United States Patent 10,696,975 (GENES AND USES FOR PLANT ENHANCEMENT) - sequence listing, part 16

SEQ ID NO: 70625 - protein, 255 aa, Brassica napus
REGKEEYVPFEVGPYCSTSSYDAAAQIFHEIIPALESLNIAVEQFHAESGKGQFEVSLGHTIAFHAADNLVYTREVIRSVARKHGLLATFVPKYDLCDIGSGSHVHISLWKNGENVFPASDKSSAHGMSSIGEEFMAGVLFHLPSIFAVLAPLPNSYDRIQPNTFSGAFQCWGKENREAAIRTASPPGAPDGLVTNFEIKACDGSTNPHLSLAIIMAAGIDGLRRHLQLPDPIDTNPADVAATLNRLPETLSKAV

SEQ ID NO: 70626 - protein, 445 aa, Musa acuminata
MFGRRTADPKSVASIILGGGAGTQLVPLTSTRATPAVPIGGCYRLIDIPMSNCINSGINKIFIMTQFNSASLNRHISGTYNFGNGINFGDGFVEVLAATQTPGDAGMNWFQGTADAVRQFTWVFEDNKNKNIEHILILSGDQLYRMDYMDLVQKHVDTGADITVSCVPVGHSRASDYGLVKIDEAGRIIQFFEKPKGADLEAMNDNGTFLRLSHQDAMKYPYIASMGVYVFKRDVLLKLLRWNYPKCNDFGSEILPSAVEEHNVQAYAFSDYWEDIGTIRSFFDANLALTEQPPKFQFYDPMTPFFTSPRFLPPTKIEKCRVMDAIISHGCFLRECSVERSIVGVRSRLDFGVELKDTMMMGADIYETEAEISSHLADDKVPIGVGQKTKIRNCVIDMNARIGKNVVIANKDGVQEADRASEGFYVRSGIVVILKNATIKDGTVI

SEQ ID NO: 70627 - protein, 460 aa, Schizosaccharomyces pombe
MEEPEEATQATQEAPLHVSQNIAKQVVNNENVFMKLVMTRMLDGKTEVIPLTTDVHNGFWGFGRHKSCEVVLNGPRVSNFHFEIYQGHRNDSDESENVVFLHDHSSNGTFLNFERLAKNSRTILSNGDEIRIGLGVPKDEISFLCQVPVKHSRDSQKNMIKSENSHYEIIRTLGSGTFAVVKLAVEVNSGKWYAIKIINKRKILLTSSEKRATEMFQREIDILKSLHHPGVVQCHEICENDDELFIVMEYVEGGDLMDFLIANGSIDEQDCKPLLKQLLETLLHLHKQGVTHRDIKPENILITNDFHLKISDFGLAKVIHGTGTFLETFCGTMGYLAPEVLKSKNVNLDGGYDDKVDIWSLGCVLYVMLTASIPFASSSQAKCIELISKGAYPIEPLLENEISEEGIDLINRMLEINPEKRISESEALQHPWFYTVSTHEHRTPPSSSEHEATEQLNSSS

SEQ ID NO: 70628 - protein, 507 aa, Musa acuminata
MSSGDSLNAELSEKTPVLGLRLWVVIGISVGVLIVFILCILSIWVTSRRKTRRTFDKLPVLQIPNVSKEITVDRVGTHSLAQSLQEHEGPFFSSYDKFSEKDSGKKLAHLTMSKSSDADNMSQCSSVHQNDRVGSSYSGDEGSSGHARKPYSPYSRVSASPLIGLPEFSHLGWGHWFTLRDLENATNRFSKENILGEGGYGVVYRGRLVNGTEVAVKRLLNNLGQAEKEFRVEVEAIGHVRHKNLVRLLGYCIEGTHRMLVYEYVNNGNLEQWLHGALHQHGVLSWENRMKVILGTSKALAYLHEAIEPKVVHRDIKSSNILIDEEYNGKVSDFGLAKLLGSGKSHVTTRVMGTFGYVAPEYANTGLLNEKSDVYSFGVLLLETITGRDPVDHGRPSNEVNLVEWLKLMVGNRRTEEVVDPNLDLKPPTRALKRALLVALKCLDPDSDKRPNMGQVVRMLEADEDRKSRRNRAASMEIESLKESNGSSDLENKVAGSDNWSCERFHA

SEQ ID NO: 70629 - protein, 278 aa, Oryza sativa
MAWCAARSRLLPLATAPQLLRRLLLSSAAAPRYAHPHHHHGGFSLLFSLSHRLLVRFPSRRSRGGGGGGGADMAEVEAAPIAAAETPEVAAAEGAAAAKAPHKLHRQWAFWYDIQSKPKPGAAWGTSLRKAYTFDTVEEFWGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNV

SEQ ID NO: 70630 - protein, 560 aa, Arabidopsis thaliana
MGSSGDVNWKLADHPKLPKGKTIGLIVLDGWGESDPDQYNCIHKAPTPAMDSLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRAKGVDAQVASGGGRMYVTMDRYENDWSVVKRGWDAQVLGEAPHKFKSALEAVKTLRAEPGANDQYLPSFVIVDDNGKAVGPIVDGDAVVTFNFRADRMVMHAKALEYKDFDKFDRVRVPDIRYAGMLQYDGELKLPSRYLVSPPLIDRTSGEYLAHNGVRTFACSETVKFGHVTFFWNGNRSGYFNEKLEEYVEIPSDSGISFNVQPKMKALEIAEKARDAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 70631 - protein, 406 aa, Escherichia coli CFT073
MTFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNNIAEYEQNLMHYALSQLAAVPDLTLYGPPDRLGVIAFNLGKHHAYDVGSFLDNYGIAVRTGHHCAMPLMAYYNVPAMCRASLAMYNTHEEVDRLVTGLQRIHRLLG

SEQ ID NO: 70632 - protein, 589 aa, Lactobacillus johnsonii NCC 533
MKKTKIVSTLGPASNDVETITKLAEAGANVFRFNFSHGDHEEHRARMNMVREVEKKTGKLLGIALDTKGAEIRTTEQEGGKFTINTGDTIRISMDDTKKGNKDMIHVTYDGLYDDTHVGGHVLIDDGLVDLLIKDKDDAKRELVCEAQNTGVIGSKKGVNAPGVEIRLPGITEKDTNDIKFGLKEGINFIFASFVRKAQDVLDIRQLLEEAHCEYVKIFPKIESQEGIDNIDEILKVSDGLMVARGDMGVEIPFINVPFVQKELIKRCNALGKPVITATQMLDSMQENPRPTRAEVTDVANAVLDGTDATMLSGESANGLYPVKAVKAMAEIDMRTEKQLAKRNKLALQRFEEYKGSNVTEAIGESVVRTAEELGVKTIIAATESGYTARMISKYRPNADIIAMTFNDKIQHSLGVVWGVKPMLTEKPKSTEEMFEKAAELAKETGLAKDGDLVIIVAGVPLGETGTTNLMKLQLIGTQLVKGLGVGEQSVIGKAVVATSAEEANSKVQDGDILVAKTTDKDYLPAIKKASGMVVEASGLTSHAAVVGLSLGIPVIVGATDAVEKIKDGSKITVDARRGAVYQGEATNL

SEQ ID NO: 70633 - protein, 429 aa, Bacillus clausii KSM-K16
MTIISDVYAREVLDSRGNPTVEVEVHLESGVMGRALVPSGASTGEYEAVELRDGGDRYMGKGVQKAVDNVNEKIAPELIGENALDQIGIDRLMIELDGTENKGNFGANAILGVSMAVAHAAANALDIPLYVYLGGFNAKQLPVPMMNIINGGEHADNNVDIQEFMVMPVGAESFKEALRMGAEIFHNLKSVLKAKGYNTAVGDEGGFAPNLSSNEEALATIIEAIEKAGYKPGEQVKLAMDVASSELYSKEDGKYHLAGEGKVLSSEEMVSFYEELVSKYPIISIEDGLDENDWEGHKLLTERLGDKVQLVGDDLFVTNTKKLAEGIEKGIGNSILIKVNQIGTLTETFDAIEMAKRAGYTAVISHRSGETEDATIADIAVATNAGQIKTGAPSRTDRVAKYNQLLRIEDELADLAQYNGLKSFYNLSK

SEQ ID NO: 70634 - protein, 422 aa, Saccharomyces cerevisiae YJM789
MVDLIARDDSVDTCQASNDYNGHAGLRILAVFIILISSGLGVYFPILSSRYSFIRLPNWCFFIAKFFGSGVIVATAFVHLLQPAAEALGDECLGGTFAEYPWAFGICLMSLFLLFFTEIITHYFVAKTLGHDHGDHGEVNSIDVDAPSSGFVIRNMDSDPVSFNNEAAYSIHNDKTPYTTRNEEIVATPIKEKEPDSNVTNYDLEPGKTESLANELVPTSSHATNLASVPGKDHYSHENDHQDVSQLATRIEEEDKEQYLNQILAVFILEFGIIFHSVFVGLSLSVAGEEFETLFIVLTFHQMFEGLGLGTRVAETNWPESKKYTPWLMGLAFTLTSPIAVAVGIGVRHSWIPGSRRALIANGVFDSISSGILIYTGLVELMAHEFLYSNQFKGPDGLKKMLSAYLIMCCGAALMALLGKWA

SEQ ID NO: 70635 - protein, 232 aa, Triticum aestivum
  misc_feature (24)..(24): Xaa can be any naturally occurring amino acid
  misc_feature (32)..(32): Xaa can be any naturally occurring amino acid
  misc_feature (197)..(197): Xaa can be any naturally occurring amino acid
  misc_feature (206)..(206): Xaa can be any naturally occurring amino acid
  misc_feature (211)..(211): Xaa can be any naturally occurring amino acid
  misc_feature (229)..(229): Xaa can be any naturally occurring amino acid
MADCMQEWPEPIVRVQAVAESGLXAIPGCYVXPQRDRPAQQHLAAAGNVLHEPSDDSIPVIDLSELLAADDGRIDGLITEAVAAACRDWGFFQVVNHGVAPELMRAVREAWRGFFRLPISAKQQYANQPRTYEGYGSRVGVQKGGPLDWGDYYFLHLAPEAAKSPDKYWPTNPGICKEVSEEYGREVTRLCEVLMTXLSASLGLEXARFQXEFGGAECGACLRANYYPXGPQ

SEQ ID NO: 70636 - protein, 510 aa, Bacillus clausii KSM-K16
MSKKPVALIILDGFGLREEEKGNAVAHAQKPNFDRYWNEFPHATLRADGENVGLPEGQMGNSEVGHLNIGAGRIVYQSLTRVNLSIREGDFFKNETFIKAMDHVKEKQSALHIYGLLSDGGIHSHIDHIYALLDMAKQQNVERVYVHGFLDGRDVGPTSAEVYLKGLQDKFDEVGLGKLATVHGRYYAMDRDKRWDRVEKSYRAMVYGEGPSYKNGLELLDDSYKNNIVDEFVIPSVITEEDGTPVATVKDDDAVIFCNFRPDRAIQLSQVFTNEDFRGFDRGEKMPKRLHFVCLTKFSETVKGFVAFKPTNLDNTLGEVLSQQNYTQLRIAETEKYPHVTFFFSGGREDEFPGEERILINSPKVATYDLKPEMSAYEVTDALVKEIEGEKHDVIILNFANPDMVGHSGMLEPTVKAIEAVDECLGRVVDALLQKGGAAIITADHGNADEVVTLDGKPMTAHTTNKVPVIVTEKGITLREDGILADLAPTVLDLLGADKPKEMTGKTLKQ

SEQ ID NO: 70637 - protein, 251 aa, Bacillus clausii KSM-K16
MRKPIIAGNWKMNKTIGEAVDFVEAVKANVPAQATVDSVVCAPALFLDRLLQAVKGTELKIGAQTMHFEDNGAFTGEISPKALSDMGVHYVIIGHSERREMFAETDETVNKKVHAAFAHHLVPIMCCGETAEEREAGKMEAVVKEQVENGLAGLSEEQVKQTVIAYEPIWAIGTGKSATEKDANEACAYVRQTVAANFSEEAAEAIRIQYGGSVKPGNIKDYMAQPDIDGALVGGASLDADSFLELVGAAK

SEQ ID NO: 70638 - protein, 273 aa, Oryza sativa Indica Group
MEKYEKLETVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWLLGTPTEEQWPGVTDLRDWHEFPQWKPQILERQVPSLEPEGVDLLSKMLQYNPANRISAKAAMEHPYFDSLDKSQF

SEQ ID NO: 70639 - protein, 499 aa, Oryza sativa Indica Group
MVQLFFQGTTDGGSVDTDAVKARRSLLGKVEPIIRSVIKSGGGYEARMWLCSTVSSIHLLDPYGQRDLFLNLLGMKNSKRDVAARLLRMIFDKKPKKAGSIIAKKCQMLQDFFQGNPKQIMQWFGHFAVTGELTHKKGARALSQFAFVNRDICWEELEWKGKHGQSPAVVATKPHYFRDLDVLQTVENFLEYVPDFWSSEELADSVKDGEILQIDTEYFVDQFVYLMYEENSRDAWQLVDEFLMDEQFSSLSQHLLIHLDEQRLLNFLRALGKLIKLNSQCKEMVFPCCWLEVLLSAHSDHISLDELVLLNCVISKGRQLWRLMNDEEQEEEQGQMQELLKSTNQLTDADHFALMKGFVDTELPDALKWIGIQSWLVFCELSKGCKSADSCEHLFTCNRIEFRKADDYPLVQNDGNSIALDSDDEDLIRGSHKRRKRDRKRKRRRYDSDEDDLDQLLELGTSNRRGIESHHGCWYLSTDGFSASWDIIHAFLDVLAAAA

SEQ ID NO: 70640 - protein, 167 aa, Candida boidinii
MAPIKRGDRFPTTDDVYYIPPEGGEPGAFELSKFVKTKKFVVVSVPGAFTPPCTEQHLPGYIKNLPRILSKGVDFVLVITQNDPFVLKGWKKELGAADARKLIFVSDPNLKLTKKLGSTIDLSSIGLGTRSGRLALIVNRSGIVEYAAIENGGEVDVSTAQKIIAKL

SEQ ID NO: 70641 - protein, 394 aa, Bacillus clausii KSM-K16
MNKKTLYDYDFAGKTVFCRVDFNVPMKDGKITDETRIQAALPTIKYLSEQGARVLLASHLGRPKGEVVESLRLAPVATRLSELLGKEVQAVQEAHGPVAKQAVEGLEDGGVLLLENVRFYPGEEKNDPELAKAFASLADIFVNDAFGAAHRAHASTEGIAHYLPSAAGFLMEKELDVLGKALSNPERPFTAVIGGAKVKDKIGVIDNLLDKVDNLIIGGGLAYTFVKAQGYEVGKSLLEEDKLDLAKQFMEKAEQKGVKFYMPEDVIVADDFSDDANKKEVAISGIPADWEALDIGPKTRKTYEAVLKASKLVIWNGPMGVFELESFAGGTKAVANALAEASDTYSVIGGGDSAAAVEQFGLADKMSHISTGGGASLEFMEGKELPGVVALSEK

SEQ ID NO: 70642 - protein, 335 aa, Bacillus clausii KSM-K16
MATKIGINGFGRIGRNVFRASLKNPNVEVVAINDLTDANMLAHLLKYDSVHGVLDAKVEAKDNSLVVDGREISVSAERNPAEIGWDKYGVEVVVESTGFFTKRADAAKHLEAGAKKVIISAPASDEDITIVMGVNEDKYDPANHHVISNASCTTNCLAPFAKVLNDKFGIRRGMMTTVHSYTNDQQILDLPHKDYRRARAAAENIIPTTTGAAKAVALVLPELKGKLNGGAMRVPTPNVSLVDLVAELDKDVTAEEVNGALKEAAEGDLKGILAYSEEPLVSGDYNGNPHSSTIDALSTMVMEGNMVKVISWYDNESGYSHRVVDLLDYIAGKGL

SEQ ID NO: 70643 - protein, 587 aa, Vibrio vulnificus CMCP6
MAKIILSQWFPGLVQLKHYQKEWLADDVRAAFSVVAVALPVAIAYAQLTGVSAIVGLYSCVLPMLVYALMGTSRQLIVGPDAATCAVIAAVVTPLAAGDATKHWQLVMTMTAMTGMWCVLASRLKLGILADFLSRPILLGLLNGVALTIIVGQFAKVVGWKYEQRYLLERLWEAPQRLADLHWPTLALSVATVAVYLITKRFRPSWPAAMLAILITTASVWLLRLQEVGVSVVGLTQGGFPNFQTPEFELGVTRELVVPALNLAMVSFVSMMLTARSFAAKNGYDIDADKEFRALGFANIASAFSQGFAISGADSRTAVNDANGGKSQLVSIIAAITIAVIAVFIYQPLQFIPIASLGVVLIIASLSLLDLKGIWILRKRDKDAFYLASITFVSVLVIGVIPGITLAVLLGLFQFLRIVMRPSDQLLGLDEEGTIRTVDGTGKATPIPGMVIYRFNSPLTYFNAPYFKRRLLEHAEHTKDVGCVVVDAVSSFTHLDLSVMATLADVHETLKKRGIRLILAGRKRRLRQWCELTGISTSEGGILLRADMYLAIKLSGCYLSAVGEGQVPTVQKEPDLEEPPKAIPEVA

SEQ ID NO: 70644 - protein, 308 aa, Moritella sp. PE36
MLKVLNQIELGIRELVEGFVEAGCPCPSKQSVIQRREGYIDSVVLAGPSPKMHEEFEDEFDGIRIKIFKPTSEKLLPLTIYFHGGCFVSGGFATHEQQMRQLAKLSNTIVVCIRYRLAPEYHYPAAHDDVYKASIHIHDHGYEYGGDPKRISFVGDSAGAHLALVTSLRLKAKSNWLPRKQVLIYPMLDPQGKSDSYSQNGKDFIITGGMLLSGFEMYLEGSNVSNKHPEISLLLRNDFSGLPPTYIVTAELDPLRDEGEELYKKLLSSGVDAYCDRYLGVIHGFFQLSAVSKSAVRCIENVARQIVN

SEQ ID NO: 70645 - protein, 563 aa, Saccharomyces cerevisiae YJM789
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNQLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 70646 - protein, 566 aa, Zea mays
  misc_feature (413)..(413): Xaa can be any naturally occurring amino acid
  misc_feature (422)..(422): Xaa can be any naturally occurring amino acid
MGEVATMSLEVMKLAAVPKANVDMFVAHRSKRRVVSSAGDSIEKATKLKAARNLDSSFAEVRRGRRDSIRGREGGSSLSQLAMAPAPHNGLNNNHPVAPMDVSVEAGNAGAAEWLDDDGRPRRSGTFWTASAHIITAVIGSGVLSLAWAIAQLGWVAGPAAMLLFAFVTYYTAALLAECYRTGHPETGKRNYTYMDAVRSNLGGVKVVFCGVIQYANLVGVAIGYTIASAISMKAVRRAGCFHAHGHADPCKSSSTPYMVLFGGVQILFSQIPDFDQIWWLSIVAAVMSFTYSSIGLSLGIAQTVSNGGFKGSLTGISIGAGVTSTQKIWHTLQAFGDIAFAYSFSNILIEIQDTIKAPPPSESKVMQKATRLSVATTTVFYMLCGCMGYAAFGDNAPDNLLTGFGFYEPFWXLLDVANVAXIVVHLVGAYQVFCQPIFAFVERRAAAAWPDSAFVSRELRVGPFSLSVFRLTWRSAFVCVTTVVAMLLPFFGDVVGLLGAVSFWPLTVYFPVEMYIKQLRVPRGSTKWICLQTLSVSCLLVSVAAAAGSIADVIAALKVYKPFSG

SEQ ID NO: 70647 - protein, 207 aa, Oryza sativa Japonica Group
MATVDGTTAPSSGGKTATVALESGGGRYGGPAPAKCSGANLALRALLFAVSLSALVVLVTAKQTVMVPFVIRPPQFILAPVPAKYTHSPALIYLLAALCATCFYSLITAISSVRLLSSSACSAKTLFYLILLDVFYAAVMASATGTAGAVAWVGLKGNSHTRWNKICNVYGKFCRHIGSSTFLALIAAIVLVLLAFLNAYSLYRRSR

SEQ ID NO: 70648 - protein, 177 aa, Rhodopirellula baltica SH 1
MSNARNKRNNKNEEQGLEAGLLDRVVKIKRCAAVVKGGRRFSFAAMVVVGNGSGQVGWGYGKANEVPPSVQKAQKQASRSMIHVPLVEGSIPHQVWGRYGAARVVLIPAGAGTGIIAGQAVRAVCEACGIHDILTKSYGTNNPVTLVKATLDAMSKLRTREQIAALRGLNPDDLIEA

SEQ ID NO: 70649 - protein, 338 aa, Glycine max
MEGYEILKDIGSGNFAVAKLVRDNCTNELFAVKFIERGQKIDEHVQREIMNHRSLKHPNIIRFKEVLLTPTHLAIVMEYASGGELFERICNAGRFSEDEARFFFQQLVSGVSYCHSMQICHRDLKLENTLLDGSTAPRVKICDFGYSKSSVLHSQPKSTVGTPAYIAPEVLTRKEYDGKVADVWSCGVTLYVMLVGAYPFEDPEDPRNFKKTIGKILSVQYSVPDYVRVSMECRHLLSQIFVASPEKRIKIPEIKNHPWFLRNLPIEQMEGGSWQMNDVNNPSQSVEEVLSIIQEARKSLNVPKVGGLLIGGSMDLDDLDADEDLEDLQTSGEFVCPI

SEQ ID NO: 70650 - protein, 387 aa, Clostridium perfringens str. 13
MELNTLKSTFINNFGKEPNSLFFSPGRINLIGEHIDYNGGFVFPCPITLGTFAAASLRDDRICRAYSLNFESLGVIEFSLDDLSYKKEDNWTNYLKGVLKVLIEKGYKIDKGIDLVINGNLPNGAGLSSSASLEMLIVKILDTFFSLNISKVDAALIGKEVENTYIGVNSGIMDQFAISLGEKDKAILLDCNSLYYEYVPLNLGDNSIIIMNTNKRRELADSKYNERRKECDDSLDTLKKYTNISSLCELTSLEFETYKDKIEDSNKLRRCVHAISENERVKDAVKALKENNLELFGQLMNQSHISLRDDYEVTGKELDTLAENAWKQPGVLGARMTGAGFGGCAIAIVNNAHVDEFIKNVGQAYKDAIGYEASFYVASIGNGPTEL

SEQ ID NO: 70651 - protein, 304 aa, Streptococcus uberis
MTKVRKAIIPAAGLGTRFLPATKALAKEMLPIVDKPTIQFIVEEALRSGIEEILVVTGKSKRSIEDHFDSNFELEYNLQEKGKTELLKLVDETTSINLHFIRQSHPKGLGDAVLQAKAFVGNEPFIVMLGDDLMDITNTKAVPLTKQLMDDYETTHASTIAVMKVPHDDVSSYGVIAPNGKALNGLYSVDTFVEKPKPEDAPSDLAIIGRYLLTPEIFDILENQAPGAGNEVQLTDAIDTLNKTQRVFAREFTGKRYDVGDKFGFMKTSIDYALKHHQVKDDLKAYIIKLGKELEKAQDSKESK

SEQ ID NO: 70652 - protein, 476 aa, Photorhabdus luminescens subsp. laumondii TTO1
MMSTEIKAQVVVLGAGPAGYSAAFRCADLGLETVLVERYSTLGGVCLNVGCIPSKALLHVAKVIEEAKALADHGIVFGEPKTDIEKVRVWKEKVINQLTGGLAGMAKGRKVKVVNGFGKFTGANTLVVEGEGGATTINFDNAIIAAGSRPIQLPFIPHDDPRVWDSTDALALTTVPGRLLVMGGGIIGLEMGTVYHALGSQIDVVEMLDQVIPAADKDVVKVFTKRISKQFNLMLETKVTVVEAKEDGIYVTMEGKNAPAEPQRYDAVLVAIGRVPNGKMLDAGKAGVDVDDRGFIHVDKQMRTNVPHIFAIGDIVGQPMLAHKGVHEGHVAAEVISGKKHYFDPKVIPSIAYTEPEVAWVGLTEKEAKEKGISYETATFPWAASGRAIASDCADGMTKLIFDKESNRIIGGAIVGTNGGELLGEIGLAIEMGCDAEDIALTIHAHPTLHESVGLAAEVFEGSITDLPNAKAKKKK

SEQ ID NO: 70653 - protein, 581 aa, Musa acuminata
MPNSPDLDFFSEYGDANRYKIQEVIGKGSYGVVCSAIDTHTGEKVAIKKIHDIFEHISDAVRILREIKLLRLLRHPDIVEIKHIMLPPSRKDFKDIYVVFELMESDLHQVIKANDDLTREHYQFFLYQLLRALKYIHTANVYHRDLKPKNILANANCKLKICDFGLARVAFSDTPTTIFWTDYVATRWYRAPELCGSFFSKYTTAIDIWSIGCIFAEVLTGKPLFPGKNVVHQLDLMTDLLGTPSLDTISRVRNEKARKYLSNMRKKLSVPFSQKFPNADPLALKLLERLLAFDPKDRPTAEEALADPYFKGLAKVEREPSCQPITKMEFEFERRRLTKEDIRELIFREILEYHPQLLKDYMNGTQSANFLYPSAVDQFRKQFAYLEENGGKSGPVIPLDRKHVSLPRSTVVHSATIPPMEQPNMGPSRDKQGTVEACKNPRDNERSSGSIAKASQAQRIPTARPGKVVGPVVPYDSGSMKDAYDPRRFIRNPVLPLQSAIPPFCFHGPAGKLGSSNRDPGEAEGESVQHKPPPHPCIPSKMAPDIALDMRASPFNGIVAAATAGGHRKVGTIQFGMTRMY

SEQ ID NO: 70654 - protein, 205 aa, Brassica napus
  misc_feature (20)..(20): Xaa can be any naturally occurring amino acid
  misc_feature (64)..(64): Xaa can be any naturally occurring amino acid
SVLFCRTCVAIAGSDYCVIXTGYSILTRDYSKIHKIADKAVLSSSGFQDDVKALQKVLNSRHLXVCQHQHNKQMSCPAMAQLLSNTLYFKRFFHYYAFNFLGGLDEEGKGCVFTYDTVGSYEKVGYSAQGSGSTLIMPFLDNQLKSPSPFLLPAQICLSVLGLFNQFKYMMNHFSYLFFVFWLCRMLSHLFPSLDLVKTEFASHP

SEQ ID NO: 70655 - protein, 123 aa, Taraxacum officinale
EYEPSEHDILYAEGVTQGNGLAFIEFSLDDRSPMSETYTDNLDAQSQPLTRYQLIRVNAKGMNEGCRWVEMFEDVRVVVFCVALSDYDQMWLSPDTTGSGSLLQNKMVQSKELFEAMVKHPCF

SEQ ID NO: 70656 - protein, 592 aa, Arabidopsis thaliana
MEDMKQSSQQIPSIRNKESLSFSQSISVIDLKKVIVVSNEDDDGALELKNRGVERTSGELLKTTVSMCLLLSLSFSKSCKKKGCEAKAKCVIKIMLQFCKENSLNQTFQTLQSECQVSLNTVDSVETFISDINSGRWDSVLPQVSQLKLPRNKLEDLYEQIVLEMIELRELDTARAILRQTQVMGVMKQEQAERYLRMEHLLVRSYFDPHEAYGDSTKERKRAQIAQAVAAEVTVVPPSRLMALIGQALKWQQHQGLLPPGTQFDLFRGTAAMKQDVEDTHPNVLTHTIKFGKKSHAECARFSPDGQFLASSSVDGFIEVWDYISGKLKKDLQYQADESFMMHDDPVLCIDFSRDSEMLASGSQDGKIKIWRIRTGVCIRRFDAHSQGVTSLSFSRDGSQLLSTSFDQTARIHGLKSGKLLKEFRGHTSYVNHAIFTSDGSRIITASSDCTVKVWDSKTTDCLQTFKPPPPLRGTDASVNSIHLFPKNTEHIVVCNKTSSIYIMTLQGQVVKSFSSGNREGGDFVAACVSTKGDWIYCIGEDKKLYCFNYQSGGLEHFMMVHEKDVIGITHHPHRNLLATYSEDCTMKLWKP

SEQ ID NO: 70657 - protein, 434 aa, Chromobacterium violaceum ATCC 12472
MFSLPTTATAPFCPAEVNGSVRIDASASFGQRLRRFAGPGLLVAVGYMDPGNWATDIEAGSRFGYQLLWVVMLSGIAAMMLQMLAARLGLVTGMDLAQASAARYGRFGRVCHWLSAEVSIIACDVAEVLGCALAFKLLFGVPLAWGVALTAFDTLIVLGLKGRGFRQLEAIVLGLIATIALCFLAQLALLDTHWPAVAAGLAPSLPAQGMDKAIVLALGIVGATIMPHNLYLHSSVVQTRRVEGGEGALRQTLLLCRIDTIGSLLLAMLVNGAILVLAGSAFHAAGHIAVADIADAHELIRPLAGSLAALLFGVALLAAGQSATLTGTVAGQVIMDGFLRIRIPCYQRRLITRALALLPAGAGIAWQGEQAVGPLLVWSQVALSLQLPLAMWPLLRMTGDRALMGADAAPRWAIASGWGLFWLILAANCALLLG

SEQ ID NO: 70658 - protein, 195 aa, Bacillus clausii KSM-K16
MNLIPTVIEQTNRGERAYDIYSRLLKDRIIMLGSGVDDNVANSIVAQMLFLQAEDPEKDISLYINSPGGSITAGMAIYDTMQFIKPDVSTICIGMAASMGAFLLTAGAKGKRMALPNSEVMIHQPLGGMQGQAADMEIHARRIIQMREKLNQIMAERSGQPYERIARDTDRDNFMTAEQAKEYGLIDKVIETPTK

SEQ ID NO: 70659 - protein, 412 aa, Vitis vinifera
  misc_feature (9)..(9): Xaa can be any naturally occurring amino acid
  misc_feature (49)..(49): Xaa can be any naturally occurring amino acid
  misc_feature (290)..(290): Xaa can be any naturally occurring amino acid
MAATSATAXTASSQLHFSSSHSISRLSPFHLRVYDSRTLVSFPTNSKRXHGVSGVRCMAVGTASEAETKKKSGFEIQALTSWLLKQEQAGVIDAELTIVISSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDSTLDSTEQRCVVNVCQPGSNLLAAGYCMYSSSIIFVVSIGTGVFAFTLDPMYGEFVLTQENIQIPKSGKIYXFNEGNYQLWDDKLKKYIDDLKDPGPSGKPYSARYIGSLVGDFHRTLLYGGIYGYPRDKKSKNGKLRLLYECAPMSYLVEQAGGKGSDGHQRILDIQPVEIHQRVPLYIGSVEEVEKLEKYLA

SEQ ID NO: 70660 - protein, 344 aa, Oryza sativa Indica Group
DPKNKECVPQVKLVIGICISIIFLIICISTLLIKIQRMKLEKEKQRFYDQNGGHILYQKIISGQVNTVEIFTEEVLKNATNNFDSGQKLGAGGHGIVYKGILRDNNVVAVKRSNFLHVTDAEEFVQEIIMLSQINHRNVVRLIGCCLEVEVPILVYEFISNGTLSYLIHGDSRRYASLKLRLRIAQESAEALAYLHLSTNRPIIHGDVKSLNIMLDDSYTVKVTDFGASRWLSNEAVEQIAMVQGTRGYLDPEYLQERKLTEKSDVYSFGVVLLELITGKKAIYRHDGDGDFESLAGSFLRAMEEERVENILDTSLAGASMEALPLLQEVAKVGSMCLSAKGKE

SEQ ID NO: 70661 - protein, 246 aa, Triticum aestivum
  misc_feature (203)..(203): Xaa can be any naturally occurring amino acid
  misc_feature (217)..(217): Xaa can be any naturally occurring amino acid
  misc_feature (223)..(223): Xaa can be any naturally occurring amino acid
  misc_feature (238)..(238): Xaa can be any naturally occurring amino acid
  misc_feature (242)..(242): Xaa can be any naturally occurring amino acid
MASVASSTTLISSPSSRVFPAKSSLSSPSVSFLRTLSSPSASASLRSGFARRSSLSSTSRRSFAVKAQADDLPLVGNKAPDFEAEAVFDQEFIKVKLSDYIGKKYVILFFYPLDFTFVCPTEITAFSDRHSEFEKLNTEVLGVSVDSVFSHLAWVQTDRKSGGLGDLNYPLISDVTKSISKSFGVLIHDQGIALRGLFIIDRXGVIQHSTINNLGIXRSVDEXMRTLQALQYIQENPXEVCXSRWK

SEQ ID NO: 70662 - protein, 709 aa, Vibrio vulnificus CMCP6
MLIPASAGVGLTSVSMGVLRAMERKGVKVSFYKPIAQPRSGGDLPDLTTTIVGANSDMKIGEPLLMSVAENLIGNDNMDELLETVVERYNQINKDADVTLIEGLVPTRKHPFANQVNAEIAATLGAEIVLVATPGTDNPAQLKERIEVACSNFGGTKNKNISGVIINKLNAPVDEAGRTRPDLSEIFDDADSAKQNQLEVMQIFNSSPIRVLGCVPWSINLIATRAIDMAKHLKAEVINEGDINTRRIKSITFCARSLPHMIEHFKPGSLLVTSADRPDVIVAASLAAMNGVEIGAVLLTGGYDIPTEIENLCKPAFESGLPIFKAQGNTWQTSLNLQSFSLEVPADDKERIEFINDHVAGHIDGNWIESMTEGTERSRRLSPPAFRYQLTELARKAGKRIVLPEGDEPRTVKAAAICAERGIAECVLLGNPEEIKRVAAQQGVELGAGVKIIDADAIRENYVARLVELRGSKGMTEVVAREKLQDSVFLGTMMLENDEVDGLVSGAVHTTANTIVPPFQIIKTAPNASIVSSVFFMLLPDQVLVYGDCAINPDPTAEQLAEIAIQSADSAAAFGIDPRVAMISYSTGESGKGADVDKVREATKLAQEKRPDLIIDGPLQYDAAIMENVAASKAPNSPVAGKATVFVFPDLNTGNTTYKAVQRSADLVSIGPMLQGMRKPVNDLSRGALVDDIVYTIALTAIQATQDQK

SEQ ID NO: 70663 - protein, 168 aa, Yarrowia lipolytica CLIB122
MVLVPPLNFAFVADGIYRSGHPLPINYPFLNQLDLKSIIYFGDRDIGDNQDYIEWAKSEGITLHYFHVNSAKEPFVENDPEAIRQALQILLDRRNFPILVHSNKGKHRIGVLVGVMRKILQGWCLAGIFDEYSRFAAGKGDLDVEFIETFETKLQFDLNYAPEWLAIQ

SEQ ID NO: 70664 - protein, 345 aa, Prochlorococcus marinus str. MIT 9303
MKSSLSSAEVPRVQTNRRNVLASLPNLPSRRTLSRWLTALFLPLLVAGLILVQPEPSHAARGGRIGGGSFRAPSMPRSSGGMRGGYGGGYGGYGGGYRGGGIGFPFLIPIFGFGGGGLFGFLILMSIVGVLVNAVRGGGRGNAALNGSGELAQRPTAAGPVTMLQLQVGLLASAKALQEDLRELAASAQTGSSSGLQRVLQETTLALLRQPELWVYANVETGSVPFASAESTFNRLSMTERSKLRAEVTSNVAGERRTDELSEKSAGEADAANEYIVVTILVASSSRIKLSESISSEQLRESLRILGSTSSTDLMALEVIWQPEGRGDVLSAEEVVTSYPNLQHL

SEQ ID NO: 70665 - protein, 219 aa, Photobacterium sp. SKA34
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKTMEDKINALPGVVTVGLFAHRGADVLLVGSPDGVKKFEK

SEQ ID NO: 70666 - protein, 144 aa, Zea mays
MSAANQLAALFSNMYATGLLDDQFQQLQMLQNASTPDFVSEVVTLFCQDGERIIGELAKLLEKPNVDFDRVDAFVHQLKGSSASIGAQKVKNTCIQFRESCQQKSKDGCLKTLETVKINFYDLRDKFQTMLQLQRQVNGCPPSK

SEQ ID NO: 70667 - protein, 659 aa, Yarrowia lipolytica CLIB122
MPAPPPPPPPPPPGFGGPPPPPPPGGGFGALSSGGAPKAGPPKGAPSRDALFSDITKGNKGRLKKTQTNDRSAAQTGGGGVLSGGAPKGPSSAPAVPGMGMGAPAVPGMGAPAVPGMGAPAVPGMGAPAAPSAPAAASAPSAPAMAQQDMSGLFAGGMPKLKKRGGNISLTDDHSSSGNSSPPQGGAPAIPSLRKTSGAPSAPGGFAPPPPPAPPGGAPAIPGAPSVASSYRSASASSGAPPPPPGGAPPIPGGAPPPLPGKVSTSGGAPTFGAPPPPPPGGAPAYGAPAPPTPGTSSPKPPPKPAKRPPALKPKPKIPTPGLKPAVPTPGQRRSVSPSPGAPPPPIPGSVAPSVRHAPSQSVSSIASSVSTPSTPPPAPPAPPPVPGGAAPPIPGSAAPPAPPPAPPAGFGAPAPPSFGAPTPPPAPPAPSAPPAPPAPPAPPSEPPSTPRGPAMFGAPMPKSPAAASPGAPPPPPPGAAAPGLAPPAPPAQPPSPGRPSGAPPPPPGPPAPPTDQFHSMILDDGSSSGSHGAPPPPPPSAPPSNGGHSHGAPPPPPPNGGVNRRRDVVQRTSTLGSNNIRTLDTSAYTIAPRAVSTPVGSSSGGGGGSKPPQIKIDDSRWKWRNAHDLPKPRRFEGKTKLYASGRGSSVPLNLAAYE

SEQ ID NO: 70668 - protein, 410 aa, Prochlorococcus marinus str. MIT 9303
MAPFRLDVVTLVPQAFTPLGELGVIGRAFASGIAALHTHNPRDYTTDRYHKVDDQPYGGGAGMVLKPEPVFAAFEAIPVQSRRRVLLLTPQGKPLCQKDLHRWVVDHDQLVLICGHYEGFDERIRGLADEEVSVGDFVLTGGELPAMTVINGVVRLLPGTVGTAESLQDESHSDVLLEHPHYTRPANFRGMVVPDVLRSGDHGAIALWRQQQRQLRTQLRRPDLYVRWSDQQQSSTLTMESHGSASMQFRIGNGYDIHRLVPGRPLILGGVTLDHPDGLGLDGHSDADVLVHALMDALLGALSLGDIGKYFPPDDPRWKGADSLMLLEQVVALVRDRGWQVLNVDAVVVAERPKLKPHINAMRSNLAQRLGVELDAVGVKATTNEGLGPEGREEGMSSQAVALLQQIGLT

SEQ ID NO: 70669 - protein, 532 aa, Oryza sativa Indica Group
MADEATTTPLLVSYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHACATEREDDAAGGAGGGGGGVFATLRSMWERRWALRRLAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 70670 - protein, 387 aa, Photobacterium sp. SKA34
MSVIKMTDLDLAGKRVFIRADLNVPVKDGKVTSDARIIASLPTIKRCLEAGAKVMVTSHLGRPTEGEYAEEFSLQPVVNYLNDALDCDVKLAKDYLNGLELNAGELVVLENVRFNKGEKKNEDELSKQYAALCDVFVMDAFGTAHRAQASTYGVGMFAPVACAGPLLAGELEALGKAMDNPARPMVAIVGGSKVSTKLTVLESLSKIADQIVVGGGIANTFIAAEGNDVGKSLYEADLIPTAKELMAHTDIPVATDVVCAKEFSDSAEATIKPATEIAADDMVLDLGPDSAQALADIIMNAKTILWNGPVGVFEIEQFGKGTEVVANAIAESAGFSVAGGGDTLAAIDKYGIKDKVSYISTGGGAFLEFVEGKKLPAVEMLESRAKA

SEQ ID NO: 70671 - protein, 348 aa, Photobacterium sp. SKA34
MTLKVAINGFGRIGRSVLRALYESGKHHQINVVAVNELAEPEAMVHLLQYDSSHGRFKNPVSHDQEHLFIAHDNGRQDQIRILHQLDLKLLPWHDLDVDIVLDCTGKFGSRADGLAHIASGAKKVLFSHPASKDIDCTVIYGVNHQQLTSQHRIVSNGSCTTNCIVPIIKILDDQFGIESGTITTIHSAMNDQQVIDAYHPDLRRTRAASQSIIPVDTKLHLGIGRIFPKFSDKFEAISVRVPTINVTAMDLSVTVKTNVKVNDVNQSLKNTSRCTLSGIVDYTEAPLVSIDFNHDPHSAIVDGSQTRVSNQHLIKLLVWCDNEWGFANRMLDTALAMYATEHTDTEK

SEQ ID NO: 70672 - protein, 532 aa, Photorhabdus luminescens subsp. laumondii TTO1
MAIKIKVPDIGADEVEVTEIMVKVGDTVEAEQSLITVEGDKASMEVPSPQAGVVKEIIIAVGDKVETDKLIMIFDSAEGAVEAAPAEAPAAVTLSSRMAEPEPVASAAMKVHVPDIGGDEVEVTEVMVKVGDAVEAEQSLITVEGDKASMEVPAPFAGIVKEIQIKAGDKVETGSMIMVFEVAGAAPVAPVASAPAPTAEPEKAAVPVIASRSFAEEDKNDFAENSAYVHATPVIRRLAREFGVNLAKVKGTGRKGRVLREDVQAYVKDAVKRAESAPASAGGGLPGMLPWPKVDFSKFGEIEEVELGRIQKISGANLSRNWVVIPHVTQFDETDITEVENFRKQQNQEAEKKQLGVKITPLVFIIKAVAKALEEMPRFNSSISEDGQKLTLKKYINIGVAVDTPNGLVVPVFRDVNKKGIIELSRELTEMSKKARAGKLTASDMQGGCFTISSLGGIGGTAFTPIVNAPEVAILGVSRSSMKPVWNGKEFVPRLMLPLSLSFDHRVIDGADGARFITFINHAMSDIRRLVM

SEQ ID NO: 70673 - protein, 534 aa, Oryza sativa Indica Group
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFLLTTLADTLLGRRKMLVLSLVTMSVAGVLTVFSPNVWVYAALRFVCGFCRSTAGTSAMVLSTELVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEETAAVLSGG

SEQ ID NO: 70674 - protein, 554 aa, Oryza sativa
  misc_feature (511)..(511): Xaa can be any naturally occurring amino acid
MASISPTSSSVAALRGHPVQFVKGGAVSKEAKGSISFSPVANSNNANVKFTGLRVAASLKRDGAFPGDGYSGNDNTVLPKSTSVRGQDYPTADSVLPTESVIVPEISNAGLKCVADMFSDEDKDTEQDLDSPTEGFSSISEAIKDIQQGKLVIVVDDESRENEGDLIMAASLVTPEAMAFVVRYGTGIVCVSMKEEDLERLNLPLMVATKENEEKLCTAFTVTVDAKEGTTTGVSAKDRAKTVMTLASPDSKPEDFNRPGHIFPLKYREGGVLKRAGHTEASVDLAMLAGLPPAAVLCEIVDEDGSMARLPKLRVFAERENLKIVSIADLIRYRRKRDRLVERSSVARLPLRWGNVRAYCYRSVIDGIEHIAMVKGEIGDGQGVLVRVHSECLTGDIFGSARCDCGDQLAMAMEMIEKAGRGVLVYLRGHEGRGIGLGHKLRAYNLQDDGRDTVEANEDLGLPVDSREYGIGAQILRDLGVRSMKLMTNNPAKYGGLKGYGLSIVGRVPLXVTPITSENRRYLETKRTKMGHVYGLANGQASHQTGSNGAKGEH

SEQ ID NO: 70675 - protein, 217 aa, Escherichia coli O157:H7 EDL933
MNQTLLSSFGTPFERVENALAALREGRGVMVLDDEDRENEGDMIFPAETMTVEQMALTIRHGSGIVCLCITEDRRKQLDLPMMVENNTSAYGTGFTVTIEAAEGVTTGVSAADRITTVRAAIADGAKPSDLNRPGHVFPLRAQAGGVLTRGGHTEATIDLMTLAGFKPAGVLCELTNDDGTMARAPECIEFANKHNMALVTIEDLVAYRQAHERKAS

SEQ ID NO: 70676 - protein, 377 aa, Brucella melitensis 16M
MKIDYYEALGVTRTADDKTLKAAFRKLAMQYHPDRNPDDPEAERKFKEIGEAYETLKDPQKRAAYDRFGHAAFENGGMGGGFGNGFGGAGGFADIFEDIFGEMMGGGRRRSNGGRERGADLRYNMEVTLEEAYAGKTAQIRVPTSITCDECSGSGAKPGSQPTTCTMCSGSGRVRAAQGFFSVERTCPGCNGRGQIIKDPCEKCHGQGRVTQERSLSVNIPAGIEDGTRIRLAGEGEAGLRGGPAGDLYIFLSVKPHEFFQRDGADLYCKVPISMTTAALGGQFEVSTLDGTQTRVKVPEGTQNGKQFRLKGKGMPVLRQSVTGDLYIQIDIETPQNLSKRQRELLEEFEKLSSQENSPKSAGFFSRMKEFFEGIGE

SEQ ID NO: 70677 - protein, 470 aa, Pseudomonas putida KT2440
MATPSKAFAIAHDPLVEADKAHYMHGYHVFDEHREQGALNIVAGEGAYIRDTHGNRFLDAVGGMWCTNIGLGREEMALAIVDQVRQLAYSNPFSDMANDVAIELCQKLAQLAPGDLNHVFLTTGGSTAVDTAYRLIQYYQNCRGKPHKKHIIARYNAYHGSTTLTMSIGNKAADRVPEFDYHHDLIHHVSNPNPYRAPDDMDEAEFLDFLVAEFEDKILSLGADNVAAFFAEPIMGSGGVIIPPEGYFQRMWQLCQTYDILFVADEVVTSFGRLGTFFASEELFGVTPDIITTAKGLTSAYLPLGACIFSERIWQVIAEPGKGRCFTHGFTYSGHPVCCTAALKNIEIIEREQLLDHVNDVGSYLEQRLQSLRDLPLVGDVRCMKLMACVEFVANKASKALFADEVNIGERIHSKAQEKGLLVRPIMHLNVMSPPLIITHAQVDEIVETLRQCIIETARELTALGLYQGR

SEQ ID NO: 70678 - protein, 503 aa, Arabidopsis thaliana
MVIGLSTMLEKTEALFASDHASVVSMNLFVALLCACIVLGHLLEETRWMNESITALIIGSCTGIVILLISGGKSSRILVFSEDLFFIYLLPPIIFNAGFQVKKKQFFRNFMTIMLFGAIGTLISFVIISFGAKHLFEKMNIGDLTIADYLAIGAIFSATDSVCTLQVLNQDETPLLYSLVFGEGVVNDATSVVLFNAIQRFDLTNINSAIALEFAGNFFYLFILSTALGVAAGLLSAFVIKKLYIGRHSTDREVALMMLLAYLSYMLAELFHLSSILTVFFCGIVMSHYTWHNVTDKSKVTTKHTFAAMSFLAEIFIFLYVGMDALDIEKWDVVRNSPGQSIGVSSILLGLILLGRAAFVFPLSFLSNLTKSSPDEKIDLKKQVTIWWAGLMRGAVSMALAYNQFTTSGHTKVLGNAIMITSTITVVLFSTVVFGLLTKPLVKHLQPSSKQSSTTALQITLRSSFHDPILHEPLLSTQGQSEYDPEQHVSFRMFWKSPSRFTH

SEQ ID NO: 70679 - protein, 251 aa, Triticum aestivum
LNAADSTPNGAATAAAVAFEAPALVMEPSFDDVPEVVGWMSSMVDRGGRASQESHRLFLARRTALEMLRDRGYSVPESELARTLPEFRAWWAPEPEIERLTFSTFLASDHSDKVKILFCGPEPVRIATIQKIYDQIEGENLSRLILILQGKIMPRAKESVKEKFTFKVDIFQVNELLVNISKHALKPKHEVLTAEEKARLLKKYNVQDSQLPRMLETDPVARYYGLGKGTVLKVTYDSELTGNHVTYRCIF

SEQ ID NO: 70680 - protein, 130 aa, Oryza sativa
  misc_feature (72)..(72): Xaa can be any naturally occurring amino acid
  misc_feature (105)..(105): Xaa can be any naturally occurring amino acid
MSAYCGKYKDELIKNAAYIGTTGKAILADHEISATIGKRFASINVDIVEANRRSLRELLLNTPGALQHHKGXVILLEETLYQKTKDGKPSMDVLKEAGAHAGIQXDKDTVDVDRPTKETTTQGHDDLGMR

SEQ ID NO: 70681 - protein, 396 aa, Pseudomonas putida KT2440
MRYAKLTQRIAGDGAAAWDIHYRALALQAEDKDILLLSVGDPDFDTPAPIVEAAIDSLRAGHTHYADVRGKLALRQAIANRHRQRSGQAVSADQVTVLAGAQCALYCVAQCILDPGDEVIVAEPMYVTYEAVFGACGAKVVPVPVKPENGFRVCPRDVAERITPRTRALALNSPHNPSGASLPRATWEALAELCVAHDLWLISDEVYSELLYEGEHVSPGSLPGMAERTATLNSLSKSHAMTGWRMGWVVGSTALATHLENLALCMLYGLPDFVQDAAVVALEHPLPELDAMREAYRQRRDLVCEQLAGCPGLKALKPDGGMFVMLDIRETGVSAQAFADYLLDSQGVSVLAGEAFGPSAAGHIRLGLVLGNEALVDACQRIARCAGELMRGQTDA

SEQ ID NO: 70682 - protein, 452 aa, Burkholderia xenovorans LB400
MSRSNAVNVQTFINDHPFSPFQWLVFFMCFIIVLLDGFDTAAIGFIAPSLIAEWGITRPALAPVLSAALFGLACGALGSGPLSDRLGRRSMLLAAVLLFGVACLGSAFSNSIEQLTALRFITGVGLGAAMPNAVTMMGEYCPDRRRATVINLMFCGFPLGAAFGGFLAAWMIPHFGWRSVLLLGGITPLLLLVVLVIQMPESVRYMVANGQPVERIRAALLRISGEAAQAGTFIMTESAPQTGGKGAAVVLSRSYIIGSVMLWVAYFMGLVIFYASINWMPILLKDAGLTPQRATLISALFPLGGVGAVLCGVLMDRFNANRIIAACYALTAVSVYFIGQAVGNVGALVFIVFVAGVLMNTAQSSMPALAAAFYPTEGRGTGVAWMLGVGRFGGIAGSFLVAELTRRHFTFAGIFATVAAAGLISCVALLIKQAARPHVANVSASKTESFGH

SEQ ID NO: 70683 - protein, 320 aa, Escherichia coli
MNIWTLGDAVVDLLPLTDMQFRACAGGAPFNVAIGTAQLKCRTGFIGRVGDDDFGHFLRKTLEDSGVSTQCIQMDKYHRTSTVLVSLKDQGERGFTFLTNPSADQFLTQDALPAFSDDILHFCSLALVAADCRTTLTKAVQEVIDHGGLISFDVNLRDQMWRDKEEMFATVSQFAEKADILKLSEEEWYWLMGTHDYTEALEALKTHPARLKVVTFGARGSLVLWQDMVIHFRGFNVKSIDTTGAGDAFMAGLLASIANKGLPMNFPELQLAITQASATGALATTKKGALTALPDTAALETFINHFPLPGYEILGATATV

SEQ ID NO: 70684 - protein, 460 aa, Synechococcus elongatus PCC 6301
MLQFLSSALGWPPILAETIEIIESPEASTLILVSVLLGLVVVYLASKLGGELCVRVNLPPVLGELLGGVLVGTSVLRLLVFPSSGAGAEDVVLLNFLQQISGAPDNWMPTIFATQSEVISVLSEIGVIILLFEIGLESNLDELLKVGTKAAIVAVVGVAAPFAAGTLGLIYLFHIATIPAVFAGAALTATSIGITAKVLSELGRLNSPEGQIIIGAAIIDDILGIIVLAVVSSLAKTGEIRPSNIVILIVSSTAFLVGAIFIGRWLNPFFVNLVSSMQTRGEVLVVALVAAILAGLIAQFVRLEAILGAFAVGLILAETEKGEELKEQVKPLADVLVPIFFVVVGAKTDLSVLNPADPVNRAGLIIAGFLLVVAVLGKVITGFRLVGSSTPLNRLAIGVGMIPRGEVGLVFAGVGASSGILSESLNAGVIVMVIMTTFLAPPLLRLAFRGEPTTAVEPGS

SEQ ID NO: 70685 - protein, 163 aa, Chromobacterium violaceum ATCC 12472
MRHILSILLENEAGALSRVVGLFSARAYNIDSLTVSTTEDPTLSRMTIVTHGSDEVIEQITKQLNKLIEVVKVIDLNESEHIEREMMLIKVRAVGKDREEMKRMADIFRGRIIDVTEKTYTIELTGTSDKLGAFIEAVDRTVILETVRTGASGIGRGERVLKI

SEQ ID NO: 70686 - protein, 792 aa, Escherichia coli CFT073
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKHVIVRLSDFKSNEYANLVGGERYEPDEENPMLGFRGAGRYVSDSFRDCFALECEAVKRVRNDMGLTNVEIMIPFVRTVDQAKAVVEELAHQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 70687 - protein, 318 aa, Synechocystis sp. PCC 6803
MKPTVIITGASSGVGLYGRKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 70688 - protein, 465 aa, Oryza sativa Indica Group
MAAGVTFNWIKTPLDIRRFHDFSSLSFRCRNTFGSIQPSWLTTDQEPSFSKVRVAADYSDSVPDSKYTRDRGYHPLEEVKERPKKKDLSLTDVETARTVVEANSKGLLVFPARVHNEPHGHVAWSDFQYIVDDYGDIFFQVPDSENILEDDAANNPVTVLIGMDGPIIGETSVVISDFSDYMDVENFIDMPDENDSKIDTEITDILIEWGMPATMRAIHPIYFAKCLTKGAKSLSSGNKSKSPDLNLILQKGKKKVEIQVHEKAVHDKHREKMDSPSNGVSIVGYLRPAFIEEESYLRSLFHGECNGDGYSSDWRDDDKSRFDFTNVGSSTDSTIYKLEIMTVELFSIYGKQLMIDPQDFQDAEPDILANSASEIINRIKENDDQCAMALRSLCHRKKGLTVEEASLISIDSLGIDVRAFSGLEARTVRFSFNAQALSERSAEKKIRRMLFPRRKNVKPSTEDEC

SEQ ID NO: 70689 - protein, 478 aa, Escherichia coli CFT073
MTLSFITRWRDELPETYTALSPTPLNNARLIWHNTELANTLSIPSSLFKNGAGVWGGENLLPGMSPLAQVYSGHQFGVWAGQLGDGRGILLGEQLLADGTTMDWHLKGAGLTPYSRMGDGRAVLRSTIRESLASEAMHYLGIPTTRALSIVTSDSPVYRETVESGAMLMRVAPSHLRFGHFEHFYYRREPEKVRQLADFAIRHYWSHLDDEEDKYRLWFTDVVARTASLIAQWQTVGFAHGVMNTDNMSLLGLTLDYGPFGFLDDYEPGFICNHSDHQGRYSFDNQPAVALWNLQRLAQTLSPFVAVDALNEALDSYQQVLLTHYGQRMRQKLGFMTEQKEDNALLNELFSLMARERSDYTRTFRMLSLTEQHSAASPLRDEFIDRAAFDDWFARYRGRLQQDEITDSERQQLMQSVNPALVLRNWLAQRAIEAAEKDDMTELHRLHEALRNPFSDRDDDYVSRPPDWGKRLEVSCSS

SEQ ID NO: 70690 - protein, 480 aa, Prochlorococcus marinus str. MIT 9303
MQLANKQLLDPSNQLSDQRNKRRRLRFILQIAISAALGGFLFGYDTAVINGAVGAIGTAFTVSKETLGFAVASALLGSALGAFTAGWLSDRIGRRNSMLVAALMFLVGSLGSALAPTITTLILWRVVGGLAVGFASVLAPAYIAEISPASMRGQLGSLQQLAIVIGIFLALLFDYVIVLLTADQNPVSLIGPLAAWRWMFMSEIIPAALYAVLVIGIPESPRYLVQKGLTQRAKAVIEKTLHEPADQVIARIQSSLVNTHQGKLSELFDRHTILLPIIWTGVMLAIFQQFVGINVIFYYSSVLWQAVGFSAKDSLIVTVITSITNVVTTFIAIAFIDRLGRKPLLLAGSVVMAVNLGVMSWAFAGAPLVNGAPHLAGAGAIVALIAANLFVFAFGFSWGPVMWVMLGEMFNNRIRAVAIGLCAMVNWIANFLISDTFPGLLERSGPALAYGLYATAAAISFFLVLFFVRETKGMELEEMA

SEQ ID NO: 70691 - protein, 198 aa, Vibrio vulnificus CMCP6
MAEVRARVDFKVGAKSNIDAEILSFRGLKTDKEHVAVIFKSADVTQEVPLVRMHSECLTGDVFHSSRCDCGEQLEETINRMGESGGIILYLRQEGRGIGLYNKIDAYRLQSEGMNTYEANNHLGFDDDLRDFTEAAQMLEALGIKQIRLVTNNPKKIRELSEYGIEIVEVVNTSAHIKEGNESYLKAKVSHGKHHLKV

SEQ ID NO: 70692 - protein, 444 aa, Bacillus cereus G9241
MHILVVSVNYRTAPVEFREKLTFQAAELEQAMTTLQNQKSVLENVIVSTCNRTEVYAVVDQLHTGRYYIKKFLADWFQLEIEEVAPYLTIFEQDGAIDHLFRVTCGLDSMVVGETQILGQIKDSFLEAQQVKATGTIFNELFKQVITLAKRAHSETTIGESAMSVSYAAVELGKKIFGELTDCHVLILGAGKMGELALQNLYGSGARKVTVMNRTLSKAEIMAEKYMGHAKPLSELQCALLEADILISSTGASDYVITKEMMTKVEKMRSGRPLFMVDIAVPRDIDPAIDELEGSFLYDIDDLQGVVEANRAERLKEAEKIQFMIEEEIVLFKTWLSTLGVVPLISALRDKALAIQSETMESLERKIPNLSDRERKVISKHTKSIINQLLKDPILVAKEIAAEEGADEKLALFAKIFDLEMEDVESRAEEVEHKRAWTPSVPSL

SEQ ID NO: 70693 - protein, 452 aa, Yarrowia lipolytica CLIB122
MSATKSAGPTTLANHLDKEVKTDVLGAIDSDKLTEATQGDHKAINEEYKIWKKNSPYLYNVVIATVMDHPTLTVEWLPDLFDDITPGSMSARLMFGSHSSGLDKDYIHVASVELPTHLRPETIGLLSQQEGGTDMKQHHDAHGRHKRIAIVQSIYEDGEVNVARYNPLASKQIAAAHVTGDIHIFDRNNIMNSKEEAKPIYNLKHHTKEGWGLNWNINHADQLVSGAIDSTVAFWKIPEAASDGSCKDVTPHTVYHHDAAVNDVKFSYKMDFLIGSASDDCTLRLWDTRKPGNKAACTIKESRGINSLDFNPHSEFLVATGSADETVKVWDMRKMDTPISQLYSHCDEVTKVQWCPHQPSVLASGGHDRAILVWDIARLHDDLSSDENDEGPPELLFHHGGHSSRISDFDWHPTLPWVIASAAEDNVIQVWRMAESISNDEAVPADDVDMED

SEQ ID NO: 70694 - protein, 335 aa, Oryza sativa Japonica Group
DDENLTKEQIEAEIKKIKEANAEDEEFPDEVETPLDVPAKRRFAKYRGLKSFRTSSWDPKESLPQDYARIFAFDNFTRTQKHVLAKMAERDEGTLKDCAQRGSFVRLHLKNVPTEIASKLVHPSRRLPVVVSGLLQHESKISVLHFSIKKHDSYEAPIKSKDSLIFNVGFRQFTARPLFSTDNINCNKHKMERFLHHGRFSVASVYAPICFPPLPLIVLKSRDGEQPAIAAVGSLKSVDPDRIILKKIVLTGYPQRVSKLKAVVRYMFYNPEDVKWFKPVELWTKHGRRGRIKETVGTHGAMKCIFNSSVQQHDTVCMSLYKRAYPKWPEQLYQI

SEQ ID NO: 70695 - protein, 496 aa, Moritella sp. PE36
MIFLSNKQDWLGNVKGDILAGIVVALALIPEAIAFSIIAGVDPKVGLYASFCIATIIAFTGGRPGMISAATGAMALLMVTLVKEHGLEYLLAATLLTGVLQILAGYLKLGGLMRFVSRSVVTGFVNALAILIFIAQLPELTNVTWHVYAMTAGGLGVIYLFPHIPVIGKSIPSPLVCIVLLTVLSQVMELDIRTVGDMGALPDTLPIFLWPEVPLTLETLWIILPYALGLSVVGLLESMMTATIIDDLTDTKSDQNRECKAQGIANIGAGLMGGMAGCAMIGQSIINIKSGGRGRLSSLSAGVFLLIMVVFLGDWLKQIPMAALVAVMIMVAIGTFSWSSIKDLKTHPLSTNIVMIATVITVVGTHNLAIGVFVGVLLSALFFAHKISRFMVVKNTEIAQQGRTYQVTGQIFFVSADKFVDAFDFKEVVDSVVIDLSHAHFWDISAVGALDKVVIKFRREGATVNIVGMSDATATVIDKFAIHNDPAAVEKMMAGH

SEQ ID NO: 70696 - protein, 342 aa, Ralstonia eutropha JMP134
MPAMMKAAVVRAFGAPLTIDEVPVPQPGPGQVQVKIEASGVCHTDLHAADGDWPVKPTLPFIPGHEGVGYVSAVGSGVSRVKEGDRVGVPWLYSACGYCEHCLQGWETLCEKQQNTGYSVNGGYGEYVVADPNYVGLLPDKVGFVEIAPILCAGVTVYKGLKVTDTRPGQWVVISGIGGLGHVAVQYARAMGLRVAAVDIDDAKLNLARRLGAEVAVNARDTDPAAWLQKEIGGAHGVLVTAVSPKAFSQAIGMVRRGGTIALNGLPPGDFGTPIFDVVLKGITIRGSIVGTRSDLQESLDFAAHGDVKATVSTAKLDDVNDVFGRLREGKVEGRVVLDFSR

SEQ ID NO: 70697 - protein, 198 aa, Bacillus cereus G9241
MKVTKADIVISAVKPEQYPEGDLPEIALAGRSNVGKSSFINKILNRKKLVRISSKPGKTQTLNFFLINEMMHFVDVPGYGYAKVSKTERAAWGKMIETYFTTREQLDAAVLVVDLRHKPTNDDVMMYDFLKHYDIPTIIIATKADKIPKGKWQKHLKVVKETLDIESGDEVVLFSSETGLGKEEAWKAIHKFTKTKNA

SEQ ID NO: 70698 - protein, 506 aa, Ralstonia eutropha JMP134
MNMAEIAQLGVTNPYKQQYENYIGGAWVPPAGGEYFEAITPITGKPFTRVPRSKQEDVDAALDAAHAAKAAWGRTSTTERANILNRIADRIEANLTLLAVAETIDNGKPVRETMAADLPLAVDHFRYFAGCIRAQEGGISEIDAETIAYHFHEPLGVVGQIIPWNFPLLMATWKLAPALAAGNCVVLKPAEQTPASILALMEVIGDLLPPGVVNVINGFGLEAGKPLASSPRISKVAFTGETTTGRLIMQYASQNLIPVTLELGGKSPNIFFEDVLAADDAYFDKALEGFAMFALNQGEVCTCPSRALIQESIYDRFMERALKRVAAIRQGHPLDKGTMIGAQASAEQLEKILSYIDLGRKEGAQCLAGGERNQFDGDLAGGYYVKPTVFKGHNKMRIFQEEIFGPVVSVTTFKDEEEALAIANDTLYGLGAGVWTRDGARAFRMGRGIQAGRVWTNCYHAYPAHAAFGGYKQSGIGRENHRMMLDHYQQTKNLLVSYSPNALGFF

SEQ ID NO: 70699 - protein, 342 aa, Zea mays
IMKRASETLIPVTLELGGKDSFIVCEDVDLPSVVQVATRAALQSSGQNCAGAERFYVHDDIYSAFVSQIVKTVKSISVGPPLSGRYDMGAICMIEHSEKLQNLVNDALDKGAEIAVRGSFGNLGEDAVDQFFPPTVLVNVDHTMKIMQEETFGPIIPIMKFSSDEEAIKLANDSKYGLGCAVFSGNQKRAIRIASQLHCGVAAINDFASSYMCQSLPFGGVKDSGFGRFAGVEGLRACCLVKSVVEDRLWPYIRTVIPKPIQVYFFPSPHDTSTLDLHGLLGSCGSAMYPVSEHGFEFQQLLVETLYGYSVWDRLRSLVNLIKMVTEQNSAPASNATTKKRR

SEQ ID NO: 70700 - protein, 1383 aa, Moritella sp. PE36
MINVTFNGQIFSVNAHQTLLEVATDCHVDIPSLCGLNKHGEKVPCDLCVVDIAGQGIQRACEMTPVEGMAVTTTSATLSALRQKSLNRILSDHYADCEAPCQTACPAGVDIQSYLYHISQNDHAKAVEVIKRTLPMPLSIGRVCPAFCETECRRGLVDEPVAIRQLKRHSADIDLEAQAQYVPLKKPIKGKSIAVVGSGPGGLTCGYYLTNEGYNVTVFESMPDAGGWLRYGIPEYRLPKAILAKEIEIMCRNGMQVLTNKKLGDDFTLTQLTQDYDAVCLAVGASQAVAMQYSGSDFDGCYLGVDYLKDYVTDGNYTTGKKVAVIGGGNTAIDCARTAVRDGADTTLIYRRTRAEMPAEDYEILEAEHEGVKFHFLTNPVENIADANCRVCEIKLEKMALGEPDASGRRRPEKTGEYFTEAFDTVIAAVSQKPDLSFMDKETLDLPLTRWNTQDAHPDTMHSGVGNIFSIGDFRRGPATAIEAVADGRIAAEAIDRYFDGDMENIPVKQFNSQKARKLKQVDTAQFDSIKQAMRSVMPELSPQQRELSFAEVETGFDNDEAMREAARCLECGCQANTDCQLRDFATEYKVADTNVSQDGCQKFVVDDSSEFIVFDANRCISCGQCVDACNEQAVHGVLSFMKNDDGASASRPECRPGFENGFSMGDSNCVQCGRCVQVCPTGALVDSRDKSQGRIEILKPVDTICTYCGVGCKLTMFVDEAQNKIRYVQGVKDSPVNQGMLCVKGRFGFDFVSSKERLTTPLIRKHGELQPASWEEAITLVADKFNAIKNNHGGNALAGFSSAKTTNEDNFAFQKFIRRELETNNVDHCARLCHASTVTGLEASIGSGAMTNDIPSIKHSDMIFIIGSDTTSAHPIIASHIKQAIRHGNARLIVADPKRIDIADHAQLYVAHRPGTDVMLINGIMQQIIKNGWHDKAYIDERTEGFNALAAEVMSDNYAPDKVELITGVKAQDVIKMAEMIGTADRTAVYYSMGITQHTTGHDNVRSVANLQMLCGNIGIEGGGINPLRGQSNVQGACDMGALPNSLPGYQKVYEPEVQEKFAKAWNKANLPKEVGLTLTEIIDAACHGEVKGLYVMGENPVLSDPNQAHVIDALEQLDFLVVQDIFLTETAQYADVVLPSCSFAEKSGHFTNTERRVQRISPAVKPPGEAKEDWLIIQDIANAMGSDWAYQSVEDITKEITQLTPQYAGIHWHRVGKDGLQWPCPDDASPGTRIMHTEQFTRGKGEMVAVPFRYAAELPDDEYPLILTTGRLLEQFHTGTMTRKTKGLDNLAGPRAMISVADAERLGVVNGEMLTVTTRRGSIDTPAFVTKRMQEGVVFVPFHFAESPANRLTTTATDPHAKIPEFKVAAVKIEKALLSVF

SEQ ID NO: 70701 - protein, 392 aa, Zea mays
MAEPGLEGSQPVDLSKHPSGIVPTLHGIFLKCVGSSVPLNRGMKPFLAAISVSPGASAFKRRGTWGSFELKESGGNEMDGEYARHWMSADVKSRVSSSVGRSGSDDLFRPYEISGWAGYASLVAAILKLHETVRMDWPNSWAAVVPSSSVMLRDCGTMLKIRLCSHEEGNKDRNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLSEFRKIQQWVDGYSVQLTYVMYSFMEHVWDWAPMTCDVKVTFFKLQASSRILV

SEQ ID NO: 70702 - protein, 83 aa, Magnetospirillum magnetotacticum MS-1
MRFDAVYVGHFKCNRQRIADYPNLSHYLRDLYALPGVAETVNLDHIKRHYYGSHAGINPTGIVPLGPELHFDAPNDRALRFGR

SEQ ID NO: 70703 - protein, 177 aa, Zea mays
MSGFAAHLVLLLLVLVSVSLSPSVRCLGKERTLAMIKPDGVSGNYTEEIKRLIVEAGFNIVKERLTQLEKEAASAFYDEHSSRSFFPHLVSYMTSGPVVVMVLEKGDAVSDWRGLIGPTDSQKAKISHPHSIRALCGKDSQRNCVHGSDSTSSAEREINFFFKDVVSGDIASQHDEL

SEQ ID NO: 70704 - protein, 550 aa, Chrysanthemum x morifolium
MVFDSGLLLGKLGSTSLGTSEYSSIVSMNLFVALLCACIVIGHLLEENRWMNESITALVIGICTGVIILLISGGTNSHILVFSEDLFFIYLLPPIIFNAGFQVKKKHFFRNFMTIMLFGAVGTMISFTIISIGAINIFSRMNIGSLELGDYLAIGAIFSATDSVYTLQVLNQDQTPLLYSLVFGEGVVNDATSVVIFNAVQNFDLSQFNTTVVFQLIGNFFYLFLTSTLLGAGAGLLSAYVIKKLYFGRHSTDREVAIMILMAYLSYMLAELFYLSGILTVFFCGIVMSHYTWHNVTEKSRVTTKHAFATLSFIAELFIFLYVGMDALDIEKWRYVKDSPGTSVEVSAILLGMVLVGRVAFVFPLSFLSNLTKKGHQEKIDFRQQVLIWWAGLMRGAVSMALAYNQFTKEGHTTLQGNAYMITSTITVVLFSTMVFGLITQPLVRLLLPAPKGLNRMISSEPTTPKSFLVPFLGNGQDSEADLGHHIARPTSLRMLLSTPSHTVHHYWRKFDNAFMRPVFGGRGFVPFVPGSPTEQSTHHLVDEEDEERN

SEQ ID NO: 70705 - protein, 468 aa, Pseudomonas putida KT2440
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 70706 - protein, 134 aa, Zea mays
SISSIQKLGKMLMAKCRTLQEENEEIGAMASEGKIHELGMKIAVLKSQNNELRNQFDVLYKHMDGVTNDVERSNELVAILQEELEAKELEVTRLKEETLSQKEGTQDAPAPAPAPVEEADGAGTSDPLQVKMES

SEQ ID NO: 70707 - protein, 554 aa, Arabidopsis thaliana
MPFWWPLIVLAFAYAICKFLLMLIPPNVPSIDVDASDVLAHGKDTEENSFIYIPPRGRSQQSDKKVQCYEPATMKYLGYFPALSPTEVEERVTLSRKAQKTWAQSSFKLRRQFLRILLKYIIEHQELICEVSSRDTGKTMVDASLGEIMTTCEKITWLLSEGERWLKPESRSSGRAMLHKVSRVEFHPLGVIGAIVPWNYPFHNIFNPMLAAVFSGNGIVIKVSEHASWSGCFYFRIIQAALAAVGAPENLVDVITGFAETGEALVSSVDKMIFVGSTAVGKMIMRNAAETLTPVTLELGGKDAFIICEDADVSHVAQVAVRGTLQSSGQNCAGAERFYVHKDIYTAFIGQVTKIVKSVSAGPPLTGRYDMGAICLQEHSEHLQSLVNDALDKGAEIAVRGSFGHLGEDAVDQYFPPTVLINVNHNMKIMKEEAFGPIMPIMQFSTDEEVIKLANDSRYALGCAVFSGSKHRAKQIASQIQCGVAAINDFASNYMCQSLPFGGVKDSGFGRFAGIEGLRACCLVKSVVEDRFWPLIKTKIPKPIQAISGSRKRI

SEQ ID NO: 70708 - protein, 164 aa, Glycine max
ILQVVEIGKGSKVKYELDKRTGLIMVDRILYSSVVYPHNYGFIPRTICEDGDPMDVLVIMQEPVLPGCFLRAKAIGLMPMIDQGEKDDKIIAVCADDPEYRHYNDIKELPPHRLAEIRRFFEDYKKNENKEVAVNDFLPASAAYEAIKHSMTLYAEYVVENLRR

SEQ ID NO: 70709 - protein, 356 aa, Glycine max
IRLEVCIIKNTATLAGSLFTLHASQIHIDLPTLTEKDKEVISTWGVKNKIDFLSLSYTRHAKDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKVALDHGKSLGVIKSHDRVVVCQKLGDASVVKIIELED

SEQ ID NO: 70710 - protein, 212 aa, Prochlorococcus marinus subsp. pastoris str. CCMP1986
MEISNYLQIKKQLPLNVNLLAVSKGFSSKEIKIINNLGQNDFGESRFQEAIEKKILLDDLKNIKWHFIGRVQTNKIRKIVQNFEYIHSVDSYEKLLKISNVSFEEKRNPIVMLQVKLSDDPNKGGFNPKVLLEKWDQIKEFKSIKIKGLMTINPKGLSSIENIKLFKKCRYLADSLKLQDCSMGMSGDWEEAVKAGSTWLRLGSTIFGNRTY

SEQ ID NO: 70711 - protein, 677 aa, Gibberella zeae PH-1
MLTSPRLILLLLAWVFSALVASALVKKDWTITWEPGAPNGQERNMIKINNQFPGPTILCDEDDDIEVTVHNKMPFNTTVHWHGLERVNCVRMMGTPWSDGTPGMSQKPIEMGQSFIYRFKASPAGTHWYHSHSRATVLDGLYGPIFIRRKPDAPAPWHLISKEQADIDAMSRAVIDPKLVMVSDWTRFMSWEYMAAEESSGMAIFCSDSILVNGKGSLYCPDVDVLINHTSTYMKYGLYPRQVNDKGCFPFMRSTQGPYLTTGKPETIPLHLQHGCTPAEGTNETIEVDPADQWASLNFIGGATFKTIVFSVDEHDMWVYEVDGHYIVPQRVNTVHMYAGERYAVMIKLDKTPKDYTIRVADSGLTQVISAFATLRYKGGIQGSDSVGVIDYGGQNSTKDGSVITLDREHLPPYPPNPPARKADAMHVLSTHRWKSAWQYTMSGHGMYEEDRSAYGPLLYDPHSADAMDEGLVIRTKNGSWVDLVLQVGSLPGQPQEFPHMMHKHTGKTWQIGSGMGIWNYSSVEEAIAAEPHNFDLDTPKWRDTFVTSFDGSAWIVLRYQVTNPGPWLFHCHIETHLAGGMAIAILDGIDVWPQIPAEYGPDQRGFMPGTLPELESGGKQGTVDKQCPLLAVSPSGGPKKDSGETSASDSRWETLIRGLIQVLQGWLSDEASSRSS

SEQ ID NO: 70712 - protein, 268 aa, Prochlorococcus marinus subsp. pastoris str. CCMP1986
MTSKIAVIGFGNIAKAIITPLFDKKLLKPKDVYCLVNTKKSLENIRKNYKYDINIFQANSKGSEIIWDCEVKFLSVKPQQLKNIIELEKNKNYLLVSILAGVSLEKLIKKFPNHKCVRVVTNIPITIGKGLTGISWGDEIKEAQKQFIKRLFENSSKIYEFPEDLLDIFLSLTSSGPAIVALIIEALSDGGLSGGLQKRLSEELVVEMILGTVSLIKETNLTTAELKNMVTSPGGTTISALRVLENRSLRSALIEAVVSASNRSKEFR

SEQ ID NO: 70713 - protein, 384 aa, Brassica napus
RKKMDVIDLEDDSIDAEILNSMAVTNEHFHTALGNSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKACLRKSPIAKDVDINALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFETNAAGSGATTGVADPFATSAAAAADDDDLYN

SEQ ID NO: 70714 - protein, 507 aa, Hordeum vulgare subsp. vulgare
MEVEAGAHGDTAASKFTLPVDSEHKAKSFRLFSFANPHMRTFHLSWISFFTCFISTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYFDHFHLDLRAAGTIAACFGMANIVARPTGGYLSDLGARYFGMRARLWNIWILQTAGGAFCIWLGRASALPASVTAMVLFSICAQAACGAIFGVAPFVSRRSLGIISGLTGAGGNVGAGLTQLLFFTSSQYSTGRGLEYMGIMIMACTLPVALVHFPQWGSMFFPASADATEEEYYASEWSEEEKAKGLHIAGQKFAENSRSERGRRNVILATSATPPNNTPQHV

SEQ ID NO: 70715 - protein, 595 aa, Gibberella zeae PH-1
MLFRFLALLPFVAGAFAEYKVHDDTFKPDYVLEATLDDIKINCVSRSSIVFNGTSPGPTIYLQEEQTTWIRVYNKIPDNNVTVRAAPFSDGTPLVSQWPIPAGQFFDYEIRPEIGDAGSYFYHSHVGFQIVTAFGALIVRDARKPEYKYDGDIPLLVGDNYAAEDEVIEQGLLADPFKWSGEPQAITIQGNSGNKSFYEAPDSSCMPHVVHVDPGKTYRLRFISATALSMIKLGIEDHENLTVIEADGSYTKPAKIDHVQVSPGQRYSYLMKTKTSKEVCGGDKSQYWIRYESRDRPKVISGYALLKYRCDKNQKLPKSLPETSPIELSNSTADYLEYALEGLSEKNNQAFPKLSEVTRTVVIQINQILTTGAYVNGTLNGTVAWAQNGLPWKENVQAERRQVPYLIQIYENGTTPNYTLALEHHGFDPETKAFPAKVGEVLDIVWENNNGPTGGWDYHPMHVHGYHVYDLGSGNGTYNATENEAHFENFTPVLRDTTNLYRYAVKGVPHHTAGWRAWRIRITEENIGAWMMHCHIAQHQVMGMATVWVFGDAEQIRGKFPAPPYTQGYLTYGGSAYGTEDDQPWVNEYYSDKNN

SEQ ID NO: 70716 - protein, 509 aa, Hordeum vulgare subsp. vulgare
MEVESSSHGAGDEAASKFSLPVDSEHKAKSIRLFSFANPHMRTFHLSWISFFTCFVSTFAAAPLVPIIRDNLNLAKADIGNAGVASVSGSIFSRLAMGAICDLLGPRYGCAFLVMLAAPTVFCMSLIDDAAGYITVRFLIGFSLATFVSCQYWMSTMFNSKIIGTVNGLAAGWGNMGGGATQLIMPLVFHAIQKCGATPFVAWRIAYFVPGMMHVVMGLLVLTMGQDLPDGNLASLQKKGEMAKDKFSKVVWGAVTNYRTWIFVLLYGYCMGVELTTDNVIAEYYFDHFHLDLRTSGTIAACFGMANIVARPAGGYLSDLGARYFGMRARLWNIWILQTAGGAFCLWLGRAKALPESITAMVLFSICAQAACGAVFGVIPFVSRRSLGIISGLSGAGGNFGAGLTQLLFFTSSKYGTGRGLEYMGIMIMACTLPVALVHFPQWGSMLLPPNANATEEEFYAAEWSEEEKKKGLHIPGQKFAENSRSERGRRNVILATAATPPNNTPQHA

SEQ ID NO: 70717 - protein, 515 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEQPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGADMKSNGSGEAPSLISLLGRINMEEGEGGELNHKT

SEQ ID NO: 70718 - protein, 287 aa, Zea mays
MAEPGLEDSQPVDLSKHPSGIVPTLHGIFLKYADNSVPSNWVDEVIPCGTRRRAIFVSPGASAVGQRALPWGSSVLKAIRGDEMDIDYTTYWDSSDNKRIGVRNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLAEFRKVQQCVNLSANKSR

SEQ ID NO: 70719 - protein, 367 aa, Arabidopsis thaliana
MESDSEMVALPLLPTPIESNYRACTIPYRFPSDNPRKATPTEISWIDLFSNSIPSFKERAESDTTVPDAPVRAEKFAKRYAEILEDLKKDPESHGGPPDCILLCRIRELILRELGFRDIFKKVKDEENAKAISLFPEVVRLSDAINDEGKRIENLVRGIFAGNIFDLGSAQLAEVFSKDGMSFLASCQNLVSRPWVIDDLDNFQARWLKKPWKKAVIFVDNSGADIILGILPFAREMLRLGMQVVLAANELPSINDVTYIELAEILSKLKDENGQLMGVDTSNLLIANSGNDLPVIDLARVSQEVAYLSSDADLVILEGMGRGIETNLYAQFKCDSLKIGMVKHPEVAQFLGGRLYDCVIKYNEVQI

SEQ ID NO: 70720 - protein, 211 aa, Zea mays
MRDAAVVVAVPGPGAATRGGGAKPGAAGAAPCAACKLLRRRCAAGCVFAPYFPPGEPHKFASVHKVFGASNVSKLLQEIPAQHRGDAVSSMVYEANARVRDPVYGCAGAVSSLQQRVEALQAQLALAQAEVVRLRMSNDYVLRRLKAAGAGAGAGGGSSSSYAGSPSSMSSLKTAAAAEPDARCRATTPELLVLDMVVDQPGMDDAHFWSY

SEQ ID NO: 70721 - protein, 348 aa, Clostridium perfringens str. 13
MKILKWLLIFIPISIIGEFMHFSPTLMFVLSALAIVPLAGLMGEATEEISFYTGPKLGGFLNATFGNATELIISFFALKDGLFDVVKASIAGSVIGNILLVLGASMLAGGLKYKTQSFNKKVMETSSSMLLFAVIGLTIPAIFMHTIKPEFLNTKYESLSVIVAVVMFAIYILSLIFSFFTHKDIYAVEQDEEDGEAKWSLKKAITVLVVATVIIAIESEFLVGAVEPMTETLGLSKLFVGIILIPIIGNAAEHSTAIIMAMKNKMDVSVEIAIGSSLQVILFVAPVLIFLSLIFKPMSIIFNAFELVALIVSVLIANRIVNDGESNWLEGVQLLAVYIIIAAMFMIV

SEQ ID NO: 70722 - protein, 365 aa, Arabidopsis thaliana
MKKLMVTKLFGPQALERLRHVREDELERFHTNLLSKEMKGETVQIAKEAIKLTNNSVCKMIMGRSCLEENGDAARVRGLVTETFALVKKIFLTQVLRRLFEILGISLFKKEILGVSRKFDEFLEKILVEHDEKPDFQGGDMMDVLLAAYRDENAEYKITRNHIKSLFAELILGGTDTSAQTIEWTMAEIINKPNILEKLRKELDSVVGKTRLIEEKDLPNLPYLQSVVKEGLRLHPPAPVFGRKVLEGCTIKGYYVPKNTALVVNAYAVMRDPHYWEDPDEFKPERFLTTSSKKEEEREQELKYIPFGSGRRGCPGVNLGYIFVGTAIGMMVHCFDWRVKGDKVNMDETAAALTLNMAVGRRDTC

SEQ ID NO: 70723 - protein, 132 aa, Helicobacter pylori
SNIKYELDKESGALMVDRVLYGAQNYPANYGFVPNTLGSDGDPVDALVLSDVAFQAGSVVKARLVGVLNMEDESGTDEKLLALPIDKIDPTHSYVKDINDLSKHTLDKIKHFFETYKDLEPNKWVKVKGFEN

SEQ ID NO: 70724 - protein, 533 aa, Desulfitobacterium hafniense Y51
MVTITSWKRFKEYLYYDQELGLLLDISRMNFSAEFLRSMAEPMREAYHQLQLLEKGALANPDEGRMVGHYWLRNPDLAPTEEIVQDIKETLKEILDFAEQIHSGRLQGEKGNPFRNILLVGVGGSILGPRFVADALASSRDKMKAFFIDNGDPDGIDRVLSRIGEELPATLCLIISKSGGTIETRNGMLEVRRAYKEAGLSFPDHAVAITQRGSQLDKLSQKEGWLRAFPMWDWVGGRTSLLSAVGLLSLALQGIDVAGLLQGAKDCDGRTRRPDTLDNPGALLALMWYYSTQGQGGKQMVVLPYKDRLELFTKYLQQLIMESLGKEKNLQGETVHQGITVYGNKGSSDQHSYLQQLLEGPDNFFVTFIEVLKDRQGPSTYMEENSTSGEYLQAFLLGTREALTQKGRESLTITVKEVNAYTIGVLIALFERAVSIYALLVGINAYHQPAVEMGKKAAGQAIQLKNNIVEFLKSHPGKKFSVSELALAIQEEEHQEMVFKLLLHLTTNPEHGVNMEPGEPWPESRFFVGGPIS

SEQ ID NO: 70725 - protein, 298 aa, Novosphingobium aromaticivorans DSM 12444
MMQAAAVYPFAECLAQGEALAAALGIPALPVEVHRFPDGESRVRLHPPARTAIVLRPLNDPNARLIELLLAAAALRDGGAARVILVAPYLGYMRQDMAFRPGEAVSQRVIGNLIAAHFDGLITVDPHLHRVSSLAEVAPGIPALSISAAPVLAAELAPGLDPRTVLVGPDSESRPWVESIASPLGLDVLVGEKVRHGDRAVRIELPGKEALHGRPAILVDDVISSGTTLIECARILRAAGATSVEAVATHGLARMQDLQRIAAAGVFRVRTTDSIAAHPGSIPLAPILAQALRRQHWF

SEQ ID NO: 70726 - protein, 677 aa, Aspergillus nidulans FGSC A4
MAAPTQLAYRTVKGVGILDASPVYEPLAGFERYSFASLLQGEHVTNANPDRPEGNLRCSAYSPDGRYFAWASPEKVTIIDPSVGHVVSTIPAENVFELGFSPLGTYLITWQRPTKDPNGDAVKNLKVWQVAELESGENRIVGQYVQKSQTGWNIQYSADEKLCARVVTNEVQFYQSDDLSKVWNKLRVEGVADFALSPGQNLSVAVFIPERKGQPAAVKVFLVPQFGAPVSQKTFFKGDKVQLKWNASGTSLIVLAQTEVDKTGKSYYGETTLYLLSSSGQFDSRVHLDREGPIHDVSWSPTSKEFGVVYGTIPAKTTIFNVRGVPKHSFPLTPRNTILFSPHGRFVLVAGFGNLAGQMDIYDMEKNYNKITTVEAANSSVCAWSPDGQTILTATTSPRLRVDNGIRLWHVSGALLYNEDINELYDVFWRPQSTIQHPLGDPFNPLPAPHASAIAYLSTRKAPVKPAGAYRPPGARGQSTPLAFRREDQGGAAYVPEGTATGGALNGPARPRRRVVPGAEPVEEFLPPGAAPGGGVALPPGADQPEKLSKSAARNKKKREARKLKEGQPEEGANSNPSPPGEKKKEGARKNGQQQQKQPNGTKAAPAAAATPEPVEEGAPTVQDKKIRGLLKKIRAIEDLKMRLAGGEKLEDTQMKKIQTEDSVRKELESLGYTGAA

SEQ ID NO: 70727 - protein, 398 aa, Desulfitobacterium hafniense Y51
MRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSYHKQKHAEVTLSAIAVPWEEASRFGVMVTDAGGRIIRFEEKPPRPESNLASMGVYIFKWDVLKEALLEDEQDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 70728 - protein, 222 aa, Hordeum vulgare subsp. vulgare
MAGEKGLVLLDFWVSPFGQRVRIALAEKGLPYEYVEEDLIAGKSDRLLRSNPVHKKIPVLLHDGRPVNESLIILNYLDDAFPDAPALLPSDPYARAQARFWADYVDKKVYDCGTRLWKVKGEPQAQARAEMLEILKTLDGALGDKPFFGGDKFGFVDAAFAPFTAWFHSYERYGEFSLAEVAPKIAAWAKRCGERESVAKSLYSPEKVYDFIGLLKKRYGIE

SEQ ID NO: 70729 - protein, 368 aa, Desulfitobacterium hafniense Y51
MQAALVLETGKIFMGESFGAGGEIRGEVVFNTGMTGYQEVLTDPSYKGQMVCMTYPLIGNYGINSLDNQSPQIQVQGFIVKEAARNPHHWQLEKNISRALAQAGVVGIKGIDTRALTRIIREHGVLRGMITTELGELDQKALELKNWEIPQDAVAQVSTREIYKLPPLGKTDSRKPFHVVVMDFGIKGSILRAMQEEGYALTVVPYSASAQEIIALKPDGVFLSNGPGDPKDVAVGIKTIGGFVNKLPVFGICLGHQLLTLALGGDTYKLKYGHRGGNQPVQDLRTKKVHITSQNHGYAVAEGSLADTLLEVTHLNLNDQTVEGVRHKELPVFSVQYHPEAGPGPNDSLYLFKEFSTLMTEWRIHHAT

SEQ ID NO: 70730 - protein, 424 aa, Arabidopsis thaliana
GGCLRPPETAEEVLKLHDSECCTRPKLSITKSFFYDGLGLGFTKWGDYYRDVRKLCVLELFSVKRANSFRNIREEELSRLVNSFSDSASSGSSVDLTANLAKFVASFTCRMAFGLSFQGSGMDNETFLELFTEANRVIGKFAAADIFPGFGWILDRISGLDSSRRKSFQDLDTFYQKAIVDHREKKKTEDREDLIDVLLKLQSQETKLGSSRITDTHIRAIIMDLFVAGVDTSVITLDWTMAELSRHPRVMKKVQAEIREHVGDKGIVTYDDLEALVYMKMVIKETWRLHAPSPILIPREAMTNFKIKGYDIYPGTRIHVNAWAIGRNPDVWKDPDEFIPERFVDSNVETKGTSFELLPFGSGRRGCPAMYVGLSTVEYTLANLLYHFDWKATEEVSVEEAPGLTSHRKHPLHLVPVNVINRKL

SEQ ID NO: 70731 - protein, 211 aa, Bifidobacterium longum DJO10A
YGVPGILSGAALVFFAFIGFDVVATASEETKNPHKNVPLGIGVGMLLIIVMYMLVAVVTTGMVSYADLAKQDSPSLATAFELVGADWAAKIISFGIVLGLATVVMVLLLGLTRIVFAMSRDGLLPRGLSKTGKHGTPAALQIVVGAVVALVAAFFDIGVLSDMVNIGTLSAFTLVAISIPIMRKKRPDLPRAFKMPGSPWIPILIAVANFW

SEQ ID NO: 70732 - protein, 256 aa, Oryza sativa Indica Group
MARNLATVAPIKISSSRLASLQRLPHHFLNSLRTKKSLAKKDVVGINKWRFEKLKEHIQGDIDAENEAYERYTQNVGLLEETFGLTEDAADEPEPEATSSEERMETLVSEAKVRLKSDSANADGFRDRIATILDQKIKELLESKSTYEDDNPPDQNPDDHPKPVKLSIKQQMERGAKMTELLAKMIRAQSEVDLKICSGIAAQLFGKKNELSNQESVASVTIPYSFPKLWTRVEIDDAMMCKINGEFSSSTERQKP

SEQ ID NO: 70733 - protein, 302 aa, Synechococcus elongatus PCC 6301
MQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 70734 - protein, 118 aa, Oryza sativa Indica Group
MAASSPASSGKAASDSSAPAVAVANGNGTTPQKLPPASAFDMPKPNLRGLNKPKCIQCGNVARSRCPFQCCKSCCYKAQNPCHIHGFREGNEGKGVEKNFSMFVRLDQTAAVFFRTVV

SEQ ID NO: 70735 - protein, 385 aa, Haemophilus somnus 2336
MSLDLNEIRQQITQIDRSLLKLLSERHRLAFDVVRSKEITQKALRDVQREQQLLKELVQFADNENYQLEPQYITQIFQKIIEDSVLTQQVYLQKKLNEQREKNIHIAFLGKRGSYSHLAARNYATRYQEQLIELSCASFDEVFSSVQNEEADYGIVPLENTTSGAINEVYDLLQHTDLSLVGELAYPIKHCVLVNAQDDLDKIDTLYSHPQVIQQCSQFIRTLKRVHIEYCESSSHAMQLVASLNKPNIAALGNEDGGNLYGLKVLKSGIANQENNITRFIVLAKHPIAVSPQIHTKTLLLMSTAQKVGALVDALLVFKKYNINMTKLESRPIYGKPWEEMFYLEIEANINNPIAQQAFTELKAFSNYLKILGCYPSEIVKPAEV

SEQ ID NO: 70736 - protein, 511 aa, Synechococcus elongatus PCC 6301
MTPKLLENPLRIGLRQDKVPEPQILVIFGATGDLTQRKLVPAIYEMHLERRLPPELTIVGVARRDWSDDYFREHLRQGVEQFGGGIQAEEVWNTFAQGLFFAPGNIDDPQFYQTLRDRLANLDELRGTRGNRTFYLSVAPRFFGEAAKQLGAAGMLADPAKTRLVVEKPFGRDLSSAQVLNAILQNVCRESQIYRIDHYLGKETVQNLLVFRFANAIFEPLWNRQYIDHVQITVAETVGLEGRAGYYETAGALRDMVQNHLMQLFSLTAMEPPNSLGADGIRNEKVKVVQATRLADIDDLSLSAVRGQYKAGWMNGRSVPAYRDEEGADPQSFTPTYVAMKLLVDNWRWQGVPFYLRTGKRMPKKVTEIAIQFKTVPHLMFQSATQKVNSPNVLVLRIQPNEGVSLRFEVKTPGSSQRTRSVDMDFRYDTAFGSPTQEAYSRLLVDCMLGDQTLFTRADEVEASWRVVTPLLESWDDPRQAAGISFYEAGTWEPAEAEQLINRDGRRWRRL

SEQ ID NO: 70737 - protein, 346 aa, Lactobacillus johnsonii NCC 533
MKYAEFVKAGEMKIIDKPMPKIEKNDDVIIKVVRTCVCGSDLWAYNGVEEQGHENGGHEVIGIVQEIGKDITTVKKGNFVIAPFTHGCGHCRACLAGFDGVCMSHDLSENFSNGYQAEYVRFQHAQWSLVKIPGKPDDYTEGMLKSFLALADVMATGYHAARVADVQPGDSVIVLGDGAVGLSAIIAAKLRGAKQIVSTSRHADREALAREFGATENVAERDEEGIQNLLAITRSGADAVLECVGSKLSNEEALQVGRPGSRVGRVGLPHGAELNPGLIFYKNMSVAGGPASVTTYDKQVLLTAVLDGRINPGKVFTKTFTLDQINEAYQEMADRKAIKSYIKVND

SEQ ID NO: 70738 - protein, 399 aa, Vibrio vulnificus CMCP6
MKIMFEKVVAAPADPILGLTEEFKKDPRAEKINLGVGIYKTEQGETPVLATVKKAEAALVETEKTKSYLTIEGTAEYALAVQKLLFGADAELINAQRAKTAQAPGGTGALRVAGEFIKRQLGDVKIWISNPTWANHHGVFRAAGLETVEYAYYNPETKDKDFAAMLADLEKASAGDVVLLHGCCHNPTGIDPTAQEWEALAKLVADKGLLPLFDFAYQGFAKGVEEDAQGLRTFAKFNKEILVASSFSKNFGLYNERVGAFTLVAESQEIAETAFSQVKAIIRSIYSNPPAHGSAVVTHILNDAALRAEWEAEVAEMRDRIQEMRELFVTTLKEEGVAADFSFIQRQNGMFSFSGLNKDQVARLKEEFAIYIVGSGRISVAGMTKSNMGPLCKAIAAVL

SEQ ID NO: 70739 - protein, 328 aa, Prochlorococcus marinus subsp. pastoris str. CCMP1986
MAKIYEDNSFAIGNTPLVKLKSVTKNAKATVLAKIEGRNPAYSVKCRIGANMIWDAEKSGKLTKDKTIVEPTSGNTGIALAFTASARGYKLVLTMPESMSIERRRVMAVLGAEIVLTEASKGMPGAIAKAKEIAESNPSKYFMPGQFDNPANPEIHFKTTGPEIWDDCDGEIDVFVAGVGTGGTITGVSRYIKQEKGKNIVSVAVEPSHSPVITQTMNGEEVKSGPHKIQGIGAGFIPKNLDLSIVDKVEQVTNDESIEMALRLAKEEGLLVGISCGAAAAAAVRLAEQDEYAGKTIVVVLPDLAERYLSSIMFTEVPNGIIEEPVKA

SEQ ID NO: 70740 - protein, 663 aa, Rhodopseudomonas palustris CGA009
MSPRRSRGCSSVPKVAVARLVRLARLADGGAKFGAAVGDGWWAGLCRSLPRLGRSAPDDDGNPPRRSFDNHRVARGDRVEIGSKGQRRCYMVVDVIPDGSGVIDRATEVTIDHRAMADATTSPYDDVGGLAREVALVREMVELPLRFPHVFARLGIEAPKGVLLYGPPGCGKTLIARTVAREAGVYFLHVNGPEIIQKHYGESEEMLRRIFADAQKQPAAIIFFDEIDAIAPNRETVLGDVEKRVVAQLLALMDGLTARGNIVVIAATNLPNSLDPALRRPGRFDREIGIAPPDRAGRLEILRIHTRRMPLADDVDLAQIAAAAHGYLGADLAALCREAAMGCTRDLGPRLVAGDPGAAAALDGDLQVRMDHFRRALREVPLASTRSLTTEVAASHWDEVGGLDDIKALLRETVEWPLKYPQRLAFAKTTAPRGILLTGPTGTGKTLIVRALATQSDVNFIAVNGPELLSKWVGETERAIRDVFRKARQSAPSIIFFDEVDAIVASRGGDDGGARIGDRMVGQFLLEMDGLAGLDGVVVIAATNRPDLIDRALLRPGRFDHIATLALPDRAARAAILAIHCRGRALGSDVDLAALAKACAGMSGADLEALCRRAAMAAIRASIIAEPGADFAPFAITGGDFDAALADWRTATPEGASKLDAVA

SEQ ID NO: 70741 - protein, 318 aa, Burkholderia mallei ATCC 23344
MAAIVAAGELLAEFVAAKRGQGFDAPGEFAGPFPSGAPAIFADQAARMGASVAYAGCVGRDAFGDAIVARLASHGVDVAHIRRAARPTGIACVAYRADGGRQFVFSIEGSASALLEPADVVPSMFAGCRYFHVMGSSLTSENAIAAVKRGVIEAARVGAKISFDPNVRAEILAFAPMRAALREMLDACHLFLPSEADLPFFCGPQPAERAIAGLLATHPLLERVVLKRGAAGSAAFDRTGSVAAPAYETAEVDPTGAGDCFGGTFVACAIAGLPVASALARANAAGALAVSRIGPMEGNSMPADIDRFLAERGVRCAA

SEQ ID NO: 70742 - protein, 349 aa, Chlamydomonas reinhardtii
MSLAGKNIFVTGGLGFIGSHTVLVLLEHGATVHLIDNMANSFERVFEHMKKLAGDKADKMKFTKCDINDKETLTTIFEKEHFDCVIHFAGYKAVGESVDKPLEYYHNNFVGTVILLEVMRAHKCKNMVFSSSCTVYGMPDEVPITESAPLKAISPYGRTKLFQEDMFRDLAVSDKDWRILLLRYFNPIGAHPSGELGEHPVGIPNNLMPYIQQVALGQREFLRVFGNDYPTPDGTAIRDYIHVMDLAEGHVSAVVKTLATPDLGCTPINLGTGKGTSVLEMIKAFENASGKKVEHKLVDRRPGDSVAVWAATETAEEKLGWKSKYDVDDMCKHQWAWASKYPQGYETPL

SEQ ID NO: 70743 - protein, 489 aa, Francisella tularensis subsp. tularensis SCHU S4
MVELKVPMFPESVADGTLAQWNKNEGDFVNEGDILAEIETDKVVLEVPATSSGVLKGIKKHAGDTVLSEESLAIIDTAVSTSEPNQQTTNQGNASEATATGQEIDIKAPVFPESVADGTISEWHKKEGEAVSEGDILAEIETDKVVLEVPATSNGVLTKILKTAGETVLSAELIAKITAGGATATTKSEASVGVSQANNDPHLVPSARKAFNASGLDTAANIEGTGKKGRITSEDVKKAVASVNKPQQQTVVINQGARYEKRVKMTRLRQTIANRLVEVQHTNAILTTFNEVDMSAVMELRNKYKDMFVKEHDTKLGFMSFFIKAATEALKKFPDVNASIDGDEIVYHNYFDIGIAVGTDRGLVVPVLRDTDTKSLAELEADVLDKAIKGRDGKLSLEDMQGGTFTITNGGTYGSMLSTPIINSPQSAILGMHNIVERPVVVKGEIKIRPIMYLALSYDHRIIDGGTSVRFLKMIKELIEDPNRILLQV

SEQ ID NO: 70744 - protein, 437 aa, Burkholderia mallei ATCC 23344
MPLPTVPTAPFCPAEVKGSIAIDAGVSRLTKLRRFAGPGLLVAIGYMDPGNWATDIQAGSQFGYALLWVVVFSSVAAIFLQTLAARLGLVAGRDLAQASYDRYGPFGRIVQWITAEVSIIACDIAEVLGCALAFKLLLGVPLAWGIVLTALDTMIVLGLQGKGFRQVEAIVFGLIGTMAFCFVAQVAMVPPDWRAVLHGLAPSVPGHDRKDAIVLALGIVGATIMPHNLYLHSSVVQTRRVVGGAGDAIKETLAMVRIDTWISLVVAMLVNAAILVLAGAAFHATGQTGVADIEQAYRLITPIVGGAAAWLFGIALLASGQSSTLTGTIAGQVIMDGFLHMKMPCYQRRLITRGLALAPALTGVLWLGDGALGQLLVWSQVLLSLQLPFAMWPLIRSVGDRSIMREYAIGRGTKVVAWTLFVLVSITNLVLVTGFVG

SEQ ID NO: 70745 - protein, 175 aa, Francisella tularensis subsp. tularensis SCHU S4
MNLDFIKSKIAAVPDFPKPGIMFRDITPLLADPQGLRKTAEAMAQELKNKGIQPTIVAGTESRGFIFGVALAEVLGLGFVPVRKPGKLPRATYSVKYDLEYGSDSLEIHQDAFKVTDEVLVVDDLLATGGTAKATVDLIEKTQAKVAGLIFVMELDGLGGREVLAGYNVSALIKF

SEQ ID NO: 70746 - protein, 345 aa, Blastopirellula marina DSM 3645
MKAMLLSEYKQLDVVEFAEPEIGADDLLIQVKACGICGSDIHGYDGSTGRRIPPLVMGHEAAGVVAKVGSAVTDYQVGDPVTFDSTVSCGVCFYCRQGHINLCDNRMVLGVSCGEYRRHGAFAEFVSVPQHICYRLPADFPYEHAAMIEAVSVAVHAANRAPLVLGDTAIVVGSGMIGLLVVQAIRLAGAAQVIAIDLDEGRLELAKKLGADVGLKADAVDVAAEVKKRTGGRGADVAIEVVGATRTIQTAIDSTRKGGSVTLVGNVSPQVEMPLQAIVSRELTVYGSCASNGEYPACIDLLQRGLIKVDPLITAKISLDQAPEWFARLYQGEPGAMKVIVDPTL

SEQ ID NO: 70747 - protein, 289 aa, Clostridium perfringens str. 13
MRINRNDLCWCNSGKKYKKCHMEFDERIENLAREGFEVPTRDIIKNEEQIEGIRKSAEINNAVLDLVAEKIKAGMSTEDINKIVHDYTVSRGAIPAPLNYGGFPKSVCTSINDEVCHGIPDENIILKEGDIINVDVSTIYNGYYSDASRMFIIGEASENAKRLVKVAKECLEKGIEAVKPWGFLGDIGAAIQEHAEKNGYSVVRDFGGHGVGLKFHEDPFVYHYGDAGEGMVLVPGMIFTIEPMINEGKYDVFVDADNDWTALTMDGSLSAQWEHTILVTEDGIEIIAK

SEQ ID NO: 70748 - protein, 489 aa, Prochlorococcus marinus str. MIT 9303
MSEASFDFDVIVIGAGYGGFDAAKHAADDGLKVAIVESGDMGGTCVNRGCVPSKALLAASGKVRELADAEHLSGFGIHAAPVRFERQKIADHANKLVATIRSNLTKTLQRAGVTILRGHGRLEGSQRIGVREKSGVDRLLTARDVILATGSDPFVPPGIETDGRTVFTSDEAVNLEWLPRWIAIIGSGYIGLEFADVYTALGCEVTMIEALDRVMPTFDPDITKMAARHLIEGRDIDARAGVLASKVIPGCPVRIELAEMKSRELVDSLEVDAVLVATGRVPSSKGLNLESVGVETNRGFVPIDDSMRVLVNGNPLPHLWAVGDVTGKLMLAHTAAAQGTLAVDNIQGHSRTIDYRSIPAATFTHPEISSVGLSEADAKELAAKDGFELGSVRSYFKANSKALAELESDGLMKLLFRKDSGEVLGAHIYGLHAADLIQEVANAVARRQSVAQLANEVHTHPTLSEVVEVAYKQAAKQLAKAVVASASAS

SEQ ID NO: 70749 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLQHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 70750 - protein, 253 aa, Francisella tularensis subsp. tularensis SCHU S4
MQKLIMGNWKMNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICTE

SEQ ID NO: 70751 - protein, 657 aa, Arabidopsis thaliana
  misc_feature (254)..(254): Xaa can be any naturally occurring amino acid
MEIVEVSPIHKHPLLPITRFSREHCKCNVCGSVGYIYGGYCCNEVGCESMFHKECVESLSEIKHTSHPDHPLKLLISDKASFCSRCEGRFENGYICSICDFKLDFRCAKGPAPLLILEKSNLHEHLLEFFVGWHSWKGHRECKACGGAGFRGYRWYGCYQCDTLFHGECAEFFPEAKHTSHPQHTLKHITSEEAPDYADNKCLLCEEEFDQQHPKIHHCDVCNFTICRACMKNAPPVRIESLTTHEHQLHLVPXRIDFTCNACGTLGDRSPYFCLQCNFMIHRQCIDLPRVININRHDHRISYTRRLGHGEWKCKVCRKKVDGFYGAYTCLKCPSFVVHSLCATRNDVWDMIELEGMQEEEEIAPYEMIDANTIKHFSHDHNLQINNDGHGRIQPENIVCEACVFQILSEPFYSCNQCSFILHEKCANHPRKKRHVCNNTSFILFTDSCNKANASCGLCKQHFTGFRYESGPYVTIDVRCAAILDTIEHGSHQHPLYYYTTFDWKPCSRCREEGAVLFRCDECDYILDGNCALFPKKVMRNRYDDHLLFLSFGDKNVSGDYWCEACETKVNPKEWFYTCNDCGTILHISCVVGDFSYIMPGSHITTWRANVVSNTSICRPVCYMCNSRCKLPSVLKLSDTKVDVYLCSFKCAYFIRK

SEQ ID NO: 70752 - protein, 443 aa, Moritella sp. PE36
MSVYSTLCFLGAIAIFIAFINSKIGKMQTTVAITAGSIILSLGIVIAGQSGWFHLEAIATEQLNNINFESFLLKGILGFLLFAGGLGIKLAHMKDQKWEITVLALVATLFSTAFIGGVLWGFCQLVGIPLDFIYCLLFGSLISPTDPIAVLAIVKNLDAPQRISTQIEGESLFNDGFGLVIFMTLFSVAFGSEAPTVSSVAQLFMHEAIGGIIYGLVLGLVFHYLISSTNDHSMELLLTIAIPTAGYVFADVIDVSGPLAMVVAGIMIGNWTRQKGFSPESEYHLDHFWELVDEFLNGILFLLIGMAMLLFSFHKEDWILMVFAIPLVLVARYLSVKFSYLFFNRFRSYNPLSVTILTWGGLRGGLALAMALAIPAGVFIIPEKNIDVREIILVMTYSVVVFSILVQGSSITGLIHKAKKWETEQLEKKTAADVITAKMDTDK

SEQ ID NO: 70753 - protein, 501 aa, Oryza sativa Indica Group
MAAAAAVWFSAIAAVLLAASTIAVVVVAKMTGKRNGGAAAAAAAAAEAELPLPPVVSGVSLIIPVITRGPMAVADELYVKLGSVFTVSFLGVVKATFLVGPEVQGGFYSRPESEVHQGDTYRMTVPMFGRGVMYDVDVATRSEQIAVCFEALRPTKLRSSTVTMVRETEEYFAKWGEQGTVDLKRELDLLILTIASRVLLGKEVRETMFADVVASFHELMDNSMHLISLCFPNLPIPRHRRRDTASARLKELFSRAIQLRRGSGRAEDDVLQRFLESRYRDGRAMSDNEITGMLIALVVAGQHMSSSASTWTGAFLLRDPKHLAAAVDEQRRLIGDDRVDYDALTTGMSTLHRCIKEALRMHPPAPALVRTVRRGFAVRTREGKEYRMPAGHSVVSYAAFNHRLGYVYRDPDEYDPERFGPERKEDRVAGKFSFTAFGGGRHACLGEHYAFLKMKVIWSYLLRNFELELVSPFPEVELNNIMLGPRGEVMVRYKRRKLTST

SEQ ID NO: 70754 - protein, 200 aa, Zea mays
MASHLDFRCLDEGLGGERGKRKRREDASAAAADSMDLDADAPRPSKLRAMPSLSDPSKPASFGQPTYDGVIAGRLSGRRWKEPRTRRSSAVAVSRKPIPLEQRVREKSLKRAYQARKAELKEEIRQNKVAKRKAREEREKRKQENVLRTGTKLQRVTNPKTIQKIAKSKKRKQLKVVPDEFFGGKKSEASRRMQVPGLEN

SEQ ID NO: 70755 - protein, 674 aa, Musa acuminata
MTVICVAIFHKCNHGLNLKLIFCFCVKNLLLTEVIILLTKFDKTLTDILTNYLICCGFITVFLFRFCTTGLPSDVTVEVGEMTFHLHKFPLLSKCGLLEKLIRQKSEEGEDGCVIQLPDIPGGPKAFEPAAKFCYGMKMELTASNVVYLRCAAEHLEMTEEIAEGNLITQTEVFLNQVVLRSWKDSIKALQTCDYVLPYAEDLQIVKRCIDYLAIKACKDPSLVGWPIVEHGPMQSPGGSILWNGISTGARPRYSSSDWWYEDVSCLSLPMYRRLISAMETRGIGQEIISGSLTFYARRHLPGLDRRQSISEANIRLESRALMALPSEEEQRHLLEEIDKLLPSQKGLMSTKILFGLLRTAMILRASPSCMFNLERRIGMQLDQASLEDLLIPNFSDSTETLYNVDCIHRIVEHFVARNQMIGGASPDVADDDQFLGSPSLIPVIAVAKLVDGYLAEVASDANLKPSKFQALAAAIPDDVRPLDDGLYRAIDIYLKAHSWLAESQREELCRLMNCQKLSLEACTHAAQNERLPLRVVVQVLFFEQLQLKTSIAGCFLVSDNLDGSRPLRSGLPISGEDTGWASAIRENQVLKVSMDSMRMRVSELEKECSSMREELEKLTKGRSGWSTGGRKFRSNIIKGQICSAQEDAISKERDTVQTFEKEQLKLTKYKKHM

SEQ ID NO: 70756 - protein, 452 aa, Klebsiella pneumoniae subsp. pneumoniae MGH 78578
MSHNATPNTSRVELRKTLTLVPVVMMGLAYMQPMTLFDTFGIVSGMTDGHVPTAYAFALIAILFTALSYGKLVRRYPSAGSAYTYAQKSISPTVGFMVGWSSLLDYLFAPMINILLAKIYFEALVPSIPSWVFVIALVAFMTAFNLRSIKSVANFNTVIVVLQVVLIAVILGMVIYGVFEGEGAGTLASSRPFWSGDAHVIPMITGATILCFSFTGFDGISNLSEETKDAERVIPRAIFLTALIGGLIFIFATYFLQLYFPDISRFKDPDASQPEIMLYVAGKAFQVGALIFSTITVLASGMAAHAGVARLMYVMGRDGVFPKSFFGYVHPTWRTPAMNIILVGAIALLAINFDLVMATALINFGALVAFTFVNLSVISQFWIREKRNKTLKDHFQYLFLPMCGALTVGALWVNLEESSMILGLIWAGIGLVYLACVTKSFRNPVPQYEDVA

SEQ ID NO: 70757 - protein, 469 aa, Oryza sativa Japonica Group
MHTSTKLRIPTSQQQQLDAAIMDGAHRSPAARPPAPPRSKMKLLLLVIATNLVSVYLFSGASLSLRLPAGAAAPSIHLWDSSALLRDLGATRAALAAARAEVAALRAQCNASSLLLESVLAGLGAAHGDKPAAADRGFDGWPEEPTGELRLATEPHRLPLGFSAKLGTDELHPGVGFACRNFQDELARYMAYDAGGECPDDADALELQLILKGCEPLPRRRCRPRSPARYVEPAPLPGSLWSIPPDTTVNWSPYACKNYTCLVGRARARGGGGGSYECKDCFDLAAGGKERRRWMSDNGGPGFSIDGVLASRAPGTVRVGLDIGGGAGTFAARMRERGVTVVTTTLDVGAPFSAFVASRGLVPLQLSLAQRLPLADGVMDIVHAMQLGGWVPGAVLELALFDVYRVLRPGGVFWLDHFACVGPRLNDTYAPILDRVGFRRLRWKASRKLDLGAERNEWYLSALLEKPLT

SEQ ID NO: 70758 - protein, 472 aa, Rhodococcus sp. RHA1
MNRRTKIVCTLGPATATGDRIRELVESGMDVARLNFSHGEHADHEENYKRVRAASDATGKAVGVLADLQGPKIRLGRFAEGRTTWANGEEVRITVDEVEGTHDRVSTTYKQLAEDAKAGDRLLVDDGKVGLVVSGVDGNDVICRVTEGGPVSNNKGVSLPGMNVSVPALSEKDIADLEFALGLGVDFIALSFVRSPADVELVHAVMDRVGRRIPVIAKLEKPEAIDNLEAIVLAFDAVMVARGDLGVELPLEQVPLVQKRAIQIARENAKPVIVATQMLESMIENSRPTRAEASDVANAVLDGADAVMLSGETSVGKYVMETVRTMARIVEAVENESTQVPPLTHVPRTKRGVISYAARDIGERLDAKALVAFTQSGDTVRRLARLHTPLPLLAFTPLPEVRSQLSLTWGTETFIVDPVESTDAMVRQVDHALLGLGRYQKGELVVIVAGSPPGTVGSTNLIHVHRIGEEDH

SEQ ID NO: 70759 - protein, 129 aa, Taraxacum officinale
NSGRNGKNNGKGYYIYEKGSKPKPDPQMFPIIEEAKRQVNIMPGGKAISVTDKEIVEMILFPVVNEACRVLGEGVVVRASDLDVASVLGMSFPSYRGGIVFWGDLVGAKHIYASLKKWSEKYSKFYKPS

SEQ ID NO: 70760 - protein, 500 aa, Rhodococcus sp. RHA1
MADPQGFLHIVKKEARKRPVAERVHDWHEVYAPQSPAERAAEVSEQAARCMDCGIPFCHSGSAGCPLGNLIPEWNDLVRRGRWSAASERLHATNNFPEFTGRVCPAPCESACVLALADTHTTGSVTIKRIEQAIADVAWESGTVVPKPPMIATGRKVAVVGSGPAGLAAAQQLTRAGHDVTVYERDDRLGGLLRYGIPEFKMEKAILDQRLMQMRAEGTHFVTDCEVGVDLTVEQMRENFDAVVLAIGALRGRDNTTVEGRELNGIHLAMEHLVTSNKECEGDGPATITAKGKHVVIIGGGDTGADCLGTAHRQGALSVTQLDYKPELPTERDEAATPWPAWPMVLRTSPAHAEGGVRRYQVAVQRFLGDENGNVRSMVLAEVRVTREDGKRIITPVGEEIELPCELALFAIGFEGVDLGPLLDDYGLSPNRRGSLSCGPDWQTTAPGVFVCGDAHRGASLVVWAIAEGRSAAHAVDVYLTGASDLPSPVHPTALPLAVV

SEQ ID NO: 70761 - protein, 446 aa, Streptococcus agalactiae 2603V/R
MNQNHSVKRSLSEVNQSVEVPHNSSFWNTLRAFLGPGALVAVGYMDPGNWITSVIGGATYRYLLLFVVLVSSLMAMQLQQMAGKLGIVTRQDLAQATASRLPKPLRYLLFIIIELALIATDLAEVIGSAIALHLLFGWPLLLSIMITILDVFLLLLLMKLGVQKIEAFVSVLILTILIIFTYLVVLSQPDLDAMFKGFLPHHELFNISHEGKNSPLTLALGIIGATVMPHNLYLHSSLSQTRRVDYHNKSSIKKAVRFMTLDSNIQLSLAFVVNSLLLVLGASLFYGHANDISAFSQMYLALSDKTITGAVASSFLSTLFAVALLASGQNSTITGTLTGQIVMEGFLHFKLPQWLIRLCTRLLTLLPIFVIALLVGGEENTLDQLIVYSQVFLSLALPFSIFPLIYFTSQKSIMGEHANAKWNTYLAYLVAIILTLLNLKLIMDLL

SEQ ID NO: 70762 - protein, 530 aa, Populus tremula x Populus tremuloides
MADVEGSPGSSMHGVTGREQSFAFSVASPTVPTDTTAKFALPVDSEHKAKVFKIFSFANPHMRTFHLSWISFFTCFVSTFAAAPLVPIIRDNLNLTKSDIGNAGVASVSGSIFSRLVMGAVCDLLGPRYGCAFLIMLSAPTVFCMSFVDSAGGYLAVRFMIGFSLATFVSCQYWMSTMFNSKIIGLVNGTAAGWGNMGGGATQLVMPLVYELIKRAGSTSFSAWRIAFFVPGWLHVIMGILVLNLGQDLPDGNLGALKKKGDVAKDKFSKVLWYAVTNYRTWIFVLLYGYSMGVELSTDNVIAEYFYNRFDLKLHTAGVIAATFGMANLVARPFGGYFSDVAARYFGMRGRLWVLWILQTLGGVFCTWLGRANSLPLAVTAMILFSIGAQAACGATFGIIPFISRRSLGIISGLTGAGGNFGSGLTQLVFFSSSSLSTAAGLSWMGVMICGCTLPVTLVYFPQWGGMFFPPSKDVVKSTEESYYASEWDEDEKQRGMHQKSLKFAENSRSERGKRIASAPTPPSTTPNRV

SEQ ID NO: 70763 - protein, 302 aa, Zea mays
MALKAAVSVTPLLPSPPLRRLLLSPSPSSAAARRIARVSAAMATTEVHPAVVVGGGRVGQALVSMGPPGGDVLVGRGEKVPDDAPGPILVCTRNDDLDAVLEATPKSRWRDLVFFQNGMLDPWFKIKGLVGANQVLAYFAVSKVGEPPVDGITDTNPEGLTAAFGSWAPAVAARLQNGGLTCKVLEKEAFQKQMLEKLIWISAFMLVGARHPGATVGVVEKNYRSEVASLIAELASAAAAEEQLTFAEGMEDRLCAYSRAVAHFPTAVKEFKWRNGWFYSLTEKALAAGKPDPCPLHTAWLE

SEQ ID NO: 70764 - protein, 464 aa, Solanum tuberosum
MVRSLKNPKKAKRKNKAKKGEGSSDSVPSLPAKVWQPGVDKLEEGEELQCDASAYNSLHAFHIGWPCLSFDVLRDSLGLVRTEFPHSVYCVAGTQAEKSSWNSIGIFKLSNISGKRRDLVPDKTGDENSDMDSNSSDSDEEEEAGSGTPVLQLHKVFHEGCVNRIRAMTQNPHIVASWGDTGHVQNPESDLSHGASAVSNQAPLFKFGGHKDEGYAIDWSPRVPGKLVSDVLHISAGDCRNCIHLWEPTSGATWNVSAKSYIGHTASVEDLQWSPTEDTVFASCSVDRNIIIWDTRMDNPLAATITAHKADVNVISWNKLASCMLASGSDDGTFSIQDLRMVKDGDSVVAHFDYHKHPITSIEWSPHEASTLAVSSSDNQLTIWDLSLERDEEEEAEFKTKMKEQVNAPTDLPPQLLFVHQGQKDLKELHWHSQIPGMVVSTAADGFNILMPSNIENAIPANVA

SEQ ID NO: 70765 - protein, 418 aa, Prochlorococcus marinus str. MIT 9303
MVDALDSKSSAFGHVGSSPTAPTAVMGTYKRFPVTLLRGKGCWLWDDHGHQYLDAVAGIATCALGHSDRALRRSLGQQLKQLQHVSNLYRIPEQEALAHWLVENSCADSVFFCNSGAEANEAAIKLARKHGHRRRGIDRPIILTANSSFHGRTLAAISATGQPNYHKGFEPMVEGFEFFPFNDLQAFEQQLNRLEAQGPSVAAVLIEPLQGEGGVNPGEASFFRRLRELCSQHQILLIFDEVQVGMGRCGHWWGYQQLGVEPDAFTLAKGLGGGHAIGALLVKQHADLFEPGDHASTFGGNPFACKAALTVAKEIERRGLIAKVQQRGAQLREGLTDLVQRFPRQLKGVRGWGLLQGLVLQDESTFTAPNIAQAALEEKLLVIAAGPKVVRMVPPLIIKPSEIRQLLQRLEATLAHFR

SEQ ID NO: 70766 - protein, 197 aa, Clostridium perfringens str. 13
MKIKSSEFIISAVKREQYPDDNLPEIAFVGRSNVGKSSIINSLTNRRGLAKVSQTPGKTRLINFFLLNKDFYLVDLPGYGYAKVSKKEKASWGATIERYLLNRGPLKKVVLLVDCRHKPTADDVQMYEWIKHYGYEVVVIATKSDKISNNQIGKSEKLIKETLGLPKDHKLKFFSSLNKKGKDELVDYLFDDLVEEV

SEQ ID NO: 70767 - protein, 179 aa, Prochlorococcus marinus str. MIT 9303
MPSSLSQRQSLMTFLGWMLCLLIAIPAQALDTSSGVGLQDQALFQERLDYTLTNQNGKDFHAQDLSNTSFAGAVARAADFSNSNLRGAILTQGTFTQSNFSGADLSDALMDRVDFVDTDLRNSVLKGVIASGSSFAGAQIDGADFSDALLDLDDQRRLCLDADGINQITGIATFESLNC

SEQ ID NO: 70768 - protein, 628 aa, Aquifex aeolicus VF5
MLEKYEILKDYKGPFDIKNYDYETLQKLAQEVRDYIINVTSKNGGHVGPSLGVVELTIALLRVFNPPEDVIVWDIGHQGYPWKILTDRKEQFPTLRQYKGISGFLRREESIYDAFGAGHSSTSISAALGFRIGKDLKGEKEDYVIAVIGDGALTAGMAYEALNNAGHIRPDRFIVILNDNEMSISPNVGAISTYLNRIISGHFVQETRQKIKNFLQHFGETPLRIMKLTEEFLKGLISPGVIFEELGFNYIGPIDGHDIKALEDTLNNVKDIKGPVLLHVYTKKGKGYKPAEENPVKWHGVAPYKVESGEIIKKSSPPTWTSVFGKALVELAERDEKIVAITPAMREGSGLVEFAKRFPDRFFDVGIAEQHACTFAAGLAAEGLRPVAAYYSTFLQRAYDQVIHDVALQNLPVTFAIDRAGLVGDDGPTHHGVFDLSYLRCVPNMVVCAPKDEQELRDLLYTGIYSGKPFALRYPRGAAYGVPTEGFKKIEIGTWEELLEGEDCVILAVGYPVYQALRAAEKLYKEGIRVGVVNARFVKPMDEKMLRDLANRYDTFITVEDNTVVGGFGSGVLEFFAREGIMKRVINLGVPDRFIEHGKQDILRNLVGIDAEGIEKAVRDALKGGRLI

SEQ ID NO: 70769 - protein, 568 aa, Glycine max
MASSTLICDTQQWKELKAHAEDVEKTHLRDLLSDDERSQSMVVEFDGILLDYSRQQATLETREKLFKLAEVTSLKQKINQMYNGEYINSTENRSVLHVALRAPRDAVIQSDGNNVVPDVWNVLDKIQEFSERVRSGSWVGATGKELKDVVAVGIGGSFLGPLFVHTALQTDPEAIESARGRQLRFLANVDPIDVARNITGLNPETTLVVIVSKTFTTAETMLNARTLREWISNALGPLAVAKHMVAVSTNLTLVEEFGIDPNNVFAFWDWVGGRYSVCSAVGVLPLSLQYGFSVIEKFLKGASSIDQHMYSEPFERNLPVLLGMLSVWNVSFLGYPARAILPYSQALEKFAPHIQQVSMESNGKGVSIDGVPLPFEAGEIDFGEPGTNGQHSFYQLIHQGRVIPCDFIGVVKSQQPVYLSGEVVSNHDELMSNFFAQPDALAYGKTAEQLQKENVPPHLVPHKTFSGNRPSLSLLLPSLNAYNIGQLLAIYEHRVAVEGFIWGINSFDQWGVELGKSLASQVRKQLNASRTKGEPVQGFNFSTTAMLTRYLQASADVPADLPTRLPQI

SEQ ID NO: 70770 - protein, 194 aa, Clostridium perfringens str. 13
MSNLVPMVVEQTSKGERSYDIFSRLLKDRIIMLSGEVNDVTANLVVAQLLFLESEDPDKDIHLYINSPGGSITSGMAIYDTMQYIKPDVSTICIGMAASMGAFLLSSGAKGKRFALPNAEIMIHQPLGGFQGQATDIDIHAKRILKIKDKLNQILSENTNQPLEKIKVDVERDYFMEASEAVEYGLIDKVIERK

SEQ ID NO: 70771 - protein, 159 aa, Clostridium histolyticum
MNHKKEKEYKKLDTEKLKENLTELQYNVTQRNATEKPFLNKYDKHFEDGIYVDIVSGEPLFLSIDKFNSGCGWPAFSKPISRKYIKERADFSHGMSRIEVRSKNADSHLGHVFNDGPIENGGMRYCINSASLKFIAKDKLKEEGYEEFLPLFEKDKQEL

SEQ ID NO: 70772 - protein, 200 aa, Klebsiella pneumoniae subsp. pneumoniae MGH 78578
MQLKRVAEAKLPTPWGDFLMVGFEELATGQDHVALVYGDISGQSPVLARVHSECLTGDALFSLRCDCGFQLEAALSHIAEEGRGILLYHRQEGRNIGLLNKIRAYALQDQGYDTVEANHQLGFAADERDFTLCADMFKLLNVEQVRLLTNNPKKVEILTEAGINIVERVPLIVGRNPKNAHYLDTKAAKMGHLLNSKPTE

SEQ ID NO: 70773 - protein, 157 aa, Aquifex aeolicus VF5
MSFEYNEKVLDHFLNPRNVGVLEDANGVGQCGNPACGDAMLFTIKVNPENDVIEDVRFKTFGCGSAIAVSSMLTEMVKGKPIQYALNLTYKDIFEELGGLPPQKIHCTNLGLETLHVAIKDYLMKQGRVEEASKIPDCYEEEEEQEESKEFEFLSGT

SEQ ID NO: 70774 - protein, 401 aa, Clostridium acetobutylicum ATCC 824
MNFKFNTVEEAILDIRQGKMVIVVDDEDRENEGDLVAAGATITGETINYMARYARGLICTPMDSDSMERLGINTMVEKNTEYFGTDFGVSVDAARTRTGISAYERAETIKKLSDKDAKEEDFVKPGHTFPLRAKKNGVLDRNGHTEATVDLVRLAGFYPSVGVCCEIMNEDGTMARLPKLMEFSRKNDIKIITVEKLIEYRKKNEALIKREAEAKLPTKYGEFKIVGYKSLIDNKENLAIVKGELKAEEEVLVRVHSKCLTGDVFGSLRCDCGNQLSYALSAIEKQGAGVVLYMDQEGRDIGLLNKLKAYMLQEKGLDTVEANLKLGFEADLREYWAAAEMLKDLGVKKVKLMTNNPEKINELNKYGIDVVSRVPINTEHVKENEFYLRTKKQKMGHLIEI

SEQ ID NO: 70775 - protein, 155 aa, Clostridium acetobutylicum ATCC 824
MKIYEGKLISKNLKFGIVAGRFNEFIVSKLLSGAVDALKRHGCDEDSIELAWAPGAFEIPLISQKMAESGKYDAVICLGAVIRGATSHFDYVSSEVSKGIAQTSLKTGCPVIFGVLTTDNIEQAIERAGTKSGNKGFDAAVTAIEMANLIKTIGE

SEQ ID NO: 70776 - protein, 270 aa, Bifidobacterium longum DJO10A
MIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQAGLEFVLL

SEQ ID NO: 70777 - protein, 397 aa, Streptococcus agalactiae 2603V/R
MAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAVTAYDLNYLKTKKEKMGHLLD

SEQ ID NO: 70778 - protein, 156 aa, Streptococcus agalactiae 2603V/R
MTIIEGQLVANEMKIGIVVSRFNELITSKLLSGAVDGLLRHGVSEEDIDIVWVPGAFEIPYMARKMALYKDYDAIICLGVVIKGSTDHYDYVCNEVTKGIGHLNSQSDIPHIFGVLTTDNIEQAIERAGTKAGNKGYDCALSAIEMVNLDKKLRER

SEQ ID NO: 70779 - protein, 410 aa, Oryza sativa Japonica Group
MAKATTMEGRPAKMGFRMPAEWEPHEQCWMGWPERRDNWRELAGPARKVFARTAIAISKFESVTICASAKQYPYVHELMLHQPNIRVVEMSMNDCWFRDIGPTFIVRKGAPGLGITEKNIAGIDWEFNAWGGATDGCYVDWSLDSYVAKKIVEIERIPRFPHTMVLEGGSIHVDGEGTCITTEECLLNPNRNPNMTKLEIENELKDFLGVAKVIWIPHGLYGDDDTNGHVDNLCCFIKPGVVLLSWTDDENDPQYQRSVDALSTLSKSVDAKGRQIEVVKIHVPGPLYMTKEESEGVVKTEHAIPREPGTRLAASYVNFYIANGGIVAPAFGDKWDEEACAVLQKAFPDHEVIFTDPFHFETLSSDAVISVCQRPQLKQAVAVGCYSAMATTSELKTVLGVLTEPVNFRW

SEQ ID NO: 70780 - protein, 484 aa, Burkholderia xenovorans LB400
MMETETDLRRHDLLIDGKRLPPGTGEYSVDIDPATEEPIALVAQGSAADVDAAVHAARAALKVWNAIRSAERGRILMRLAGLMRANLEELAALESLDAGKPIAAVMRQDIPAAIDTLEYYAGWCDKINGQVVPVRPDALTYTLREPVGVVAAIVPWNFPLMIGMWKIAPALACGCTLIVKPAEITPLSALRIGELALEAGVPPGVLNIVTGKGRVVGDALVAHPGVDKVTFTGSPSVGRGILQGAAGNFKRVTLELGGKSANLIFPDANLDNAVRAAAAGIFFNTGQVCSAGSRILAHRDVYDEVVERLAARARSIKVGDPSSRETSMGPLISAAQMKTVLGYVETGRAEGASLVTGGARVGERGFFVEPTVFADVEHEMRISQEEIFGPVVSVIRFDDEADAIRIANGTLYSLAAGVWSADIGRVHRVARDLRAGTVWINTYGYTDVRLPWGGSGDSGFGREHGDVAIENFTEPKAVWLAIDQ

SEQ ID NO: 70781 - protein, 484 aa, Synechococcus elongatus PCC 6301
MVTTTEKTNIGYIRQVIGPVVDVEFPAGKLPQIYNALVIKGKNEAGQDLSVTCEVQQLLGDRKVRAVSMSTTDGLVRGLEVIDTGAPISVPVGEATLGRIFNVLGEPVDELGPVNAATTSPIHRDAPKLTDLETKPKVFETGIKVIDLLAPYRQGGKIGLFGGAGVGKTVLIQELINNIAKEHGGVSVFGGVGERTREGNDLYQEFKESGVIDEKNIANSKVALVYGQMNEPPGARMRVGLSALTMAEHFRDVNKQDVLLFIDNIFRFVQAGSEVSALLGRMPSAVGYQPTLGTDVGQLQERITSTLEGSITSIQAVYVPADDLTDPAPATTFAHLDATTVLSRGLASKGIYPAVDPLDSTSTMLQPSIVGEEHYRTARAVQSTLQRYKELQDIIAILGLDELSEEDRQTVARARKIEKFLSQPFFVAEVFTGSPGKYVKLEDTISGFNRILNGELDDLPEQAFYLVGDIQEAIEKGAKLKAES

SEQ ID NO: 70782 - protein, 351 aa, Zea mays
RRAPPTPGRYLGAGAMPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETGMRGKLVKRNKKSSGDLDIYGGHRINVEPIGTLGEDSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 70783 - protein, 277 aa, Rhodococcus sp. RHA1
MALSRDPRELLAVASELLDGVHDRFVSGVGAPSAVHKGPDDFATALDLELEKRLTGELRDRTGIDVHGEEFGGPDLGSGPVWVLDPIDGTFNYSAGLPTAGTLLALLDDGVPVLGLTWLPLVGRRYAAVADGPLLEGGKPLPALGRTSLASSIVGLGALNIDSRGRIPGAYRLQVLAQLSRVSSRIRIHGSTGVDLAFTAAGILGGAVVFGHNAWDNAAGVALVRAAGGVVTDLGGKPWTVTSDSVLAGAPGVHGEILDILGSLGDPRSEPSGGRTQ

SEQ ID NO: 70784 - protein, 270 aa, Oryza sativa Indica Group
MGWGIPTRPPATSTPSRVQALYELCKRTFPSPSSVAASSSPSSPPPDHAIGAISSLMDTITPVDVGLRDDNLEDGRGFGFFESNFLKNSARVARWAQPITYLHVYECDAFSIGIFCLPTSAVIPLHDHPGMTVLSKLLYGSMHVKSYDWVEPAVLANGKPVKLGKLHTDDVLNAPCPTAVLYPQSGGNMHCFTSVKSCAVLDVIAPPYSESSGRVCTYFHDYPFSSFSAGQAKVVHGPDNYAWLEALNVPVNINMRPGTYTGPTIQEHLP

SEQ ID NO: 70785 - protein, 412 aa, Lactobacillus johnsonii NCC 533
MAKLNTEKIKQDFPIFNQKINDETLVYLDNAATSQIPKFVEEKVRDFNEKERANVHRGVHALGLRATNQYESSRQKVANFIGANNAKEVIFTSGCTDSLNLVAASFGEQNIQAGDEILVSIMEHHSNLLPWQQLAKRKQAKLNFIEINSDGLLDIKNLKSKINSKTKIVALTHVSNVLGTINPIKELTDLAHEKGAIVVVDGAQAVGHFPIDVAELNVDFYAFSGHKMFAPTGIGVLYGKKDLLDKMQPYRLGGEMIANVTREGATWAEVPYKFEAGTPNIAGAIGLGAAIDYLQSLDFELIQKHEQELTSYALEKLKNVSGLTIYGPQKSNGRIGVISFNLKNIHPHDLATALDLNGIEVRAGHHCAQPLMASLNTESTVRASLSIYNTKDDIDKLVSSLHEAKEFFSEFR

SEQ ID NO: 70786 - protein, 235 aa, Brassica napus
  misc_feature (223)..(223): Xaa can be any naturally occurring amino acid
STHASGSSTSPPPPLTLLSLSSLLISAAISDAYPTIPGTAPIDGGFSDELKPIRREVYGEGKIFDISHRYTPEMPAWDSTEGIGRFLWLAASMKNGSLANNSEMKIPTHTGTHVDSPGHVYDEYYDAGFDVDSLDLQVLNGPALLVDVPRNKNITAEVMKSLNIPRGVRRVLFRTLNTDSFVIIKKKYYRRLMFKREFDTSYVGFMKDGAQWLVDNTDIKLVXVDYLSVAAYDDL

SEQ ID NO: 70787 - protein, 390 aa, Zea mays
  misc_feature (13)..(13): Xaa can be any naturally occurring amino acid
  misc_feature (62)..(62): Xaa can be any naturally occurring amino acid
  misc_feature (102)..(102): Xaa can be any naturally occurring amino acid
  misc_feature (114)..(114): Xaa can be any naturally occurring amino acid
  misc_feature (356)..(356): Xaa can be any naturally occurring amino acid
MATAGKVIKCRAXRGVGGRQAAVHRGGGGGAAAGHGGAYQDPLHRALPHRRLLLGGQGANPXGFPEDLRTRSRAGTGPEFPGCIVESVGEGVTELAPGDHVXPVFTGDCKECGXCKSEESNMCDLLRINVDRGVMIGDGKSRFTISGQPIFHFVRTSTFGEYTVIHVGCLGEINPEAPLDKVCILSSGTSTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFFREKTLKGTFFGNYKPRTDLPNFVEMYMKKERELXEKFFPPSVPFSEINPAFALMLKGGGLRCFMGRGD

SEQ ID NO: 70788 - protein, 533 aa, Ustilago maydis 521
MVTGAACPPVDDLIRNNMPADPFWQPDFVSQRNESSPSRSVSSKSKLDLSSTLPSLAASPALSPKGSVFFLRSDAESLHDALTVSSYDNDYPPPPMSTPAASQTFASSSKQPTSTVSPTRLSACTETREGASTMAAPTLTSSPSSINGLTESLPRRPARPGRPTLTRLNTSEIMRTHTNTAALEPPSVHSIPSRRSPTALKLQLDTSVPRRSATLSSYPHCKKMNYPTPLYSTLTLPSPTTSTRSDFATIKDGSARLTNGDVEDRAGAGESSYANSPAARPDSVNLAGDNFSFEGIDFEVSTILPDFLYLGPDVQSEQAVTELKAMGVRRILNVACEIDDRGPLRLRDRFDRYLKVPMLDSVEAKGVQDSIEQACSFLDDARLRSEPVYVHCKAGKSRSVTIVIAYLIHALGWTLRRSYSHVSEKRAAICPNIGFVAELMQFEEKELKLARSTGIYGDPADVPLASASSPQLLPGWQQGQTRLDSPRNDSSPIPSTLARQGVLMHMTTSLNSSLGGSLSKSSPDLPSLTSGCT

SEQ ID NO: 70789 - protein, 636 aa, Triticum aestivum
MSKLLVIALLLLPLINHGIYLATAWDDQDFFKYCPPSKCSQHGPMIRYPLCLESSNTSSSSSCGCAGRSIWKLACSGQDTILVHPVLGPYSVSAIDYRRSSMKITPLVDPCLVLQQKLIISRSSSSPQVDVINDEKPSFDENFFESSSATIVHCSREFTPAAAHADSIAGPVSCLSNTTHFFYLVNSDEDMSILPLDCKVVPVSDRGGISLPHMLKDQMFYNFTETAKKIPSFAETAVSWDEGDCRECELSGRRCAFSSQRDREFCMPDPHGSHIKVIAATSSVAAFVALLLTVATVLYLSLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFCSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKADVYSFGMLVLEMVSGRRNSDPRIGSQDDVYLPEWIYEKVINGEELALTLETTQEEKDKVRQLAMVALWCIQWNPRNRPSMTKVVNMLTGRLQSLQMPPKPFVSSENELMS

SEQ ID NO: 70790 - protein, 326 aa, Geobacter sulfurreducens PCA
MPVLVTGGAGYIGSHVVRQLSEAGYTVVVYDNLSTGFPDALVHGERLVTGDLSDTARLDALFVEYGFSTVLHFAASIIAPESVTAPLKYYGNNTRNTLNLLGACVKHGVERFIFSSTAAVYGIPDSGVAAEESATVPINPYGTSKLMSEWMLRDVCAAHGMRSVALRYFNVAGADPQARMGQRTPEATHLIKVSCQAALGLRDKVCIFGTDYPTPDGTGIRDYIHVEDLASAHLAALSYLEKGGESTRINVGYGSGSSVREVIDMVRRVSGVHFLAEEAPRRPGDPPSLVARADRARTLLGWTPRYDNLETIVADAWRWEKKISGN

SEQ ID NO: 70791 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTVTQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 70792 - protein, 474 aa, Yersinia pestis CO92
MGKMVDQSKIVAEPLQEPEEHLQRSLSNRHIQLIAIGGAIGTGLFMGSGKTISLAGPSIIFVYMIIGFMLFFVMRAMGELLLSNLNYKSFSDFSADLLGPWAGFFTGWTYWFCWVITGIADVVAITAYAQFWFPDFSQWVASLLVVLLLLSLNLATVKMFGEMEFWFAMIKIVAIVALIFAGLTMVLVSYQSPSGTTASFTHLWSDGGMFPKGISGFFAGFQIAVFAFVGIELVGTTAAETKDPEVVLPRAINSIPIRIIMFYVFSLIMIMSVTPWSSVVADKSPFVELFVLVGLPAAASVINFVVLTSAASSANSGVFSTSRMLFGLAKEGNAPKQFGKLSRRSVPATGLTFSCICLLGGVVLIYLIPNVMTVFTLVTTVSAILFMFVWTIILCSYLVYRKRRPALHKKSIYKMPAGIFMSWVCMAFFAFVLVLLTLESDTRQALIVTPLWFVILTASYIFLKKRRARLYNSK

SEQ ID NO: 70793 - protein, 336 aa, Geobacter sulfurreducens PCA
MSSILVTGAAGFIGFHLTKRLLDRGDRVVGLDNLNDYYDVNLKLDRLRQLEGREGFSFVRTSLADRPALEDLFAGQRFDVVVNLAAQAGVRYSITNPHAYVDSNLVGFINILEGCRHHGVKHLVYASSSSVYGANTAMPFSIHHNVDHPVSLYAATKKANELMAHTYSSLYGLPTTGLRFFTVYGPWGRPDMALFLFTKAILEGRPIDVYNFGKMQRDFTYVDDIVEGVTRVMDRTPEPNPAWSGARPDPGTSYAPYRIYNIGNNNPVELLAFIEAIEQNLGITAQKNLLPLQAGDVPATYADVDDLMNDVGFKPATPIGEGIERFVEWYRGYYGV

SEQ ID NO: 70794 - protein, 281 aa, Chlamydomonas reinhardtii
MGKYAQIVIGPAGCGKSTYCHTLYEHCLAIKRSVHCVNLDPAAEAFQYPVSFDIRDLVSLEDVVEELGLGPNGGLLYCMEYLEDNLHDWLGEQLESYGDDDYLVFDCPGQIELYNHLSVFRSFVDFLKNDGWNVCVVYCLDAHFITDIAKFMAGALQALAAMVKLELPHVNVLTKVDLLEDKRHLDDFLFPDSALLLPQLAASTGPRFRALNKAMGQLLEEFSLVSFMPLDITDEDSIADILGQIDIAIQYGEDAEPRIREDEYDPERDGDGDGGDGGDDI

SEQ ID NO: 70795 - protein, 136 aa, Corynebacterium glutamicum ATCC 13032
MTDFKLISDTEWRERLTPQEFHVLREAGTEPPHVGEYTNTTTEGVYSCRACGEELFRSTEKFESHCGWPSFFSPLAGDKIIEKEDLSLGMRRVEILCANCGSHMGHVFEGEGYDTPTDLRYCINSISLKLEEKPVS

SEQ ID NO: 70796 - protein, 342 aa, Solanum tuberosum
MARCRLLLFLAALFSIFGLLHASAGDADPIYSACVDQCEKTGCVGDECSQHCNFTSGGIPVDGPWYLQEPLYLRWKQWDCLSDCRYHCMLAREKERKKVGLKPVKYHGKWPFQRVNGIQEPVSVALSALNLAMQFHGWVSFFIFVNYKLPFRPNRKPFYEYTGLWHIYAIFAMNSWFWSVVFHSRDVNLTEKLDYSSAVALLGFSLILAVLRVFNVTDEAARVMVSAPLVAFVTTHILYLNCYQLDYGLNMKVCLGMGILQLILWAVWAGVTRHPSRWKLWVVVIGGALAALLEIYDFPPYRGFVDAHALWHATTIPLTYLWWSFVRDDSEFRTTTLIKKAK

SEQ ID NO: 70797 - protein, 219 aa, Brassica napus
  misc_feature (87)..(87): Xaa can be any naturally occurring amino acid
MASSKGTQSVKDLMHPGKNALLPPKIPFPTVSAPYSEYIPLGSRHHGHKLNDEKPHHHHHHQRTSSESDLVEEPPFWLDDLLNEPEXPVRKCGHRRSSSDSYAYLDMANAKNISLTLQNDFSYRNTGSSTQRGGVHELDWNQNAQGAAFYSDSNFLNQTNRQRDSLVAASGPRPSGQPFTRESVGGKHMGSSSYMPQEAPETKNYAKTLSHDAKKFSPE

SEQ ID NO: 70798 - protein, 636 aa, Corynebacterium glutamicum ATCC 13032
MGILNSISTPADLKALNDEDLDALAKEIRTFLVDKVAATGGHLGPNLGVVELTIGLHRVFDSPQDPIIFDTSHQSYVHKILTGRAKDFDSLRQKDGLSGYTCRAESEHDWTESSHASAALSYADGLSKAKQLDGDTTHSVVAVVGDGALTGGMCWEALNNIAAGKDRKVVVVVNDNGRSYSPTIGGFAENLAGLRMQPFYDRFMEKGKTSLKSMGWVGERTFEALHAFKEGVKSTVIPTEMFPELGMKYVGPVDGHNQKAVDNALKYAHDYDGPIIVHMVTEKGRGYAPAEQDLDELMHSTGVIDPLTGAPKSASKPGWTSVFSDELVKIGAQNENVVAITAAMAGPTGLSKFEANFPNRFFDVGIAEQHAVTSAAGLALGGKHPVVAIYSTFLNRAFDQLLMDVGMLNQPVTLVLDRSGVTGSDGASHNGVWDMALTSIVPGVQVAAPRDEDSLRELLNEAISIDDGPTVVRFPKGDLPTPIVAIDTLEDGVDVLAYEDATDVESTDDAPSVLIIAVGERATVALDVASRIKQHGVNVTVVDPRWIVPIPQSLVALSDDHDLVITIEDGVIHGGVGSLLSDALNASEVDTPRRQIAVPQKYLDHASRNEVLADYGLDADGIETTVVGWLDSLFGE

SEQ ID NO: 70799 - protein, 379 aa, Solanum tuberosum
MATQGQVITCKAAVAWEPNKPLVIEDVQVAPPQAGEVRVKVLYTALCHTDAYTWSGKDPEGLFPSVLGHEAAGIVESVGEGVTEVQPGDHVIPCYQAECRECKFCKSGKTNLCGKVRAATGVGVMMNDRKSRFSINGKPIYHFMGTSTFSQYTVVHDGSVARIDPAAPLEKVCLLGCWVPTGLGAVWNTAKVEPGSIVAIFGLGTVGLAVAEGAKAAGASRIIGIDIDSKKFDRAKNFGVTEFINPKEHEQPIQQVIVDLTDGGVDYSFECIGNVSVMRAALECCHKGWGTSVIVGVAASGQEISTRPFQLVTGRVWKGTAFGGFKSRSQVPSLVDKYLKKEIKVDEYITHSMTLADINKAFDLMHDGDCLRVVLDMFV

SEQ ID NO: 70800 - protein, 263 aa, Novosphingobium aromaticivorans DSM 12444
MAGTLKGRSALVTGGGQGVGQGIARALAAEGADVMIAQRGLEAAEAEAVHLRATYGVNAIARQVDVTVRGEVDAMVDACAAAFGRLDILVNNAGGSFPKRLENHTDEDMEGSFLLNYWSAFWSMRAAFPLMKAQKYGRIVNLGSLNGVNAHMFTAAYNASKEAVRALTRTAAVEWGGHGITANVICPSALSPAARDYFDANPEMAQAILGQVPVGRFGESAGDIGPVAVFLAGEASSYMTGNTLYVDGGGHINGVAWRPEVED

SEQ ID NO: 70801 - protein, 182 aa, Yersinia pestis CO92
MQLNIPTWLTLFRVVLIPFFVLAFYLPFVWAPMVCAIIFVFAAATDWFDGFLARRWKQTTRFGAFLDPVADKVMVAVALVLVAEHYHSWWITLPAATMIAREIIISSLREWMAEIGKRSSVAVSWVGKVKTMAQMGSLVGLLWRPDHNVELASFVLLYIAAVLTFWSMFQYLNAAWSDLLEP

SEQ ID NO: 70802 - protein, 447 aa, Ralstonia eutropha JMP134
MNSPSLDAFLAGVARRDPGQPEFLQAVKEVMMTLWPFVERHPRYADQALLERLVEPERVIQFRVAWTDDQNRVQVNRAFRVQHSSAIGPYKGGMRFHPTVNLSVLKFLGFEQTFKNALTTLPMGGGKGGSDFDPKGKSDAEVMRFCQALVTELYRHLGPDTDIPAGDIGVGAREVGFMAGMMKKLSNQSACVFTGKGLAFGGSLMRPEATGYGTVYFAQEMLHRRGMDFDGLRVLLSGSGNVAQYAAEKAIELGAKVLTLTDSGGVLHYPEGMTTEQLAEVMAFKNEERGRLSDFAARHGMKFEAGRTPWHVPADVALPCATQNELDGNDAETLLGNGVICVAEGANMPSTLEAVDRFVDAKILYAPGKASNAGGVATSGLEMSQNAMRLSWHHAEVDEKLHAIMKDIHQNCIHHGQKDGGYVNYVEGANIAGFVKVADAMLAQGVI

SEQ ID NO: 70803 - protein, 438 aa, Alternaria alternata [sequence omitted]

SEQ ID NO: 70804 - protein, 230 aa, Arabidopsis thaliana
AFSLKSAMTKQHANWSPYDNNGGTCVAIAGSDYCVIAADTRMSTGYSILSRDYSKIHKLADRAVLSSSGFQADVKALQKVLKSRHLIYQHQHNKQMSCPAMAQLLSNTLYFKRFFPYYAFNVLGGLDEEGKGCVFTYDAVGSYERVGYGAQGSGSTLIMPFLDNQLKSPSPLLLPKQDSNTPLSEAEAVDLVKTVFASATERDIYTGDKLEIMILKADGIKTELMDLRKD

SEQ ID NO: 70805 - protein, 445 aa, Hevea brasiliensis
MAITIVSVRARQIFDSRGNPTVEADVKLSDGYLARAAVPRGASTGIYEALELRDGGSDYLGKGVSKAVENVNIIIGPALVGKDPTDQVGIDNFMVQQLDGTVNEWGWCKQKLGANAILAVSLAVCKAGAHVKGIPLYKHVANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNNGSQKISGDVLKDLYKSFVTEYPIVSIEDPFDQDDWEHYAKLTSEIGVKVQIVGDDLLVTNPKRVEKAIKEKACNALLLKVNQIGSVTESIEAVKMSKRAGWGVMASHRSGETEDTFIADLSVGLATGQIKTGAPCRSERLAKYNQLLRIEEELGAEAVYAGANFRTPVEPY

SEQ ID NO: 70806 - protein, 445 aa, Hevea brasiliensis [sequence omitted]

SEQ ID NO: 70807 - protein, 334 aa, Klebsiella pneumoniae subsp. pneumoniae MGH 78578
MKFLVTGAAGFIGFHIAQRLLNEGHNVVGIDNMNDYYDVSLKQARLDRLAYPAFHFQQLDLADREGMAKLFATEQFDRVIHLAAQAGVRYSLENPYAYADANLMGYLNILEGCRHTKVKHLVYASSSSVYGLNRKMPFSTEDSVDHPVSLYAATKKANELMAHTYSHLYGIPTTGLRFFTVYGPWGRPDMALFKFTKAMLEGKSIDVYNYGKMKRDFTYIDDIVEAVVRVLDVIPQANADWTVESGSPATSSAPYRVYNIGNSSPVELMDYITALEEALGMEAQKNMMPIQPGDVLDTSADTQPLYDLVGFKPQTSVKDGVKNFVDWYKDYYQI

SEQ ID NO: 70808 - protein, 306 aa, Mycobacterium leprae
MTRHFLRDDDLSPTEQADILALAADLKKAPFSRRPLAGPRGVAVIFDKNSTRTRFSFDIGIAQLGGHAVVVDGLSTQLGRDETLQDTARVLSGYVDAIVWRTFGQHRLDAMAATATVPVVNALSDEFHPCQVLADLQTIAERKGSLNGLRLSYFGDGANNMAHSLMLGAVTAGVHVTVATPVGFTPDPSVLAAAKKRAEATGASVTVTVDADTAAAGADVLVTDTWTSMGQENDGLDRVKPFWPFQVNARLVGLADSEAIVLHCLPAHRGDEITNEVMDGPTSAIWDEAENRLHAQKALLVWLLER

SEQ ID NO: 70809 - protein, 385 aa, Haemophilus somnus 2336
MEPSYQEQNNCTETIKINEVKKLWLDSKFSLNLPVWTLLLPLFALLVLAFHLLTYPTGWLINTVTTVLLIGSVFAAVHYAEVIAHKVGEPFGTLVLAIAVTVIEVALIVILMSNSTQENSLVLARDTVYAALMLICNGIVGIGLLIGGMKNYVQLFSLHGIKAAVSVLLAISLIVFVLPNFTLSAEGGGMVNSQLLFVAMCCLVLYGSFIFTQTIRHRNYFVDEDENESHHNDNWLTIGVSIVFLLISLVSVVGLAKMLSPTIESALVSFGLPKIMLGIIVAGLVLLPESIASIKAAYNNQLQNSLNLGLGSALASIALTVPVIAIISVISGQPIVFGLTAKESLMLIITLLLTMNTLSTGRSNFLLGVIHLVMLATFIFFSIIP

SEQ ID NO: 70810 - protein, 388 aa, Klebsiella pneumoniae subsp. pneumoniae MGH 78578
MKITISGTGYVGLSNGVLIAQNHEVVALDIVQAKVDMLNQKISPIVDKEIQEYLAEKPLNFRATTDKHDAYRNADYVIIATPTDYDPKTNYFNTSTVEAVIRDVTEINPNAVMIIKSTIPVGFTRDIKERLGIDNVIFSPEFLREGRALYDNLHPSRIVIGERSARAERFADLLKEGAIKQDIPTLFTDSTEAEAIKLFANTYLALRVAYFNELDSYAESQGLNSKQIIEGVCLDPRIGNHYNNPSFGYGGYCLPKDTKQLLANYESVPNNIIAAIVDANRTRKDFIADSILARKPKVVGVYRLIMKSGSDNFRASSIQGIMKRIKAKGIPVIIYEPVMQEDEFFNSRVVRDLNAFKQEADVIISNRMAEELTDVADKVYTRDLFGND

SEQ ID NO: 70811 - protein, 414 aa, Burkholderia xenovorans LB400
MDFETVSVVGLGYIGLPTAAAFAARRKRVIGVDVSQHAVDTINRGAIHIVEPELDMLVHAAVTQGYLRATITPEPADAFLIAVPTPFSDGYKPDLRFIEAASQAIAPVLKKGDLVVLESTSPVGTTEQMAAWMAQLRPDLTFPQQAGEQSDIRIAHCPERVLPGHVIRELVENDRVIGGMTPRCSELARELYQSFVRGECILTDARTAEMCKLTENSFRDVNIAFANELSIICDKLDINVWELIRLANRHPRVSILQPGPGVGGHCIAVDPWFIVDSAPEQARLIRTARTVNDSKPGYVIDRVERAARRFKDPVIACLGLAFKADIDDLRESPAVEIADELAERFAGQVVVVEPNVRTLPAALDGKVRLCELNEALLEADIIVILVDHAQFRRVDPVRFQAKVVIDTRGVLAHA

SEQ ID NO: 70812 - protein, 499 aa, Lactobacillus johnsonii NCC 533
MEDHSFISYANGKSLVEINSTIPVPRTRNFFRMLLAYTGPGALVAVGYMDPGNWAASINGGQSFNYLLISTILISSLMAMLLQYMAAKLGIVTQMDLAQAIRARTSKRLSFILWIIIELAIMATDVAEVIGAAIALNLLFKIPLVIATFITVFDVLLLLLLSKVGFRKIEALVSCLIMVILLVFTYQVMLANPNWKNIFLSALPSPELVAQHPVVNGLSPLTGSLGIIGATVMPHNFYLHSSICQTRKINHDNLADVQNAVRFTTWDSNIQLIIAFFVNVLLLIMGAAVFKSGAVKDSSFFGLYDALSNTTMLSNPILISVAKTGILSVLFAVALLASGQNSTITGTLTGQVVMEGFIHLKMPLWARRLFTRLLSVIPVIMCVLMTAKDSISQQHFALNMLLENSQVFLAFAVPFSIVPLLIMTDDRRMMGQFKNRKIWSILGWASSIILIFLNLCNLPATFVSFNMMPKRDAVVFAYTIIMLIILLMGWTCWDMRKKK

SEQ ID NO: 70813 - protein, 433 aa, Clostridium acetobutylicum ATCC 824
MKNELEFAKKLIDFIYDSPSPFHSVDNIKNTLIENGFAEIKEENKWELNKNGKYFVKRNDSALIAFTVGSGFVAKKGFKIIGGHTDSPTFRIKPNPEMVSENSYIKLNTEVYGGPILSTWFDRPLSIAGRVTVRGKSALFPETKLLNIKRPILVIPNLAIHMNRDVNSGFKINPQVDTLPIIGIINDKFEKENYLMKIIASELGEDIENIIDFDLFLYEYDKGCIMGINNEFISSSRLDDMEMVHAGLNALVNAKCSEATNVLACFDNEEIGSATKQGADSQFLSDILERIVLSFGGDREDFFRALHNSFMISSDSAHAVHPNKGEKADPITRPHINEGPVIKISAAQKYTSDSNSIAVYEEVCRLSGVPYQKFVNRSDERGGSTIGPITATHTAIRTVDIGTPLLAMHSIRELCGTLDHMYVEKSFEEFYNL

SEQ ID NO: 70814 - protein, 388 aa, Salmonella enterica subsp. enterica
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMDGAKLLK

SEQ ID NO: 70815 - protein, 388 aa, Salmonella enterica subsp. enterica
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 70816 - protein, 468 aa, Klebsiella pneumoniae subsp. pneumoniae MGH 78578
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILEKISARAEDGEPCVAYIGADGAGHYVKMVHNGIEYGDMQLIAEAYALLKGGLALSNEELAATFTEWNAGELSSYLIDITKDIFTKKDEEGKYLVDVILDEAANKGTGKWTSQSSLDLGEPLSLITESVFARYISSLKDQRVAASKVLTGPQAQLAGDKAEFVEKVRRALYLGKIVSYAQGFSQLRAASDEYNWDLNYGEIAKIFRAGCIIRAQFLQKITDAYEQNASIANLLLAPYFKQIADEYQQALRDVVAYAVQNGIPVPTFSAAIAYYDSYRSAVLPANLIQAQRDYFGAHTYKRTDKEGVFHTEWME

SEQ ID NO: 70817 - protein, 252 aa, Streptococcus agalactiae 2603V/R
MSRKPFIAGNWKMNKNPEEAKAFIEAVASKLPSSELVEAGIAAPALTLSTVLEAAKGSELKIAAQNSYFENSGAFTGENSPKVLAEMGTDYVVIGHSERRDYFHETDQDINKKAKAIFANGLTPIICCGESLETYEAGKAVEFVGAQVSAALAGLSEEQVSSLVIAYEPIWAIGTGKSATQDDAQNMCKAVRDVVAADFGQAVADKVRVQYGGSVKPENVAEYMACPDVDGALVGGASLEAESFLALLDFVK

SEQ ID NO: 70818 - protein, 230 aa, Streptococcus agalactiae 2603V/R
MVKLVFARHGESEWNKANLFTGWADVDLSEKGTQQAIDAGKLIQAAGIEFDLAFTSVLKRAIKTTNLALEAADQLWVPVEKSWRLNERHYGGLTGKNKAEAAEQFGDEQVHIWRRSYDVLPPDMAKDDEHSAHTDRRYASLDDSVIPDAENLKVTLERALPFWEDKIAPALKDGKNVFVGAHGNSIRALVKHIKQLSDDEIMDVEIPNFPPLVFEFDEKLNLVSEYYLGK

SEQ ID NO: 70819 - protein, 388 aa, Salmonella enterica subsp. salamae
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNARDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 70820 - protein, 278 aa, Oryza sativa Indica Group
MATSPRSPPGAPPPPEFEISRQSRLLAALSKKVIDLDELRMLAAQGVPDGAAVRPTVWKVLSLLLGYLPSDRALWEQELAKKRSQYAAFKEEFLSNPYSEIIEQIDRDVKRTHPDMHFFCGDSSFAKSNQNFAEADSFFCFMELLSGFRDNFCQKLDNSAVGIQGTLSKLSQLVAKYDGELQRHLEITTEINPQFYAFRWITLLLTQEFNFADTIHIWDTLLSDPDGPQETLLRICCAMLILVRKRLLAGDFTSNLKLLQNYPPTNISHLLYVANKLH

SEQ ID NO: 70821 - protein, 337 aa, Brassica napus
  misc_feature (150)..(150): Xaa can be any naturally occurring amino acid
MSIPMELMSIRNPNSTFLHRPHSHPPATLRSLRFQHLPNQRHHLTSPSLVSCTGLRLRFTSDTKLNRSFVAFAASHEDSEPSDVEVEKEKSVVDGDDNDSTSQEAWKQTLASVKEQVSKIQSVSSEAYNVNSQKAMTILKDTSEQLRIQXAEKAKEELGTKAKEVGEEGREYILKAAEESPSDVKEIVEAFSSTEDLRDVSRTQDFHVGIPYGLLLFVGGFLSFMISGSIPAIRFGVILGGALFALSMASLKAQRLGESSAKFLKGQMAIVAIIFLRELKLVLFQRSTFMGFLPPLTSGGVLAFYGYKLVSNKKKGPNKEQGGEEDETSEGFASREG

SEQ ID NO: 70822 - protein, 280 aa, Corynebacterium glutamicum ATCC 13032
MEQQSFNELRAIAAETATLTAVRIRDKRAELTNLWDYTNTKSSTVDPVTIVDTLAEDFIANRLQELRPKDGLIGEEGTGTASISGVTWIVDPIDGTVNFLYDLPQYAVSIAAAIDGEVVAGAVINVVTGVLYTAARHEGATKYLPERDEIVPLKASAATVVSESLVATGFSYSALRRSLQADLLTKILPTVRDIRRMGSAALDLCHLADGQVDIYYEHGLNCWDFAAGSLIAAEAGAFVRAPGLSIPGSSGEICFGAAPGVFDDANAHFDVVGAFKALDR

SEQ ID NO: 70823 - protein, 53 aa, Triticum aestivum
  misc_feature (27)..(27): Xaa can be any naturally occurring amino acid
  misc_feature (38)..(38): Xaa can be any naturally occurring amino acid
  misc_feature (45)..(45): Xaa can be any naturally occurring amino acid
  misc_feature (47)..(47): Xaa can be any naturally occurring amino acid
  misc_feature (49)..(50): Xaa can be any naturally occurring amino acid
MKLNIANPATGCQKLVECEDDRKLIPXMDKRMATEVAXDSLGDDXKXYXXKIT

SEQ ID NO: 70824 - protein, 264 aa, Pseudomonas putida KT2440
MKTIYMVGAGHMGGAILLGLKAYFKSATDLRVIEIDTQRSNDWRAKGFETSSRIQTLQPQDCVVLAVPPQQFENMLAANPVLCRHRGPVVSVMAGITHATLVRLLGHDAVVRAIPNTPSEVAQGVTMYYAPSDADAALIDSARQIFDVIGLSLRVNDERQIDTGTALAGGGPALVAHFADALQDYGLHMGLDSEQAAVVALQLLSGTAALIQASGKPASQICQEVQTAGGTTERAIRALDAAGFKGLVNAALDAAARRSAELGQ

SEQ ID NO: 70825 - protein, 400 aa, Clostridium perfringens SM101
MIGVIGVKRNVDIAIREKLALYPKKHKKYVGELLNSFKEVVILNTCNRTEIYFNCTEEISEDEIFDKIFNVFNWNDDLKKYMFLSKEKRAVTHLMEVICGFHSRILGEDQILGQIKDAYKTAISDNSISSELQKMFEIAIACGKKFKTKCKMFEVPVSSVSISINSALLKGCRKFMVLGYGEIGKLAIKHLLSHKVECIYLIVRDKSKASDLEGEIVEILDFNEKNHVINEVDCIVSCTAAPHTVVRNEDIKTEGDIIHIYDLAVPRDVDKELSEKERVILKDIDEISKIDDKNKKIRKERMEEYKHIVEESIEEFLNWLKIREVSSKIRNIKIRENEICSERIKTFSNKGNGENAKLAERMIKSTADAYVNRAIELLKSEALKGSDSSCAEIIEKIFLT

SEQ ID NO: 70826 - protein, 423 aa, Vitis vinifera
  misc_feature (10)..(10): Xaa can be any naturally occurring amino acid
  misc_feature (33)..(33): Xaa can be any naturally occurring amino acid
MADVGGTMSXVSAPVRRVLLISAGASHSVALLXGNVVCSWGRGEDGQLGHGDAEDRLSPTYLSALDGHEVVSVTCGADHTTAYSESFTQVYSWGCDLFTPQPIKALHGLRIKQIACGDSHCLAVTMDGEVQSWGRNQNGQLGLGTTEDSLVPQKIQAFQGVSVKMVAAGAEHTAAVTEDGELYGWGWGRYGNLGLGDRNDRLVPEKVSTVEGVKMVKVACGWRHTISVSSSGGLYTYGWSKYGQLGHGDFEDHLTPHKLEALQENLISEISGGWRHTMALTSDGKLYGWGWNKFGQVGVGDNVDHCSPVQVKFPHEQKVVHISCGWRHTLAVTERQNVFSWGRGTNGQLGHGESIDRNIPKMIEVLSADGSGGQQIETSKVDPSTGRIWVSPSERYAVVPDETGNGNDASVPESDVKRIRLAE

SEQ ID NO: 70827 - protein, 136 aa, Burkholderia xenovorans LB400
MLYIYRIAHLLHRLHVPFLPWALKVFNRVVFSVSLPPSVIVGRNVVFGYQGLGIVVHRHAVLGSDIVIAPNVVIGGRGQPGAPIIEDNVLIGAGACILGPVTIGRNVKIGANAVVTFDVPPNVTVAGVPARIVKLR

SEQ ID NO: 70828 - protein, 109 aa, Vitis vinifera
MSSHNNSSPAVNDPRQPSTANPYVAPMVRPEDLPVDYSGFIAVIFAIVGLMFRYKLCSWLAIIFCAQSLSNMRNFENDLKQISMAMMFAIMGLMTNYLGLGPTRPSTQG

SEQ ID NO: 70829 - protein, 410 aa, Streptococcus pneumoniae
MKIAVAGTGYVGLSIAILLAQHHQVVAVDIIPEKVELINKKKSPIQDDYIEKYLAEKELNLVATLNAEEAYENADFIVIAAPTNYDPKKNFFDTSSVEAVIEAVMKYNPDAIIIIKSTVPVGYTKSVRRKFLTDNIMFSPEFLRESKALYDNLYPSRIIIGTDKDDKDLVKSAEIFVKMLQEGAVKENIETLYMDFTEAEAVKLFANTYLALRVSYFNELDTYSEMKGLDTQAIIDGVCLDPRIGSHYNNPSFGYGGYCLPKDTKQLLANYSDVPQEMITAIVQSNRTRKDYIADRILDLAGSYVGNDFYKPDKEKEIVVGIYRLTMKSNSDNFRQSSIQGIMKRLKAKGVTIIIYEPTLESGTTFYGSQVVNDFEIFKKSSQVIVANRFDETLEDVRGKVYTRDIFKRD

SEQ ID NO: 70830 - protein, 179 aa, Coprinopsis cinerea okayama7#130
MSATIKVGDAIPEATFKYIPWTEALENNLACGSPVELSTNDWKNKKVVIVSVPGAFTPTCHTNHLPPFLQKYDEFKKKGVDVIAVLAANDPFVMSGWGRFEGLKDKVGIHVLTYILTISDTNAEWSKKLGLEKDLSAHGLGIRTARYAIILENNVVKYLGVESGPGVTVSGADAILQNL

SEQ ID NO: 70831 - protein, 273 aa, Lactobacillus johnsonii NCC 533
MKHLTLNNGVKIPIFGFGTYEISPDQTKEAVLSAFKDGYRLIDTAQYYQNEQQVGEAVRASNLNRDEVFITTKTMTDGYEATKQGLDESLNKSGLDYFDLVLIHWPMGHDLDTWRALEEAYKAGKTRAIGISNFNSRQTLELINHAEIRPMVDQIETHLLLQQWKMHEFLKKENIIHESYSPLGNGQQNLMTNPVLQKIGEKYGKSPIQVILRYLVQNDIVTIPRSTNPAHIKANIDIFDFELDKEDLKQLCALDERKPIDGWPAEMREDEDY

SEQ ID NO: 70832 - protein, 388 aa, Salmonella enterica subsp. VII
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTRRLVRAAIEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 70833 - protein, 496 aa, Funalia trogii
AIGPVADLTISNGAVSPDGFSRQAILVNDVFPSPLITGNKGDRFQLNVIDNMTNHTMLKSTSIHWHGFFQHGTNWADGPAFVNQCPISTGHAFLYDFQVPDQAGTFWYHSHLSTQYCDGLRGPIVVYDPQDPHKSLYDVDDDSTVITLADWYHLAAKVGSPVPTADATLINGLGRSIDTLNADLAVITVTKGKRYRFRLVSLSCDPNHVFSIDGHSLTVIEADSVNLKPQTVDSIQIFAAQRYSFVLNADQDVGNYWIRALPNSGTRNFDGGVNSAILRYDGAAPVEPTTSQTPSTNPLVESALTTLEGTAAPGSPAPGGVDLALNMAFGFAGGKFTINGASFTPPTVPVLLQILSGAQSAQDLLPSGSVYSLPANADIEISLPATAAAPGFPHPFHLHGHTFAVVRSAGSSTYNYENPVYRDVVSTGSPGDNVTIRFRTDNPGPWFLHCHIDFHLEAGFAVVMAEDIPEVAATNPVPQAWSDLCPTYDALSPDDQ

SEQ ID NO: 70834 - protein, 495 aa, Oryza sativa Indica Group
MGGGQSRSPRDGSGHGRYGHSPSFQQQWGGGGGGGGGGGGGYPYGQDAHGGGYYGAPAPQGGYAAPYPAYQQPPPPMSSPAATQPPARAGGASKPRLDRRYSRIADDYHSVDQVTDALAQAGLESSNLIVGIDFTKSNEWLGKFSFHGRSLHHISNAPNPYEQAISIIGQTLSKFDEDNLIPCFGFGDATTHDQDVFCFYPDLRPCNGFSEALSRYRELVPHLRLAGPTSFAPIIEMAMTIVEQSGGQYHVLLIIADGQVTRSVDTASGQLSSQEQKTVDAIVRASELPLSIVLVGVGDGPWDMMKEFDDNIPSRAFDNFQFVNFSEIMNKNMPQSRKEAAFALSALMEIPQQYKATVELGILGRRSFKSPERVPLPPPGGSHDAYSYGSKSFSKPSTYPQSSTSSSSYPHYETAQSSSPAAPSSTYDNQVCPICLVNPKDMAFGCGHQCNPCKAFERLADKPVKYWVCIDKDRKASNPLLQDCGAGDVSSIETH

SEQ ID NO: 70835 - protein, 631 aa, Pseudoalteromonas tunicata D2
MTIEINVPDIGADAVEVTEILVKVGDTVVEDQSLLTVEGDKASMEVPASTSGVVKEIKIALGDKVTTGSLIMIFEGESQAAPAPVATAAPAAAPVSAATAQNVNVPDIGGDEVEVTAILVAVGDVVAEDQSILNVEGDKASMEVPAPFAGTVKEIKVATGDKVTTGSLVMVFDVAGAASVEVAVPVAAAAPVASASSEQNVCVPDIGGDQVEVTEILVAVGDVVKEDQSILNVEGDKASMEVPAPVAGTVKEIKVAVGDKVGTGSLVFVFEVAGSAPVAQAPVAQAPVAQAPTAAAPSAPAVQAVAPVQAAQAESFAENSAYAHASPVIRRLAREFGVNLANVKGSGRKGRVVKEDVQNYVKNLVKQVESGALSTSKGTTGGGELNLIPWPKVDFAKFGEVEEKKLSRIQKLSGANLHRNWVQIPHVTQFDEADITTLEEFRKEQNALAEKQKLGVKITPLVFVMKAAAKALVEFPTFNSSLSNDGESLILKKYVNIGVAVDTPNGLVVPVFKDVHKKGIIELSRELMDISKKAREGKLTAADMQGGCFTISSLGGIGGTAFTPIVNAPEVAILGVSKSDIKPKWNGKEFEPKLMVPLSMSYDHRVIDGALAARFTATLASYLSDIRQLVM

SEQ ID NO: 70836 - protein, 474 aa, Pseudoalteromonas tunicata D2
MSNEIKTQVVVLGGGPGGYSAAFRAADLGLEVTLVESRETLGGVCLNVGCIPSKALLHVAKVIDDAAEMSSHGVTFGAPQIDLDKVRSWKDSVIGQLTGGLAGMAKMRKVKTVFGYGKFTGANTLAVEGADGTTTITFDNAIIAAGSQPVNLPFIPKDDRVIDSTGALELKDVPAKLLVLGGGIIGLEMGTVYRALGSQIDVVEFADQLIPAADKDVIKIYQRYVKDKFNVMLSTKVVAVEAKDDGLYVTFEGKEAPAEPVRYDKVLVAVGRTPNGKLLDADKAGVNVDERGFINVDKQLRTNVNHIFAIGDLVGQPMLAHKAVHEGHVAAEVISGQKHFFDPKCIPSIAYTDPEIAWVGVTEKEAKEKGLNIETAVFPWAASGRAIASARTEGQTKLIFDKDSGRIIGGAMIGINAGEMLGEIGLAVEMGADGEDLALTIHAHPTLNESIGLAAEIFEGSITDLPNKKAVKKK

SEQ ID NO: 70837 - protein, 388 aa, Salmonella enterica subsp. houtenae
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTRRLVRAALEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 70838 - protein, 122 aa, Arabidopsis thaliana
  misc_feature (8)..(8): Xaa can be any naturally occurring amino acid
  misc_feature (28)..(28): Xaa can be any naturally occurring amino acid
  misc_feature (45)..(45): Xaa can be any naturally occurring amino acid
  misc_feature (74)..(74): Xaa can be any naturally occurring amino acid
  misc_feature (83)..(83): Xaa can be any naturally occurring amino acid
  misc_feature (98)..(98): Xaa can be any naturally occurring amino acid
MEQTFIMXKPEGVQRGLIGEVICRFEKXRGFTLKGSKVDQVVERXFWLRKHYERIYLSRSFLSVGTRFDYIGIXGPVVAMIWXGKNVVLTGRKIMGAXTNPAASEPGTIRGDFAIDIGRNVI

SEQ ID NO: 70839 - protein, 120 aa, Oryza sativa
  misc_feature (93)..(93): Xaa can be any naturally occurring amino acid
MAPTVMAYSATSEAPLQGLKSTAGLPVRRRSTNSGFGSVSNGGRIKCVHAWPIEGIKEFETLSYLAPLTRGDLSEHSRDLLPSKVVPSLAFSXVGFVYRENHRSLVYYDGRYCTMWKLPC

SEQ ID NO: 70840 - protein, 329 aa, Corynebacterium glutamicum ATCC 13032
MKLLVTGGAGYVGSVAAAVLLEHGHDVTIIDNFSTGNREAVPADARLIEGDVNDVVEEVLSEGGFEGVVHFAARSLVGESVEKPNEYWHDNVVTALTLLDAMRAHGVNNLVFSSTAATYGEPDVVPITEDMPTQPTNAYGATKLSIDYAITSYAAAFGLAATSLRYFNVAGAYGNIGENREVETHLIPLVLQVATGHREKTFMFGDDWPTPDGTAVRDYIHILDLAKAHVLALESNEAGKHRIFNLGSGDGYSVKQVVEMCREVTGHPIPAEVAPRRAGDPATLIASSEKAKQELGWTPEHTDLRTIVEDAWAFTSALGDRSHAAKKKA

SEQ ID NO: 70841 - protein, 358 aa, Ralstonia eutropha JMP134
MSKFHELTVASVTRETRDAVAVTFAVPEDLADTYRYVQGQHLTLRAGIGGEDVRRSYSICSAVQDRRLRVAIKRVDGGMFSNWANDALQPGMTLEVMPPSGHFHVPLSDTHSKHYVAFAAGSGITPMLSIIKTTLMTEPDSRFTLFYGNRASSSVLFKEELEDLKDTYLERFNLVFILSREQLDIDLFNGRIDGEKVRALLRHWVRPQDIDVAFICGPHSMMEEVSQALQENGVDKARIKRELFATSIPAARPAAHAHKQLGQQQCEVTVIQDGRTRQFTLEKNKETILDAALAQGIELPYSCKGGVCSTCRCKRIEGEVDMDVNFALEDYEVARGFILSCQSYAVTDKLVIDFDQET

SEQ ID NO: 70842 - protein, 286 aa, Brassica napus
  misc_feature (216)..(216): Xaa can be any naturally occurring amino acid
CHNGHTLCSTCKVRVHNRCPTCRQELGDIRCLALEKVAESLELPCKFYNLGCPEIFPYYSKLKHESLCNFRPYGCPYAGSECGVVGDIPFLVSHLRDDHKVDMHAGSTFNHRYVKSNPREVENATWMLTVFHCFGQYFCLHFEAFQLGMGPVYMAFLRFMGDEEEARSYSYSLEVGGSGRKLTWGGTPRSIRDSHRKVRDSNDGLIIQRNMALFFXSGGDRKELKLRVTGKIWKEQHSPDSGLFMPKPIFLIVHAFSSFFFSIFENESCMMNTFTHFFFICILNIS

SEQ ID NO: 70843 - protein, 326 aa, Bacillus anthracis str. A2012
MEVFHMKALCFETFGNADVLQYKEIPDPIINPNEILVRTKAIGLNFADIYRRRGDYHLAGNPPYILGYEGAGIVEEIGTNVTTIKPGDRIAFADVPFANAELVAVPSKKTIQLPNSISFETAASVLLQGLTAHYLTKDSYQIKQGDIALVHAAAGGVGQLLIQIIKLLGGTAIGLTSSNEKAKVATLAGADHVFLYSEKWHSKVLEITNGTGVNVVYESVGSTLEESFNATKIGGTVVFYGMAGGNPAPVDPRMLMDTSKTLTGGDLWNVLTTFEERKQRSTQLFDWIASGKLNIASPTTFSLQDGAHAHKLLESRKSTGKILLIP

SEQ ID NO: 70844 - protein, 482 aa, Solanum tuberosum
  misc_feature (210)..(210): Xaa can be any naturally occurring amino acid
MASATASHTFCGIPTTSSSSTTNRSTTHSSARFLLKTPLRRLGFAGAVADPLFTNHVATKLRSLKASSNPVRAVVSMAKKSVGDLSSSDLKGKKVFVRADLNVPLDDAQNITDDTRIRAAIPTIKHLIANGAKVILSTHLGRPKGVTPKYSLAPLVPRLSELLGIQVVKADDCIGPEVEKLVDSLPEGGVLLLENVRFYKEEEKNEPEFXKKLASLADLYVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFAAGTEAIAKKLADLSGKGVTTIIGGGDSVAAVEKVGVASVMSHISTGGGASLELLEGKVLPGVIALDEADAPVAV

SEQ ID NO: 70845 - protein, 331 aa, Clostridium perfringens SM101
MAVNLKGRSFLTLKDFTPAEIRYLLDLSHDLKAKKRAGILGDSLKGKNVVLLFEKTSTRTRCAFECGAAEEGAHVTFLTNSQMGKKESIEDTAKVLGRMYDGIEFRGFKQSTVEELAKHAGVPVWNGLTDADHPTQILADFLTIEEHAHKPLSEIKLVFTGDTRNNMSYALMYGAAKMGMHFVALGPDSLKPDEDILKEMQEYSKETGATIEFSSNVDEAVKGADVIYTDIWVSMGEDESLYPERVKLLTPYKVTREMMNKTGNKNTLFMHCLPSFHDEDTEVCKDMMDRLGLDIREVEDEVFRSKNSVVFDEAENRMHTIKAVMVATAGK

SEQ ID NO: 70846 - protein, 1041 aa, Gibberella zeae PH-1
MGETPFKWAKEDDPESPDSWSEEAEMSDTTVPRNETFVGRWMRLVVALLTVLSIFMLTAFIFFQQSSFTHHQDSHSEHFQTTKPQATQASNSVEYKEDIPSIPQLRDTKEYILLQTWDFDASPTTREHFWTINQETLNPDGVYRPMLLINNQFPGPLVECNEGDTIIVHIKNDAPNATAIHFHGMFQNGTNGMDGTVGVTQCPIAPNSTFTYKFDVRGQHGTYWYHAHHSAQASDGLLGPMVVHSKKEHNLQKIDYATDRVVMVQDHYHNLTSELLMEYLAPDQENNEPVPDNGLINGRGLRDCLDFRGWDCNSTDREMPNINLEAGQRHRLRIINVGAFAEFQVQFDEHPFYVTEVDGTDVHPESVHRLNILPAQRYSVILETNATTGSAFWMRARMVTHCFKNENERLEPEAKAIIRYEGHNKTSSNEKPTSKEWPDAIEVICRDLNTSSLRPVEVISPPPSDKVIILRANFEIGDWRLARGFFNESTWHPNITSPSLHRFLDSGVQSTSKKTPIAINERVFDRNKELVLETTGIQTVDISINNFDDGAHPFHLHGHKFFVLLQGRDGYPPSPAELPEYLEKHNLLENPLRRDVVTVEGYAWAIIRVVLDNPGLWAFHCHNTWHAESGMVMQMLVRPEVMKDWKSTSEERDMCLRDGVMSGMRPDDSLCQLLQVRLLTLPVTRVASVQYNSIVDYNALFDQMFNILLLFTITSYIFPPQPSSIFLMPSLSQLLAYANQEFTDVYNRGPYTSYKQIEFLLLISDACIAASADVEATWKGKAGRCTATSLKVSDQLMRKYPGQFEFEYFSVRRGKVSHRFSRCALTGIVIDVICSMGAFILPDNELRTITTMYTLSWGHQDGNVYMIDEDGMDQFCEKVSHVRAQALCLYEVSRSGQLVVLFRELNPRFLNQNISGYEYKTAMFPHGCIKFKLKPDSASGPGLKQLHLTPNPDDPGDKTIIVWSQDHTDQDRGEAQNEVHYFLATWTGCHANRQWPADGINWFYRELFWQLCLGYGNPKILTKADAEYSLPDKGGLGLCTC

SEQ ID NO: 70847 - protein, 408 aa, Aquifex aeolicus VF5
MAAAPVEGNGAGLDVHTLFLHLAILLFSAKLFGSIFRKLGIPPVLGEVTAGVILGQSVLGLIPLSEAIKVLAELGVILLLFEVGLEADINMLMRVGLWSTLVAIVGAALPFAGGFIVSYYFFGLDLVASLFMGGALTATSIGITVRVLTDLNKHKERFAQIVLGAAVLDDIMGVIILAALYEFSKTKAVHFDTTVNLIIHILMFFLIAPFVANVLAKLLSIAARKTQDMDLIPASIMALILLAAYSAHKFGSPSILGSFTAGLALSRRFVIPFAAMLRLDEKLLHKVEESITPLVWVMAPIFFVSVGLALNLKAIDFSSPEFWTFSSALIVVAIIGKVLAGFVAPGSLKEKASIGFSMLPRGEVGLIFAEFGRSFKAINEVEYAVIVFVVAVTTLIAPIVLKLLLKEE

SEQ ID NO: 70848 - protein, 346 aa, Mycoplasma pneumoniae
MPINLKGRSLDSALNFTTAQINYLIDLAIDLNAVNTKLHIQNRPLAGKNIVLLFQKDSTRTRCAFEVAAFDLGMGCTYIGPSGSNFGKKESIEDTAKVLGSMYDGIEFRGFKQSDVDALVKYSGVPVWNGLTDAEHPTQMLADYMTIKELKGDLKGRKIVFAGDIKNNVARSLMIGAAFVGMDIVLVGPKAQHELVQNGAGYKEVFEQCQALFQLNGGSVSFSTDKLQAAKNADVIYTDVWLSLGEDFSLFEERIQELGQFQVDMAMIKAAKSDVIFLHCLPAFHDDHTSFSLEIKQKLGKKYPVVKTGAMEVTDTVFQSKHNMAFIQAENRLHTIKAVILATLGY

SEQ ID NO: 70849 - protein, 180 aa, Hordeum vulgare
KLMAQIFDLKFTSKSLQRQARKCEKEEKDQKLKVKKAIEKGNVDGARIYAENAIRKRTEHMNYLRLASRLDAVVSRLDTQAKMQAIGKSMGNIVKSLDSSLATGNLQKMSETMDNFERQFVNMEVQAEFMEGAMAGSTSLSTPETEVNSLMQQVADDYGLEVSVGLPQAAAHAIPAAKEK

SEQ ID NO: 70850 - protein, 456 aa, Gloeobacter violaceus PCC 7421
MSGSFARPDTLVGRTVGRYRLVEKIGAGGMGSVYRAVHIEIEDLVVAVKLLLPGLIDDEALRRRFKDEAAICARLSERSSHIVQIRDYGILEDLDLPYFTMEYLQGRSLQHLMHKVAAPVHQGLAIARQICLGLRVAHDMNVVHRDLKPSNIHLIPDLQLGEKVKLLDFGIARLVRDAQRGPLTQGYLGTPQYSAPEQLRGLEVDARADIYSLGMILYELFSGVCPFAVEDQNFETWYVLHTEGEPSPMAAANPRRPVPMAIEQLVLHCLAKKPADRPAGVSEILERLELVMGHLPPAPPAAAIPPPPTITLSAEQVAHLEKQLATQVGPIAPTLVRRALGSSHTPGELVEQLAAQLPATQREKFSRTVLANLSAQTSAAPSPGVREGSVPPVLRLDPRFVERCGHELSRLVGPIAAFLLQSALKETPPTPAVLVERLAALVGDQAKAEQLRRKLL

SEQ ID NO: 70851 - protein, 180 aa, Hordeum vulgare subsp. vulgare
KLMAQIFDLKFTSKSLQRQARKCEKEEKDQKLKVKKAIEKGNVDGARIYAENAIRKRTEHMNYLRLASRLDAVVARLDTQAKMQAIGKSMGNIVKSLDSSLATGNLQKMSETMDNFERQFVNMEVQAEFMEGAMAGSTSLSTPETEVNSLMQQVADDYGLEVSVGLPQAAAHAIPAAKEK

SEQ ID NO: 70852 - protein, 227 aa, Haemophilus somnus 2336
MELVFIRHGFSEWNAKNLFTGWRDVNLTERGIEEAKAAGKKLLEAGYEFDIAFTSVLTRAIKTCNIVLEESNQLWIPQVKHWRLNERHYGALQGLDKKATAEQYGDEQVHIWRRSYDVSPPDLDPQDPNSAHNDRRYALLPKDVVPNAENLKITLERVLPFWEDQIAPALLSGKRVLVTAHGNSLRALAKHIIGISDEEIMAFEIPTGQPLVLKLDEQLNFVEKFYL

SEQ ID NO: 70853 - protein, 150 aa, Triticum aestivum
MATTRGSGAMWPQALLAAASSSSSLPWPRRLPAAATVKTTTRRKNMARRRCLQRRTTTSSGEIARRLVRKRTKVLRGMVPGGELLDGASLLREAMDYVVHLRAQVAVLRRVSNAMQHRPSSHHMTVAVAPPVPLKTETTGKAQASDGNQE

SEQ ID NO: 70854 - protein, 528 aa, Streptococcus agalactiae 2603V/R
MKFTELNLSQDILSAVEKAGFVEPSPIQEMTIPLALEGKDVIGQAQTGTGKTAAFGLPTLNKIHTEDNTIQALIIAPTRELAVQSQEELFRFGRDKGVKVRSVYGGSSIEKQIKALRSGAHVVVGTPGRLLDLIKRKALKLNHIETLILDEADEMLNMGFLEDIEAIISRVPETRQTLLFSATMPDPIKRIGVKFMKDPEHVKIKATELTNVNVDQYYVRVKENEKFDTMTRLMDVDQPELSIVFGRTKRRVDELTRGLKLRGFRAEGIHGDLDQNKRLRVIRDFKNDHIDILVATDVAARGLDISGVTHVYNYDIPQDPESYVHRIGRTGRAGKSGQSITFVSPNEMGYLTIIENLTKKRMTGMKPATASEAFQAKKKVALKRIARDFEDQELVSKFDKFKADALELATQYTPEELALYVLSLTVQDPESLPEVEITREKPLPFKPSGGGFKGKGGRGNGRGGDRRRNDRGDRRGNRDRDDRGSRCDFKRRDDKFKKDNRRQENKKPHKNTSSEKQTGFVIRNKGDK

SEQ ID NO: 70855 - protein, 298 aa, Klebsiella pneumoniae subsp. pneumoniae MGH 78578
MNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGAKFRESIKKLLA

SEQ ID NO: 70856 - protein, 355 aa, Burkholderia xenovorans LB400
MLLLNPGPVTLTERVRNSLLQTDLCHRESEFFDLQGEARTRLVDLYGLDASEWQAVLMTGSGTAAVESMSAALVPQNGKLLVVENGVYGERISQIAAQYGIAHESLKHDWMQAPDLTKIAAHLDADKAFTHVAVIHHETTTGRLNDLAALGALCRERGLRLLVDGVSSFGAETIDFADSSLDAVAATANKCLHGVPGASFVLVRRAALAQAASRTYYLDLGRLARLQDQRNTPFTPSVHAYYALVEALRELADEGGWRARHARYAALAEQARAGLAERGIGSVLPPEQSSVVLRAYRLPAGITYPQLHDALKARGFVIYAGQGGLSAELFRISTMGNIHAADIDRLLQGFSELMR

SEQ ID NO: 70857 - protein, 86 aa, Brassica napus
MPPGAKKRKALNKKQQQQQAIGTSTNGDNLHGGNDEHGSQQDDRESDGNLSSPGSQGNEEFGGMKDPSAAMVKDTAKEITEATQGL

SEQ ID NO: 70858 - protein, 291 aa, Lactobacillus johnsonii NCC 533
MTEVPTITLNDGNKMPLLGLGVFQIPDHEKARQTVEMALANGYRMIDTAEVYENQIAVGEAIAESAVNRDDIFLTTKIWVSNMSFEKATKAIDHDLKELGTDYLDLVLLHQPYGDTFGAWNALAAAKRAGKVRSIGLSNFYPDQYMNLELAHEDKPAINQIEINPWFQQTNDVKFFQGRDVVVEAWAQFAEGKHDIFNNKTLKEIADAHHKTTAQVILRWLTQQDIVVIPKSVHEKRQKENLDIFDFELTKDEMDKIKGLDKGVSQFFDHRDPAVIDDIFGESLKQLRDSE

SEQ ID NO: 70859 - protein, 213 aa, Klebsiella pneumoniae subsp. pneumoniae MGH 78578
MTDMSHQCVIVGIAGASASGKSLIASTLYRELREQVGDEHIGVIPEDSYYKDQSHLSMEERVKTNYDHPSSMDHSLLFQHLQMLKSGQPIELPVYSYVEHTRTPNTIHVEPKKVIILEGILLLTDARLRNELNFSIFVDTPLDICLMRRIKRDVNERGRSMDSVMAQYQKTVRPMFLQFIEPSKQYADIIVPRGGKNRIAIDILKAKISQFFE

SEQ ID NO: 70860 - protein, 388 aa, Salmonella enterica subsp. arizonae
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFSGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMDGAKLLK

SEQ ID NO: 70861 - protein, 431 aa, Rhodococcus sp. RHA1
MTSPSLSVDDITSLDASLLWHPYGAFPASTTPLVVAEASGTRLTLADGRELVDGMSSWWAAVHGYRHPVLDAAATAQLGRMSHVMFGGLTHEPAARLAQLLVEITPDGLDKVFLADSGSVSVEVAVKMCLQYWRSRGRPERHRLLTWRGGYHGDTFAPMSVCDPDGGMHSLWTDVLARQVFAGPPPREFDPRYVAEFEHLVASHTDELAAVIVEPVVQGAGGMRFHDPRYLSELRRICDEHGLLLVFDEIATGFGRTGELFAADHAGARPDIMCVGKALTGGYMTLAATLCSTDVAETISAGDAGGLMHGPTFMANPLACAVAVASIELLLSRDWRAEVEGVRRELESGLAPARELPGVRDVRVLGAIGVIELAEPVDMRAATDAAVAAGVWLRPFRNLIYAMPPYVCTTGDVRKITAGMLAAARSSTPGR

SEQ ID NO: 70862 - protein, 449 aa, Triticum aestivum
MQQRMKQAAAVAAQQQQQMMQQALLMHQHQQQQQAAAAVPPMFPPHHAHPGLLAAPHIEPIVSGNLPPGFDSSTCRSVYVGNIHLQVTDSLLHEVFQSIGPVEGCKLIRKEKSSFGFVDYYDRRYAALAIVSLNGRQLFGQPIKVNWAYASTQREDTSGHFNIFVGDLCPEVTDAALFAFFSAYSTCSDARVMWDQQTGRSRGFGFVSFRNQQDAQTAINELNGKWLGNRQIRCNWATKGANAGEEKQSTDSKGVVELINGSSEPGKENANEDGPENNPQYTTVYVGNLPHDINSNDVHRFFHLLGAGSIEEVRVTRDKGFGFVRYSTHEEAAQAIQTGNGQFIGGRQIKCSWGSKPTPPGTASAPLPPPALAPYTPGVSAVDLISYERSLALSKMAANPALMGQVAALRQAAMGMGTGASQAIFDGSFQSVNPQQQQQQQQQQQLMYY

SEQ ID NO: 70863 - protein, 141 aa, Zea mays
  misc_feature (128)..(128): Xaa can be any naturally occurring amino acid
NQPRGGHIFNLDGAGSDGRPTPRFAAYGATKRSVVHLTKSLQAELQMNEVNNVMVHNLSPGMVTTDLLMSGATTKQAKFFINILAEPPDVVADYLVPNVREIPTKQSMKPTYIRFLTGLKAYSRIFSXAFGARRNKYVTED

SEQ ID NO: 70864 - protein, 388 aa, Salmonella bongori
QNGKLNVPENPIIPFIEGDGIGVDVTPAMLKVVDAAVEKAYKGERKISWMEIYTGEKSTQVYGQDVWLPAETLDLIREYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFGGELIDGGPWMKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 70865 - protein, 343 aa, Physcomitrella patens subsp. patens
MPAPLSMPPPVSHPDMGHNPNPAPQMTLAALAPVPQPRPVPVVQPPIAFQVPRKRINNPSDIEHFHKSEAGKIFLGFIAGLSASMEGKKLSDYCRESPLIKTLCNILEEMSSWIDQLPPKQQPARYGNPVFREWQTWLEERGPGLMVRILPEDLKEGVVELFPYFADSFGNATRIDYGTGHETNFAAWLLCLARLGLVNEDDYQALVARVFVKYLDLMRKLQTTYWLEPAGSHGVWGLDDYHFLPFIFGSAQLKDHKYMKPKSIHNADILENFSHEYLYLGCVQFVKKVKKGVLAEHSPIIDDISAVATWNKVNSGMLKMYKAEVLEKVPIMQHFLFGSLIKW

SEQ ID NO: 70866 - protein, 602 aa, Coccidioides immitis RS
MPRFAIRPGSLRPFIRPHLAQRFNPRWTKRFAQVKSTGSETATKDPVELDQITTLPNGLRVATESLPGPFAGVGVYIDAGSRYENESLRGVSHIVDRLAFKSTKTRTGDQMLEALESLGGNIQCASSRESLMYQSASFNSAVPTTLGLLAETIREPLITDEEVQMQLAVADYEIRELWAKPEMILPELVNMAAYKDNTLGNPLLCPKERLDQIDRKTVERYRDVFFGPERMVVAFAGVPHAEAVRLTEMYFGDMKRKTAPVLEGVGSEIRVNDADEEVPTMPAFSPSSTTVAETSSSSSSSSSRTSSSASTSRSSSSGMFSKLPFLKSLSTSASARASVSPLSPDLLKPDTLNLNQVSHYTGGFLSLPPIPPPANPALPRLSYIHIAFEALPISSPDIYALATLQTLLGGGGSFSAGGPGKGMYSRLYTNVLNQHGWVESCMAFNLSYTDSGLFGISASCHPQRLTHMIDVICGELQALTLEKGYSALQLAEVNRAKNQLRSSLLMNLESRMVELEDLGRQVQVHGRKIGAMEMCKQIEAVTVADLRRVAKDVFFGKVKNKGMGTGLPTVVLQEGELEGVKLNPMRWNDIQDRINGWYLGRR

SEQ ID NO: 70867 - protein, 417 aa, Solanum tuberosum
MQNQRLKQQQQQALMQQALLQQQSLYHPGLLAPPQIEPIPSGNLPPGFDPSTCRSVFVGNIHPQVTEPLLQEVFSSTGLVEGCKLIRKEKSSYGFIHYYDRRSAALAIVSLNGRHLFGQPIKVNWAFASGQREDTSSHFNIFVGDLSPEVTDAMLFACFSVYPGCSDARVMWDQKTGRSRGFGFVSFRNQQDAQSAINDLTGKWLGSRQIRCNWATKGANSNDDKQSSDAKSVVELTNGSSEDGKEAANSDAPENNPQYTTVYVGNIAPEVTQLDLHRYFHALGAGVIEEIRIQRDKGFGFVRYNTHAEAALAIQMGNTHSVLGGRQIKCSWGNKPTPPGTTSNPLPPPAPTPLGISATDLLAYERQLAMSKMGGVPGLMGQYPLKQASMGMASGASQAIYDGGFQNVAAQQLMYYQ

SEQ ID NO: 70868 - protein, 634 aa, Ustilago maydis 521
MLRSSNRHMAATLRYAASTEWYQAAAFTEGLAGPSVARRAGSASRHSSSRHRSSLRKGLTAPFSTSSCTARSSQLADHRIISDPFPNQDTGFSYEKRDQLGLRGLLPPAKQSLNTQVLRVLHQLRSKSTPLEKHVMLASLRQTNTRLYYATILANKEEILPLIYTPTVGEACQKFSHIYRRPEGLSISLEDKGKIASIVENWPVPAGSPRIAVITDGSRILGLGDLGWNGQGISIGKLSLYVAGAGIHPRATLPIVVDLGTNNKKNLEDPLYLGLRRERASTEEYIEFMDEVMHALHTRYPNLIIQFEDFTSENAFRFLERYQGKYPMFNDDIQGTGSVILAGFTNAARIASKESGRPLHDHRILMAGAGSAAVGVGKQLMSFFTRQGLSADEARERIFITDSKGLVTKDRGDKLAEHKVFFARDDNAGKQIKDLGEIIDYVKPTAILGLSTIKGTFDENVIRKMATLNKRPIIFPLSNPTDNSECTFEEAVKYTEGRVLFAAGSPFAEIDAASSPTGKRMIPGQGNNFLVFPGIGLCAALCKAGRVTNEMITESALALSDALTDQERAEGRLYPNTERIREISRDIAVKCIQMANKQGVTRDGGKTAAMDEEQLRDWVQGEMWTPKYDTAEDA

SEQ ID NO: 70869 - protein, 568 aa, Corynebacterium glutamicum ATCC 13032
MATVADVNQDTVLKGTGVVGGVRYASAVWITPRPELPQAGEVVAEENREAEQERFDAAAATVSSRLLERSEAAEGPAAEVLKATAGMVNDRGWRKAVIKGVKGGHPAEYAVVAATTKFISMFEAAGGLIAERTTDLRDIRDRVIAELRGDEEPGLPAVSGQVILFADDLSPADTAALDTDLFVGLVTELGGPTSHTAIIARQLNVPCIVASGAGIKDIKSGEKVLIDGSLGTIDRNADEAEATKLVSESLERAARIAEWKGPAQTKDGYRVQLLANVQDGNSAQQAAQTEAEGIGLFRTELCFLSATEEPSVDEQAAVYSKVLEAFPESKVVVRSLDAGSDKPVPFASMADEMNPALGVRGLRIARGQVDLLTRQLDAIAKASEELGRGDDAPTWVMAPMVATAYEAKWFADMCRERGLIAGAMIEVPAASLMADKIMPHLDFVSIGTNDLTQYTMAADRMSPELAYLTDPWQPAVLRLIKHTCDEGARFNTPVGVCGEAAADPLLATVLTGLGVNSLSAASTALAAVGAKLSEVTLETCKKAAEAALDAEGATEARDAVRAVIDAAV

SEQ ID NO: 70870 - protein, 275 aa, Oryza sativa
MGNCASFTPKWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDQHAVGGCGDITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 70871 - protein, 478 aa, Ralstonia eutropha JMP134
MTQTPQPSSGLSHGLKQRHMTMIALGGVIGAGLFVGSGVVIKSAGPAAVLSFLITGLLVVLVMRMLGELACAMPGGGSFYEYAREAWSDRPAVGNLASFLTGWMYWYFWVIVVALEAVAGADLVRYWLPDVPNWTISLVLLVMLTLTNLISVKSFGEFEFWFASIKVAAIMVFLFVAGVYVLGLAPGAHGMNVANLTANGGFMPNGIVPVLTGAVAATGFYFGAEIVTIAAAETAEPQKAVARATNSVITRVLVFYVGSVLLVVCLVPWNATGIATPYVSALNVMGIPAAAQIMNAIVLTAVLSALNSGLYASSRMLFALTKRGDAPRSLARVSRNGVPTRAILVATLFGYGAVVMSYVSPDKVFAFLVNSYGTVAIFVYILIAVSQLRLRARLEREAPHLLKVRMWCYPYLTWLAIFGMLAIVVAMAFIPDQRTPLALGVASLGLLVSAYIVRHLFRRGVQQVVPLAEMPRPDLHEY

SEQ ID NO: 70872 - protein, 562 aa, Methylococcus capsulatus str. Bath
MSRHELLIDGMTCTSCAEHVRQALEKVPSVRSASVSFPRKRAEIEADPGVGPDPLVAAVTALGYRARVSDTPGKSAGGLFDETFGCPDGGTKRVSGEPALHVTVIGSGGAAMAGALKAVELGARVTLIERGTIGGTCVNVGCVPSKIMIRAAHIAHLRRESPFDEGLPPTPPVVLRERLLAQQQGRVEELRHAKYEGILASTPAVTVLRGEARFMDAHTLTVALCHGGTRELSFDRCLVATGASPAIAPIQGLADTPYWTSTEALASDTIPERLAVIGSSVVAVELAQAFARLGSRVSILARRTLFFREDPAIGEAVTNAFRLEGIEVLEHAQASQVAYANGEFVMTTGHGERRADKLLVATGRAPNTRNLNLEAAGIKVDAQGAIIVDRAMRTSAPHIFAAGDCTDQPQFVYVAAAAGSRAAINMTGGSAELDLTTMPKVTFIDPQVATVGYSEAEARHDGIETVSRTLTLDNVPRALANFDTRGFIKLVAEAGTGRLIGVQAVAPEAGELIQAAALAIRHRMTVQELADQLFPYLTMVEGLKLAAQTFTKDVKRLSCCAG

SEQ ID NO: 70873 - protein, 250 aa, Magnetospirillum magnetotacticum MS-1
MAVPPSNEVDIFAHDLGFIAILDKKNKVTGWNVTVGGGMGMTHGETDTFPRTADVMGFCKPEDALKVAEAVMTVQRDWGNRKNRKNARLKYTIERFGLDAFRAEVEKRIGKTLAEPKPFTFDGNGDRYGWVEGEDGRHHLTLYVPSGRIKDIEGGPQFLSGLRRIAEVHEGDFRLTGNQNVIIANVPAGKRDQIEALVDEYGLTKGASALRRSSLACVALPTCGLALAESERYLPDLLTELEESLARHGL

SEQ ID NO: 70874 - protein, 472 aa, Oryza sativa Indica Group
MEYRRVKDQESYDVVSQKDIESPGERSLSSTSATSSLSTAGASKGNNSWKLKSIVTLALTLLTSSQAILIVWSKRAGKYEYSVTTANFSVEALKCLLSLIALYRTWNSQGVTEDNRLSTSFDEVSVYPIPAILYMVKNLLQYYIFAYVDAPAYQILKNLNIISTGVLYRIILKKKLSEIQWAAFILLCAGCTTAQLNPSSDHVLQTPIQGWVMAIVMALLSGFAGVYTEAIIKKRPSRNINVQNFWLYIFGMLFNLVAICVQDFDAVMNKGFFHGYSFITVLMILNHALSGIAVSMVMKYADNIVKVYSTSVAMLLTAVVSVFLFGFHLSLAFFLGSTWHSVLQRAENMVNAIKGLFISCDVPMAQFIVNLNASMPASDKFILHMLDPTHMFVQPHVAEMIRSSPNYQKLYYYQKSRAYEAGKVQIVSEFRNMELKFSGNGRQCKKKTSAAPSAVASWPIVFNAGPFLAFSP

SEQ ID NO: 70875 - protein, 386 aa, Gloeobacter violaceus PCC 7421
MESLTQPISIGALIDGRYRLTRYIDGGGMGKVYEAVDTRLGDKAVAVKLLQQNLNVDDRLFEQLRRRFEQEAQLCALLGGQHGIIAVSDYGLDGPQPYLVMEYLGAAPRGRSLKELVSAEGPLSPERTVRLAVQICESLQYAHGVRTHLGGRQITGVVHRDIKPSNIFVIDRALVGETTKVLDFGIAKAVSDVTIAMGTNMGFVGTCDYASPEQLRGEELDARSDIYSLGIVLYQMLTGQLPLQPKTHSFAGWYQAHNHESPVPLPRLAVGQAIPPRVAAVVMACLEKEPARRPASMQELSQRLQDELLKAAPAPVAPEREAPPPASDEALGAALAAAWPVLRERMERWRSQALDRLEKLPGRIRLGVGLLAAALALKTGRRKCDD

SEQ ID NO: 70876 - protein, 278 aa, Klebsiella pneumoniae subsp. pneumoniae MGH 78578
MPMLGFGVFKVTDKAECKQAVLNAIRTGYRLIDTAAVYDNEDAVGEAVREAIAEGLCTREALFITSKLWVQDMANTGMAKAGIAASLKKSGLEYFDLYLLHQAMGDYFSAWRALEEAYEAGTLKAIGVSNFYPHVLANFCETVRIKPMVNQVELHPYFAQPAALEAMKHYHVQPEAWAPLGGGRHNPYQDALLRGIADAHQKTIAQVVLRWNVQRGVTVIPKSTRQERIEENFAIWDFVLTDNEMAQISALDLGYVGEAVKHFNPEFVRGCLGVKIHD

SEQ ID NO: 70877 - protein, 113 aa, Oryza sativa Japonica Group
MAAIGSSNVGFQLLKKSGWKEGTGLGAQEQGRLEPVESRVKNNKRGLGSKEPKLKPKVDEDGEKDPKKPKLEAPKKKAKLAAKRIRKMQEEEKRLQEREFEMAFFREFWPDNV

SEQ ID NO: 70878 - protein, 362 aa, Aquifex aeolicus VF5
MEELKELRKEIDRIDEEILRLLNERAKLAKRIGEIKSKANLPIHVPEREREIFEKILRLNKEVYGGVFPQEALVHIYREIISACLSLEKKIKVAYLGPKATFTHQAALEFFGFSAHYTPCSTIRDVFVEVETKRADYGVVPVENTIEGVVNYTLDMFLESDVKIAGEIVIPITLHLLSASDSIENVEKVYSHKMALAQCRSWLEKNLPSVQVIEVESTAKACEIALEDERAGAVASEVAAYTYHLNILARNIQDSGDNFTRFLVIAKRDLKPTGSDKTSILFGVKDEPGALYKALEVFYKHGINLTKIESRPSKKKAWDYVFFVDLEGHKEEERVEKALKELKEKTQFLKVLGSYPKALLQE

SEQ ID NO: 70879 - protein, 456 aa, Vitis vinifera
MVKICCIGAGYVGGPTMAVIALKCPSIEVAVVDISISRITAWNSDQLPIYEPGLEEVVKQCRGRNLFFSTNVEKHISEADIIFVSVNTPTKTRGLGAGKAADLTYWESAARMIADVSKSNKIVVEKSTVPVKTAEAIEKILSHNSKGISYQILSNPEFLAEGTAIQDLLNPDRVLIGGRETPGGQKAIKALKDVYAHWVPEDRIISTNLWSAELSKLAANAFLAQRISSVNAMSALCEATGADVSEVSHAIGKDSRIGPKFLNASVGFGGSCFQKDILNLIYICECNGLPEVANYWKQVIKVNDYQKNRFVNRVVASMFNTVSGKKIAILGFAFKKDTGDTRETPAIDVCKGLLGDKASLSIYDPQPMSPTSVKQVNVVWDPYEATRDAHGICILTEWDEFKTLDYQRIFNNMQKPAFVFDGRNIVNIEKLREIGFIVYSIGKPLDPWLKDMPAIA

SEQ ID NO: 70880 - protein, 470 aa, Bradyrhizobium sp. ORS278
MTGRIIPLIMCGGAGTRLWPASREVRPKQFLPLFGARSTFQDTLLRVSDADLFARPIIITNAAYRFMVLEQLAEIGIEADVLLEPMRRDSGPAIAAGAAFAQSRDSEAVVLALAADHVVRDTAAFLAACRAGLAAAEAGRIVTFGVNPERAATEYGYISPGAPVSGEVRAVARFVEKPDRPTAESYIREGYLWNSGNFMFRASVLLDEYRKYDTPSVQTVSDAVAKAGRDLSFIILDSDAFAAAKPISIDYAVMEKTERAAVAPVSCGWSDVGSWHAVWELSDKDGQGNAARGTAVFEDSRNCNVVTDKALVALEGVDDLVVVAAQDAVLVSRQRDANGLKRLVAKLKTVAPEVTEAHIKVHRPWGSYQSVDNGERHQVKRIVVKPGQRLSLQKHYHRSEHWIVVRGAARVTVNETVKTVHENESIYIPMGAVHRLENPGKILLELIEVQTGSYLGEDDIIRIEDDYRRE

SEQ ID NO: 70881 - protein, 161 aa, Glycine max
  misc_feature (71)..(71): Xaa can be any naturally occurring amino acid
MASACLKLRNLSRGGGAFRCGRYSKLIHAEREREEEEEEVPSSRISRPLSEILKELNKKVPDSLVKTRLQXIKMPPPSDSFPEWSGEVRNITYSADAKSVSVVYRVTLYGTDAEIFRESTGTASVEDTSYGDPVQKAEAMAFRRACARFGLGLHLYHEDAS

SEQ ID NO: 70882 - protein, 595 aa, Coprinopsis cinerea okayama7#130
MDPKYEKDSKEVESSSVSSQPQARRVEFYDPSKESKWTRIGLTLESFKRAPGTTGGQVVNGANNVEDLEKIMADAPMLQQKMKPRHLQMIAVGGSIGTGLFVGSGAALYDGGPAALLICWLLIGIMLINVTQALGEMAILYPVSGGFYTLAIRFLDPSFAFAMGWNYVFQWAVVLPLEITVAARTIQYWPETLKVPLAVWITIFWAVIVIFAVFGTIGFAEEEFWSSCLKLLVVVVFVIIGIVCICGGGPSDGEYSSYVGGKHWSDPGGFANGFKGVCAVFVTAAFSFAGTELVGLAASETPNPRKTMPTAVKGTFWRITVIYITSLTIIGLLIPYNEERLVTGEGAAASPFVIALDNAKIPGFNHLVNVTICISVLSIGLSCVYAGSRTLTALAETGYAPKIFTYVDKSSRPLWSLIAILVWAPLAYINVRDVGDAVFRWLLALSGLSTLFTWMAICLCHIRFRRAWKVQGHSTDELPYRALGGVYGSWFGVILVILVLIAQFYVALFPLNYDPDRTPGDVAEGFFASYLALPVMIMFYIIGYAWKRTLPQRAHEINLDSGRKSWLTAEEMNAWRAERRAAPLHIRIFRALFTH

SEQ ID NO: 70883 - protein, 338 aa, Bradyrhizobium sp. ORS278
MANEPILVTGAAGFIGFHLTQQLLAEGRQVVGLDNINSYYDPTLKEARLALLQAQPGFSFHKLDLVDRAAIKALFAAHRFPAVVHLAAQAGVRYSLENPHAYVDANLEGFINVLEGCRHHGCGHLLFASSSSVYGANTKLPFSVKDNVDHPISLYAASKKANELMAHSYSHLYRLPATGLRFFTVYGPWGRPDMAMFIFAKAILAGQPVRLFNHGQMRRDFTYVDDIVQAIVRLIGRPPQGNPDWNGNTPDPSSSRAPWRIYNIGNNHPEQLTDVITLLEKEFGRPAIKEMLPMQPGDVEATYADVSDLERDIGFRPATSIVDGIARFARWYRDYHRI

SEQ ID NO: 70884 - protein, 401 aa, Bifidobacterium longum DJO10A
MAQWQTLSDRINTVAPSATLAVDSKAKAMKAAGLDVVGFGAGEPNFPTPANVVKAAADACLDPKNYKYTPTPGLPELREAIAAKMLRDSGYEVNADQVVVTNGGKQAVYESFQILLNDGDEVIIPAPYWTSYPEAVKLAGGVPVEVFAGADMNFEPSLEALEAARTEHTKAIIVNSPNNPTGAVWKPETVEAIGRWAVEHHIWVISDEIYEHLNYDDAHTTYIGAAVPECRGQLLVLNGVAKTYAMPGWRVGWMVAPLEVAKAAAKLQGHMTSNVANISQRAALAAVAGPLDEVHEMRKAFDARRRAIVTALNDIEGVNCPTPTGAFYAFADITALLGKPLGPKGTVSDTSADFAAALLDEAHVAAVPGEAFGAPGYLRFSYALADEDLAEGMRRFKEWAN

SEQ ID NO: 70885 - protein, 599 aa, Thanatephorus cucumeris
MARSTTSLFALSLVASAFARVVDYGFDVANGAVAPDGVTRNAVLVNGRFPGPLITANKGDTLKITVRNKLSDPTMRRSTTIHWHGLLQHRTAEEDGPAFVTQCPIPPQESYTYTMPLGEQTGTYWYHSHLSSQYVDGLRGPIVIYDPHDPYRNYYDVDDERTVFTLADWYHTPSEAIIATHDVLKTIPDSGTINGKGKYDPASANTNNTTLENLYTLKVKRGKRYRLRIINASAIASFRFGVQGHKCTIIEADGVLTKPIEVDAFDILAGQRYSCILKADQDPDSYWINAPITNVLNTNVQALLVYEDDKRPTHYPWKPFLTWKISNEIIQYWQHKHGSHGHKGKGHHHKVRAIGGVSGLSSRVKSRASDLSKKAVELAAALVAGEAELDKRQNEDNSTIVLDETKLIALVQPGAPGGSRPADVVVPLDFGLNFANGLWTINNVSYSPPDVPTLLKILTDKDKVDASDFTADEHTYILPKNQVVELHIKGQALGIVHPLHLHGHAFDVVQFGDNAPNYVNPPRRDVVGVTDAGVRIQFRTDNPGPWFLHCHIDWHLEEGFAMVFAEAPEDIKKGSQSVKPDGQWKKLCEKYEKLPEALQ

SEQ ID NO: 70886 - protein, 437 aa, Bradyrhizobium sp. ORS278
MPPKRPEYQFMSHGRKIAVIGLGYVGLPVAAAFARAGCPVIGFDIDAARVAELRDGRDRTCEVEAADLKRPGLRFTSDPADMAAADFFIVTVPTPIDSARRPDLSAMRSATRTVRAVLKRGDIVVYESTVYPGAVEEDCVPLLESGSELKAGLDFNVGYSPERINPGDKTHRFETITKVVSAQNPQTLQIVAEVYGSVVKAGIHRAPSIRVAEAAKVIENTQRDLNIAFMNELSLIFQALEIDTGDVLAAAATKWNFLPFTPGLVGGHCIGVDPYYLTYRAEKAGYHPEVILAGRRINDEMGRRIARECIRGLLKRKGRSGVVTILGMTFKENVPDIRNSRVIDIISELQSFGIDVQVADPLADAAAVHEEYGIALTAAEALRPADAVVLAVSHDQFLAGGWPLVQGLLREGSGLVLDVKMKLDRASKPGAIELWRP

SEQ ID NO: 70887 - protein, 403 aa, Geobacter sulfurreducens PCA
MKNIINFRMAAVLASCTLLSACADGDLPYSDSTSISSPAYSHSAVFQNMTTLAVWGNNESGQLGDGTTTSAATPKRLRLGFATYSSGFATGASHTLAIARFDNVSGVRAWGSNSAGQIGRDPATVPTSSTPVKIGGFGGAVQQVAAGGLHSMALAGGTVWAWGSNSAGQLALNPISSATRFAPRQVETAKLPIAPTAIVAGGSHSIAYTSTEAYAWGNNASGQLGNGTTLSNHMPQKVQLPSSITIRKISAGGSHNLALDSTGAIWAWGSNAYGQLGNGTTTNQSTPVQLTLPAGVTGFIDVFAGPSHSVAVASNFTVYTWGFNTLGLLSVGTTGDQLSPAQVRDASNVPFTDVERVVLLGSFFTIVKKNGSGGMWAWGYNGYGQLGDGTTSNRTAPVQVALP

SEQ ID NO: 70888 - protein, 388 aa, Citrobacter koseri
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENAEDIYAGIEWKADSADAEKVIKFLREEMGVKKIRFPEHCGIGIKPCSEEGTKRLVRAAIEYAIANDRDSVTLVHKGNIMKFTEGAFKDWGYQLARDEFGGELIDGGPWVKIKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 70889 - protein, 450 aa, Rhodococcus sp. RHA1
MSTSPDTAAQNITSPLTVGDIDAAIERISHVIDATPLQRSERLSSLTGANVYLKREDLQVVRSYKLRGAYNLMAQLDAGERAAGVVTASAGNHAQGVAFACRTMEITGRIYVPSNTPKQKRDRIRAHGGEFVELILTGETYDAAAAAASADVRRTGATMVAPFDDARTAAGQGTIAAEILAQLGAAPDTVLVPVGGGGCIAGIATYLRAHAPRTAIVGVEPTGAASMTAALVAGGPVTLTEIDPFVDGASVKRVGDLPYAVVSALGAEVVTHTSLGQSDRSTTIRLDPESFVMANLDEGALCTTMLELYQNEGIIAEPAGALSVAALGNITFEPGSTVVCLISGGNNDVSRYGEILERSLVNLGLKHYFLVDFPQEPGALRRFLDEVLGPEDDITLFEYVKRNNRETGAALVGIELGKAEGLGELLERMEQSRMQVERLEPGSPAYRYLT

SEQ ID NO: 70890 - protein, 251 aa, Nicotiana tabacum
MPINQIAVGSHEELRQPGTLKAALAEFICTLIFVFAGQGSGMAFNKLSVDGTATPSGLISASIAHAFGLFVAVSVGANISGGHVNPAVTFGAFVGGNITLFRGILYIIAQLLGSTVACFLLEFATGGMSTGAFALSAGVSVWNAFVFEIVMTFGLVYTVYATAIDPKKGDLGVIAPIAIGFIVGANILAGGAFTGASMNPAVSFGPALVSWTWTHQWVYWAGPLVGGGIAGVVYELIFINHSHEPLPSGDF

SEQ ID NO: 70891 - protein, 548 aa, Thermoplasma volcanium GSS1
MYEEEIKKIALLNAYQHNGKAELKSVIGKVMAEIADLRKNPKLVSELAKAAVDSVNSMSKDDIVNIVEKQFPEALKKDKKPEEHRLPDLQGVNGHVVMRLAPSPSGPLHIGHTRMAILNDEYVKRYGGDLILRIEDTNPTNIDPEAYAMIPEDLEWLGVNVTKTVIQSERFDLYYSVAKKLIENGHLYICTCDREEFKRKKLASIPCKDRDNPPETNLYLFEKMLDGEIKAGAAVAVMKTDLNHPNPSVRDWIAFRIIDAKHPRTGDKYRVFPMMSFSVAVDDHYLGLTHVLRGKDQLTNTEKQRYVFEYNGWNKPYYYHYGMIRFPGTRLKTSLMKKGIQAGQYDGWSDVRLGTVRAMARRGYQPETFRRYWINSGLREIDAVFSWEIFNSLNREFVDPKAYRFSFTKDPVEIKMEGSNGLTARLPYHPSHPEYGVRKYEIGDTVYISKGDADKIADGERFRLKDLCYVVRKGDRFLFDGTEMKEKTKIINWCPPNSREFQVLKPDGSIDKGLIEPASKGYRGISQLERYGYVNFYDSDEKAYFTHD

SEQ ID NO: 70892 - protein, 202 aa, Thermoplasma volcanium GSS1
MIMKIYVVDNGGQWTHREWRVLRELGVETEIVPNDIESRKLDGLDGLVLSGGAPNIDEEMDKLGSIGEYIEDHDYPVFGICVGAQFIALHYGAQVVKAKHPEFGKTLVKISEPANVLAGLPENIIAWENHNDEIKNLTSDFVLTASSETCEVQAFYHKHKPLYAVQFHPEVEHTQFGREIFKNFIAICQQHKEKLINNVNNK

SEQ ID NO: 70893 - protein, 208 aa, Brassica napus
RPTRPKRSAEEGATEKSSEESADKKMDESESKTEDNPAEDKENTDQAQGQGTEGEDDDDESSDSPAKNGEKEEKGGALATHKDNKDVVLREDLKAVFGKFGEVKFVDFKMGSETGYLRFDEPEASQKARAAAVLAKEGGLAVKNFIAVLEPLTGEAEKEYWGLLRSKDRFDKGGRGGRGGKRGGGRFGRKRGSDSPGGRWNKSQKVEA

SEQ ID NO: 70894 - protein, 312 aa, Mannheimia succiniciproducens MBEL55E
MKNLTLIGECMIELNGEPFGVMRQTYGGDTLNTATYAARVASPEKLNVGYVSALGTDKLSQGMIERWQADGINTDLVLRDEKRSAGLYLIQLDKQGERTFLYWRNQSAARYLLQHPDYNRVLSALKNTDMIYLSGISLAILPENDRTLLIEQLGELKKSGLEIAFDSNFRPALWDSREQAQNCYKALLPLVDVALVTFDDEAMLWADNDEQATITRLSSFNIPKIIVKQGRLGATVCEKGKQTFVPTIPVEHVVDTTSAGDSFNAGFLVGYLQGKPLNECCKQGNQLAGIVIQHQGAIIEKSATEHLRNAFA

SEQ ID NO: 70895 - protein, 116 aa, Coccidioides immitis RS
MGKLTSTIGIPIKLLNEAQGHVVTLEITSGQVYRGKLLEAEDNMNVQLKDITVTARDGRVSHLDQVYIRGSHVRFFIVPDMLRNAPMFRTRGQRGRGVGLARGRATVNRARGQRRG

SEQ ID NO: 70896 - protein, 153 aa, Physcomitrella patens subsp. patens
MEHEDSRTTTVVFQQLQPYTDEISDWSKVVIAYEPVWAIGTNKVATTEQAQEVHPAIHSWCYYWIHAPLNQIAAISMRKGSILLQRWRGKGDGGRRQGGHLSGIAQGEAIGGERRGGIRGSGEVETCRRRPSTPSASATPWTGTVHRQVLNFK

SEQ ID NO: 70897 - protein, 156 aa, Aquifex aeolicus VF5
MELRIGFGFDSHEFVEGKLLILGGVEIEKDYGLKGHSDGDALLHAITDAILGALGERDIGEIFKDTDPRWKNAPSRIFLEKALEVMSEKGFNISNIDCVIVADRPKIAPHKERIKESLSKLLGIPKERISLKGKRREGFCEGNGLVCMCTVLLVKM

SEQ ID NO: 70898 - protein, 481 aa, Ralstonia eutropha JMP134
MNVFLNHIDGEWTACQSGRTFDNVNPADTGDIVGRFQASSAVDAQAAVAAAAAAFAGWKKTPVGKRAAVLNRAADHLEANADSIAAELTREEGKALTLARDEVLRSAQTLRFYAVEGQTFTGEVFPNDDPDQLVFSQREPLGVVTVIAPWNFPVSIPARKIAPALVTGNTVVFKPSSEAPLSGYRLAEALIKAGLPKGVLNFITGSAAEIGAAITEAPVVRAISFTGSSRAGEQIHRAVPLTTRTQMELGGKNPLIVMEDADLDRAVDLTIKGGFSLSGQACTGTSRVLVAESVKAAYTERLLAKVATLKVGSGMTAGMDLGPLASQKQMETVLRYIDIGKSEATLLCGGERLTGGEFDKGYYVAPTVFTDVTQQMRIAREEIFGPVIAILGFTDYADAIAKANDTEYGLAAAIVTSNPRYIHHFANDIEAGTVKINRTTTGNLVNAPFGGLKRSSTSTFRESGRTGLEFYTQIKTVYRGA

SEQ ID NO: 70899 - protein, 572 aa, Thanatephorus cucumeris
MARTTFLVSVSLFVSAVLARTVEYNLKISNGKIAPDGVERDATLVNGGYPGPLIFANKGDTLKVKVQNKLTNPDMYRTTSIHWHGLLQHRNADDDGPAFVTQCPIVPQASYTYTMPLGDQTGTYWYHSHLSSQYVDGLRGPLVIYDPKDPHRRLYDIDDEKTVLIIGDWYHTSSKAILATGNITLQQPDSATINGKGRFDPDNTPANPNTLYTLKVKRGKRYRLRVINSSAIASFRMSIQGHKMTVIAADGVSTKPYQVDSFDILAGQRIDAVVEANQEPDTYWINAPLTNVANKTAQALLIYEDDRRPYHPPKGPYRKWSVSEAIIKYWKHKHGRGLLSGHGGLKARMMEGSLHLHGRRDIVKRQNETTTVVMDETKLVPLEHPGAACGSKPADLVIDLTFGVNFTTGHWMINGIPHKSPDMPTLLKILTDTDGVTESDFTQPEHTIILPKNKCVEFNIKGNSGLGIVHPIHLHGHTFDVVQFGNNPPNYVNPPRRDVVGATDEGVRFQFKTDNPGPWFLHCHIDWHLEEGFAMVFAEAPEAIKGGPKSVPVDRQWKDLCRKYGSLPAGFL

SEQ ID NO: 70900 - protein, 531 aa, Thanatephorus cucumeris
MLSSITLLPLLAAVSTPAFAAVRNYKFDIKNVNVAPDGFQRPIVSVNGLVPGTLITANKGDTLRINVTNQLTDPSMRRATTIHWHGLFQATTADEDGPAFVTQCPIAQNLSYTYEIPLHGQTGTMWYHAHLASQYVDGLRGPLVIYDPNDPHKSRYDVDDASTVVMLEDWYHTPAPVLEKQMFSTNNTALLSPVPDSGLINGKGRYVGGPAVPRSVINVKRGKRYRLRVINASAIGSFTFSIEGHRLTVIEADGIPHQPLPVDSFQIYAGQRYSVIVEANQTAANYWIRAPMTVAGAGTNANLDPTNVFAVLHYEGAPNAEPTTEQGSAIGTALVEENLHALINPGAPGGSAPADVSLNLAIGRSTVDGILRFTFNNIKYEAPSLPTLLKILANNASNDADFTPNEHTIVLPHNKVIGAQHHRGADHPIHLHGHVFDIVKSLGGTPNYVNPPRRDVVRVGGTGVVLRFKADNPGPWFVHCHIDCTWRLGSHLSLPRPPARFARVSSRSSPTMPGTSSAPSTRLFLPICSKW

SEQ ID NO: 70901 - protein, 482 aa, Clostridium perfringens SM101
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTVTGRGNEIGDYCVTHDKIDFINFTGSTEVGIRISEITVMKPLLMELGGKDAAIVLEDADLDLTVNNIIAGGYSYSGQRCTAVKRILVMNSVADKLVEKLKEKISKLKMGNPLKVEDVTIVPLIDNKAADFVMELIDDAKEKGATLVCGGYREGNLIEATLFDNVTTDMRLAWEEPFGPVLPIIRVNDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 70902 - protein, 308 aa, Novosphingobium aromaticivorans DSM 12444
MTLNPQVEALLGFFAQMPPVDYATITPEALREMNKPMQMGPPPAVAEVRDLTMDLPGRSIAARLYLPEGPGETPPLVLFYHGGGWVIGSIESHDATARAIAAASGAAVLSVEYRLAPETKFPGPLDDCYDALVWAAGHAAELGIDAARLAVAGDSAGGNLAAAVAIRARDEGGPKLAHQLLIYPVTDADFANGSYTENAEGYFLTTQMMQWFWTQYVDDHGDPHPHAAVLRHDNLAGLPPATVLVAQYDPLRDEGLAYAEALKAAGVPVETELAPGMIHGFFSMFEAVPDAMPYVERAGARLKAAFAA

SEQ ID NO: 70903 - protein, 116 aa, Triticum aestivum
EKEAFEKQMLEKLIWISAFMLVGARHPGATVGAVEKEHRSEVSSLIAELASAAAAERGLSFDEGMEERLCAYSRAVAHFPTAVKEFKWRNGWFYSLTEKALAEGKPDPCPLHTSWA

SEQ ID NO: 70904 - protein, 876 aa, Clostridium perfringens SM101
MEKKQYVYLFNEGNASMKNLLGGKGANLSEMTILGIPVPQGFTVTTEACNKYYEDDKKISQDIIEEIENKMSELEKITGKKFGSLENPLLVSVRSGARVSMPGMMDTILNLGLNDESVEAMAKLTNNPRFAYDSYRRFIQMFADVVMGVEKRLFEDLLDEVKEEKGYKIDTDLTAEDLKDLVVKFKALYKKEKGEDFPSNPKEQLIEAVTAVFRSWNNPRAIVYRRLNDIPGEWGTAVNVQEMVFGNKGETSGTGVAFSRNPANGDNELYGEYLMNAQGEDVVAGIRTPEPISHLEAQNPEIYKQFTDIVNTLEKHYRDMQDMEFTIEDGKLYFLQTRNGKRTAQAALKIAVDLVEEGMLTKEEAILKVEPKQLDTLLHPAFASDGLKEAKIVAKGLPASPGAACGKIAFTAEEAKERKANGEKVVLVRLETSPEDIEGMIAAEGILTVRGGMTSHAAVVARGMGTCCVAGCGELKVNEEARTLEVNGQVLTFDDYISIDGSTGHIYAEQVKTVSPEITGHFATFMGWADEIRKLKVRTNADTPRDTKQAVEFGAEGIGLCRTEHMFFAEDRILAVREMILAKNEDSRRVALEKLLPMQREDFIGMYEALEERPATIRFLDPPLHEFLPNEEEDINALAKEIGVSPAEIKNVVAELHEFNPMMGHRGCRLAVSYPEIAEMQTRAVIEAAIEVKKNKGYNIVPEIMIPLIGEIKELKYVKNVVVETAKTVMEEKGIQLDYKVGTMIEIPRAALTADKIAEEAEFFSFGTNDLTQMTFGFSRDDAAKFLKDYYEKGIYEQDPFAKLDQEGVGELMRIACEKGKATRPDIKLGICGEHGGDPSSVEFCHNLGLNYVSCSPYRVPLARLAAAQAQVKNKR

SEQ ID NO: 70905 - protein, 297 aa, Triticum aestivum
MGKRAIRYAVVDAFAAEPFKGNPAAVCLLEEEGASAAMDDRWMQSVAAEFNLSETAFLARDSSGGAGAAPRFHLRWFTPVTEVDLCGHATLASAHFLFTTVLPEHGKLEFMTRSGILTAKKVPAPGSTGVPGEEQGKLFIELDFPMIGFLDCNQMPSIPETLNGAPIVSVHKSATDGDLIVELSSGKEVVNILPSIDEIKNLACRGLIVTGPAPAGSGYDFFTRFFCPKFGIDEDPVTGSIHCVLAPYWGRKLGKQKLTAFQASPRGGTLYLQLDDANQRVQIQGEALTVMDGTLLA

SEQ ID NO: 70906 - protein, 462 aa, Nocardia farcinica IFM 10152
MRIADHVVDLIGNTPLVRLNNVVGPNAGLVAAKIEYLNPGGSSKDRIAVKMIDAAEKSGQLKPGGTIVEPTSGNTGVGLALVAQQRGYKCVFVCPDKVSEDKRNVLRAYGAEVVVCPTAVPPDHPDSYYSVSDRLVREIDGAWKPDQYSNPGGPESHYETTGPEIWRDTDGRVTHFVAGVGTGGTITGAGRYLKEVSGGKVRVIGADPEGSVYSGGSGRPYLVEGVGEDFWPSAYDPAVPDEIIAVSDADSFEMTRRLAREEGLLVGGSCGMAVVAAIEVARRDPDAVVVVLLPDGGRGYLSKIFNDQWMSSYGFLRTRLDGSPEPLVGDVLRGKSGELPDLVHTHPSETLRDAIEILREYGVSQMPVVGAEPPVMAGEVQGSVTERDLLSAVFEGRAHLTDSVAQHMSPSFPLIGSGEPISAATKALSDTDALMVVEDGKPVGVITRHDLLGFLSTGSVGH

SEQ ID NO: 70907 - protein, 501 aa, Novosphingobium aromaticivorans DSM 12444
MGASLNAMPRQKPRQDFRGLWNISFGYFGIQLAFALQNANVSRIFQSLGSAVDDLAFLWIAGPVTGLIVQPLIGYYSDRTWGRLGRRRPYFLAGAVLAGLALVGLPNTGLLLLAAAFLWMLDASLNVAMEPFRAFAGDMTPDDQRAQAFAFQTWFIGAGAVVGSLAPALFNWLGIANTAPEGIIPPSVRYSFYLGAAAMVLAVGWTVLRVREYSPDEMAAFEADATAPIAPEHEPLVYPRSGPAWVAVGAVLVAIVAALGLDRQLYVLGTGLAVFGAIQIGVRATAARGALAHIVSDLAQMPAQMKQLALAQFFTWIGFFIVWIYTTPVVTEQAFGATDVSSAAYNEGADWVGVMFAFYNGIAAVSAFLLPVLARRIGNARTHAVGLLCGASGFLGLLLIRDPWWLLLPMVGMGIAWASVLSMPYVILTRVLPARKFGIYIGIFNFFIVIPQLVVATLMGGIMRSFFPGEPRWTMLVAALMMAAAAGAMMLVREHRRDSAA

SEQ ID NO: 70908 - protein, 209 aa, Bacillus anthracis str. Ames
MKTSKWIDISQPLNNDIATWPGDTPFSYEVLWSKEESGSVNVGKLTMSIHTGTHIDAPFHFDNDGKKVLDLDIQVYVGPTRIIDVSNLESIGKKELEKFHLEGVERLLLRTSSHGKANEFPDIIPHLRADIAPFLSEKGIRLIGVDVPSVDPLDDKELAAHHQLFKHSIHILENVVLDHVADGDYELIALPLALSDADGSPVRAVIRPI

SEQ ID NO: 70909 - protein, 578 aa, Gloeobacter violaceus PCC 7421
MKLHSALLLASLLVLSCAATAAALPGGDRGGTYFSTRSPVIAKNGMAATSHPLATQIAVDVLKKGGSAVDAAIAANAALGLMEPTGNGIGGDLFAIVWDPRARKLAGLNASGRSPLGLDYERLKSAVGGSPTIPIFGPLPVTVPGAVDGWFMLHGRYGRLPIAELLAPAVRYAREGVPVPQMIAGYWQSNLRRFERDKDQIPELANFRKTYLIAGNPPAEGEIFRNPDLALTLEKIGKGGRDVFYKGEIADTIDAYMQRVGGYLRRTDFERHTGTWVEPVRVNYRGYDVYELPPNGQGIAALQMLNILEGFDLKKMGHNSADYLHAQVEAKKLAFADRARYYADPDFSKMPVAGLLDKTYASDRRRLIAMDRAQSRQAAGLPPAADTIYLTTADKDGMMVSLIQSNYVGMGSGLVPDGLGFMLQDRGAQFSLTPGHPNVYAPGKRPFHTIIPAFVSKDGEPFMSFGVMGGDMQPQGHVQILCNIIDFGMDVQQAGDAARYYHTGDNDPDGRVMVDGGTLNLESGVGEDSRTELARRGHRLAATSPGAYGGYQVIQWDQVNRVYRGASEMRKDGQVSGF

SEQ ID NO: 70910 - protein, 591 aa, Cryphonectria parasitica
MPSFFRALFSGLIASQLSWAAPSLLHPLEPRQQPNCNTASNRACWISGSYDITTDYEVKTPLTGVVRQYDLTLTQAENWLGPDGVVKEDVMLVNGNILGPVIHAQWGDTISVTVTNNLKYNGTTIHWHGIRQLNTNLQDGVNGITECPIPPNGGSKTYTFIAHQYGTSWYHSHFSAQYGNGIVGAIQIDGPASLPYDIDLGPLVLSDYYYKTADELVVYTQSNAPPASDNVLFNGTNINPANTTQGQYKTITLTPGKRHRLRIINTSVENNFQVSIVGHSMTVIESDFVPVDSFTTDSLFVGIGQRYDVTIDASQATDNYWMNVTFGGGGFCGKSNNPYPAAIIHYNGASNSHPTNKGVAPADHECLDLLNLVPVVPRSIPTSGFVAASDNTLDVQLSTTTRKWTINGSTLDVDWGHPITQYVINKSTAWPSTDNVWLVEEANQWAYWLIENDPTATGNALPHPIHLHGHDFVVLGRSPNVSPTAQTPYTFTSSDVSSLNGNNPIRRDVVMLPPKGWLLIAFQTTNPGAWLMHCHIAWHVSAGLGNTFLEQPSAFVAGLNTNDVNQLNSQCKSWNAYYPSKDIFKQDDSGV

SEQ ID NO: 70911 - protein, 635 aa, Exiguobacterium sibiricum 255-15
MDMILLQVNQLSKSFGVEPILDNIKLEVQERDRIALVGRNGAGKSTLLKIIAGELSHDSGEIMKSKEVRIGYLAQDSGLESNESIWNEMLTVFEHLQDQERALRRMEIEMGMEHILNDPAAYDRLLKTYDQAQHDFSEAGGYQFEANIRSVLHGMRFYPDDYSRRIQTLSGGQRTRLALAKMLLQAPELLILDEPTNHLDIDTLSWLESYLSGYRGAVLIVSHDRYFLDQVVNVVYELSRNVSRKFTGNYTKYLEQKAALYEQEMKQFEQQQEDIAKMQDFIQRNIARATTTKRAQSVRKRLEKVDRIDRPDGDERSTVLSFPIEKQSGNDVLQVNQLAVGYEEAVSKNITFRLQRAESLALVGPNGIGKSTLLKVLVGRLKPLFGDYRFGTGVSIGYYDQEQAELNDRNRVIDEIWNEWPLMREQEVRSVLGQFLFSGDDVFKLVHELSGGERGRLALAKLKLRKTNLLVLDEPTNHLDLDSKMVLENALVDYEGTLLFVSHDRYFIDRVATRVIEMSSDGVTDYLGDYSYYMEKKAEKEEIARLEAEEAKAIKVASTKTIDKEAQKEARKKKQQLEQLEQEIERLENRSVEIEQLLCEPEVFNDIPKATALSAERDQIDVDLLELMEQWESFH

SEQ ID NO: 70912 - protein, 205 aa, Triticum aestivum
  misc_feature (200)..(201): Xaa can be any naturally occurring amino acid
MVQLFLQVPADDGSVDTDAVRARRSLLDKAESVIKSVVRSGGRYEARMWLCSTVSSIHLLDPRDQRDLFLHLLEMKDLRRDVAARLLRMIFDKKPAKAGSVLAKKCHMLEKFFEGNPERILQWFCHFAATGESAHKKGARALAQFAFVNRDVCWEELEWKGRHGQSPAVVATKPHYFRDLDVLQTVENFLEYVPDFWSSXXLADS

SEQ ID NO: 70913 - protein, 229 aa, Zea mays
  misc_feature (16)..(16): Xaa can be any naturally occurring amino acid
  misc_feature (24)..(24): Xaa can be any naturally occurring amino acid
SSEYYEASARFAKWRXVLKIGERXPSELSMRENAYGLARYAVICQENGLVPIVEPEILVDGSHDIHKCAAVTERVLAACYKAISVPHVFLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 70914 - protein, 318 aa, Streptococcus agalactiae 2603V/R
MGLLVDGKWVDQWYDTASTGGKFVRTVTQFRHWVTKDGSAGPSGDAGFKAESGRYHLYVSLACPWASRVLIMRKLKNLESHISISIVNPLMLENGWTFQEYKGVIPDMINQSQYLYQIYQASQSDYTGRVTVPVLWDKKFHTIVNNESSEIMRMLNTAFNHITGNTDDYYPDSLQGQIDEMNNFIYPKINNGVYKAGFATSQNVYQKEVETLFTALDQLEKHLSDNHYLVGEQFTEADIRLFTTLVRFDTVYYGHFKCNLKALHDYPHLWHYTKRIYNLPGIAETVNFDHIKKHYYGSHKTINPTGIIPAGPNLDWTI

SEQ ID NO: 70915 - protein, 230 aa, Mycobacterium sp. JLS
MSRATLDKNPHEVASMFDAVARRYDLTNTVLSLGQDRFWRRETCAALGIGPGDKVLDLAAGTAVSTVELAASGAWCVAADFSVGMLSAGRQRDVPKVAGDATRLPFADESFDAVTISFGLRNVVDHVAGLEEMARVTRPGGRLVVCEFSTPTNRAFATLYKEYLMKALPRMARAVASNPDAYVYLAESIRAWPDQAGLARRIEAAGWSQVRWRNLTGGIVALHAAVKPPR

SEQ ID NO: 70916 - protein, 512 aa, Zea mays
MAAPGRAALLAAALLFGTFFPSACSASSYPARIAGRLLSTTASAVAKQLWSLKSAATKTATTAVTGRSMVRYEGGYAVDTVFDGSKLGIEPHAVEITPAGNLLVLDSINSNIYRVQLPLSPYSRPKLLAGSPKGLSGHVDGRLREARMNHPKGFTVDDRGNIYVADGMNMAIRKISDTGVTTIAGGKSIRGGHIDGPSDDAKFSTDCEIKYISSSCSLLVIDRGNQAIREIPLNDDDCAYQYEAAFPLGFALLCAAGFFGYMLAMLQRRLLGMSSTTDIIVKDPQAPPRPSIASIPPSYQKPLNPYIRHPFIPREETAKQETGEGFFTTAGKLMGGAKSSVGEIFGFKKKRLSSPYHHQQQQQRRANPWPVQESYAMTHDEPPPALDTRAPTPQKNYSLMRKEPEKTHYVRHGHPYFNSWDGHCHPQQQPDQQLYRQQQHLQQHRQYFAGPQTFYEQSCEPTKEIVFGAVQEVDSKRRMVEIKAVNYGDPFYERYGMRYRNNFIGYNNNNNY

SEQ ID NO: 70917 - protein, 428 aa, Geobacter sulfurreducens PCA
MSEITDVYAREILDSRGNPTLEVEVFLESGVMGRAAVPSGASTGEREALELRDGDASRYLGKGVLKAVDNVNDIIAEQLIGMEATDQVGIDRRMLELDGTEYKSTLGANAILGVSLAVAKAAAEEVGLPLYQYIGGCNARELPLPMMNILNGGAHADNNVDIQEFMIMPAGARSFSEALRMGAEVFHALKSVLKGKGYNTAVGDEGGFAPNLKSNEEALEVIMEAIAKAGYKAGEDILLALDVASSELFKDGKYFLENEAKPEKTADELIDFYENLVNKYPIISIEDGMAENDWEGWKKITDRLGKRVQLVGDDLFVTNTKILKEGISKGVANSILIKLNQIGTLTETLDAIETAKRAGYTTVISHRSGETEDTTLADLAVAVNAGQIKTGSLCRTDRVAKYNQLLRIEDELDVTAQFRGKDVFYNLR

SEQ ID NO: 70918 - protein, 204 aa, Triticum aestivum
  misc_feature (191)..(191): Xaa can be any naturally occurring amino acid
  misc_feature (195)..(195): Xaa can be any naturally occurring amino acid
MDAKAEASGDDAVPEAPEQSVVLISAGANHSVALLSGQMVCSWGRGEDGQLGHGDSEDRPVPTVLTSFDVPRITSVVCGADHTAAYSDDEMQLYSWGWGDFGRLGHGNSSDVFNPQPVVALQGMKIKQIACGDSHCLAVTVTGQVHSWGRNQNGQLGLGNNEDSLLPQKIKAFQGVCVKMIAAGAEHTTAXTEDXHLYGWGWVT

SEQ ID NO: 70919 - protein, 272 aa, Pseudoalteromonas tunicata D2
MSQTNIAFIGTGNMSYAIIGGMIKNGFNASQIIATNRNQTKLDKVASDFGVQTQTDNLIALAQADIIVLSVKPQMMAELCQTFANSGIDYSNKVFVSVAAGITVKRLREMLRSDVKLIRCMPNTPSLLGKGVSGLFSAGTSDAENSTVTEIFSSTGIVMWLEQESQINDIIAVTGSSPAYFFLFMEAIESKAKALGFTPEQARLLVQQTAMGAAQMVESQSIEISELRNNVTSKGGTTAQAIAHFQQHNLTQTVADAMDACIARAEQMETEL

SEQ ID NO: 70920 - protein, 244 aa, Pseudoalteromonas tunicata D2
MTKTPQLSDNYMVTIAERLNSAYARIAQAEKNHQKPAKSVSLLAVSKTKPAQLIIDAYHAGHRKFGESYVQEAVEKIQQIPFNDIEWHFIGPIQSNKTKAIAEHFSWVQSIERPKIAERLNQQRPTNLPPLNVLIQVNISGEQSKSGCNLADVAALSAHISQSKQLVLRGLMAIPAPSDDQAQLIASFSQLKTCFDTLKAQYPSIDTLSMGMSADVEAAIAAGSTMVRIGTDIFGAREYPVEQH

SEQ ID NO: 70921 - protein, 284 aa, Chenopodium rubrum
PSSSSLCISGTSPLKSITDLNPRVIILSGGPHSVHAPDAPVFCDGFVDYVEKNGVHVLGICYGLQLIVQKLGGLVKVGDRQEYGKMNIEVISENSGFFGNRIKGDKQDVWMSHGDEVSKLPDGFKVVAVSQQGAVAAIENPSRKFYGLQYHPEVTHSPQGMKTLRYFLFDVCGISADWNMEDVLNEEIKVIKETVGPDDHVICALSGGVDSTVAATLVHKAIGDRLHCIFVDNGLLRYKERERVMDTFEEHLHLPVTCVDASEQFLSKLKGVADPEIQREEEEG

SEQ ID NO: 70922 - protein, 175 aa, Burkholderia mallei ATCC 23344
MSFSNVPAGKDLPQDFNVIIEIPAQSEPVKYEADKELGLLVVDRFIGTGMRYPVNYGFIPQTLSGDGDPVDVLVITPFPLLAGSVVRARALGMLKMTDESGVDAKLVAVPHDKVCPMTANLKSIDDVPAYLKDQIKHFFEQYKALEKGKWVKVEGWDGIDAAHKEITDGVANFKK

SEQ ID NO: 70923 - protein, 363 aa, Mannheimia succiniciproducens MBEL55E
MGFKCGIVGLPNVGKSTLFNALTKAGIEAANYPFCTIEPNTGVVPMPDPRLDALAEIVKPERTLPTTMEFVDIAGLVAGASKGEGLGNKFLANIRETDAIGHVVRCFENDDIVHVSGQINPADDIDTINTELALADLDSCERAIQRLQKRAKGGDKEAKFELSVMEKLLPVLENAGMIRSVDLDKEELQAIKGYNFLTLKPTMYIANVNEDGFENNPYLDRVREIAEKEGAVVVPVCAAIESEIAELDDEEKVEFLQDLGIEEPGLNRVIRAGYKLLNLQTYFTAGVKEVRAWTVAVGATAPKAAAVIHTDFEKGFIRAEVIGYDDFIQYKGEQGAKDAGKWRLEGKDYIVQDGDVMHFRFNV

SEQ ID NO: 70924 - protein, 222 aa, Aquifex aeolicus VF5
MKLLAPSILAGDWWCIGEQIQATIRGGADILHYDVMDGHFVPNITAGYEILSHIRKRASLPIDAHLMIENPDKYIPKFVEAGANWISVHIENNYHIHRTLQLIKELGAKAGVVVNPGTSLSAIEEALYYADYVLLMSVNPGFSGQKFIERSIERLRILKEMRDRINPSCLIEIDGGIKENNIAEVVRAGADVVVVGSGIFGAKDIEAQTRKLKSLMLSAVSV

SEQ ID NO: 70925 - protein, 473 aa, Novosphingobium aromaticivorans DSM 12444
MARAATAAGNGLPLLDGGVPLLGHLAQFFRDPVSVLKRGYRSKGRLFAMNFMGQRMNVMLGPEHNRFFFEETDKLLSIRESMPFFLKMFSPEFYSFAEMDEYLRQRSIIMPRFKAASMKQYVPVMVEESLNLVERLGEEGEFDLIPTLGPVVMDIAAHSFMGREFHEKLGHEFFELFRDFSGGMEFVLPLWLPTPKMVKSQRAKRKLHAILQSWIDKRRAAPLDPPDFFQTMIETKYPDGRPVPDEIIRHLILLLVWAGHETTAGQVSWALADLLQNPDYQKVLRGEISSLLGGSDGRDLGWEQAVAMEKMDLALRETERLHPVAYMLSRKARADIERDGYVIRKGEFVLLAPSVSHRMEETFRNPDAYDPERFNPANPDAQIESNSLIGFGGGVHRCAGVNFARMEMKVLVAILLQNFDMELMDEVRPIAGASTYWPAQPCRVRYRRRKLDGSEAGADMAALARAAGCPAHT

SEQ ID NO: 70926 - protein, 482 aa, Novosphingobium aromaticivorans DSM 12444
MIESSCSALLLFGATGDLSRRMLLPSLYALHEDGLIRPDLRIVGTARSEHDDAEFREFAREALAEFLPEDRRDEEKLASFLERLEYQTLDASNVDGFGELARKLGDTSCGLSIFLSTAPFLFEPTIEGLRRAGLAHENVRIGLEKPLGNDLASSTRINDAVAAAFAEEQIFRIDHYLGKETVQNLMALRFANMMFEPLWNAGGIDHVQITVSETVGLEGRKGFYDDTGALRDMVQNHMLQLLALTAMEPPASLDATSIRDEKVKVLRALRPVKAEEMVRGQYRAGAVKGTSVTGYQEDLGEVSDTETFVAIKAHVDNWRWTGVPFYLRTGKRLGERRSEIVVEFKPVPHNLFAERGGRLRPNRLVIRLQPEEYVRLQVMAKEPGLDRGGIVLRDVNLDLSLTAAFAKARRRIAYERLLLDLIEGEQTLFVRRDEVEAQWKWVDAIRKVWADTDMEAKPYAAGSWGPNAGIALTERDGRSWND

SEQ ID NO: 70927 - protein, 460 aa, Vitis vinifera
MVSERIQSKHVCVIGAGPSGLVAARELRKEGHSVVVMEQNHDIGGQWLYEPKVEGEDALGKSTFLKVHSSVYDSLRLFSPREIMGFSDFPFVVKKGRDMRRFPGHRELLLYLQDFCEWFGLREMMRFKTRVEYVGMLDSDQVGRDLKWVVESRDMESEKVSEEVFDAVVVATGHYSKPRLPSIKGMDVWKRKQMHSHMYRVPEPFRHEVVVIVGNSHSGEDVSIGLVEVAKEIHLSFKSLDLSEGLSKFISKHHNLHLHLQIESLHEDGRVVFVDGSWVMADTIIYCTGYSYSFPFLDTKGIVVVDDNRVGPLYEHTFPPLLAPSLSFVGIPRKIIAFPFFESQAIWIAQLLSGKKTLPSFHDMMHSIEDFYRSREIAGIPKRYTHELADFEYCDKYGDNVGFPHLEEWRKGLCVSAVLKAMANLETFRDSGDEDELLQVALQSPHFTQFPQSPSQHFTT

SEQ ID NO: 70928 - protein, 637 aa, Vitis vinifera
MLSERKQSKYVCVIGAGPSGLVTTRELRKEGHCVVMMEQNHDVGGQWLYDPNVEGEDPLGRSKFLKVHSSIYASLRLASPREIVGFSDFPFVVKKGRDTRRFPGHRELLWYLEDFCEWFGLRETIRFNTKVEYVGMLDSDEVGGGLKWVVRSRDVKSEKVVEELFDAVVVATGQYSHPRLPSIKGMEAWKRKQMHSHIYRVPHPFHNEVVVVVGNAASGQDISIELVDVAKEIHLSAKSLDISEGLSRIISKHHNLHLHLQIESLHEDGRVVFVDGSWVVADTIIYCTGYSYSFPFLDTKGIVAVDDDRVGPLYEHTFPPSLAPSLSFVGIPRKILGFPFFESQAMWIAQLLSGRKTLPSFHDMMRSIEDFYQSRDAAGIPKHQTHDIADFEYFDKYGDNVGFPHTEEWRKKLLLSTVGNAQVNLETYRDSWYDHELLQIESLHEDGRVVFVDGSWVLADTIIYCTGYSYAFPFLDTKGIVAVDDDRVGPLYEHTFPPSLAPSLSFVGIPRKIIGFPFFESQAIWIAQLLSGRKTLPSFHEMMQSIEDFYQSRDAAGIPKHHTHDIADFEYRDKYLDNVGFPHLEEWRKELILSGIGNAQVNLETYRDAWDDHELLQVALQSPHFTQSLQSPSQHFP

SEQ ID NO: 70929 - protein, 598 aa, Coprinopsis cinerea okayama7#130
MGAPPGISYLLRKVPPLLFPGLLAYATTHYVKRFTGISLPGWAVFLCVVLAKPLQFLVSTRYRRYLNEKEAQKLGAKMAPHVQESGLAIVSKLLEMFDRGYPGDTLQEWASKHGNIYETRLPTEGFVSDQTLHELKRLPIIELGTSTAQIWTTEPEHVKAILATEFENFPKESLFIEQMVSLLGDGIFSVNGEKWKFHRAMTRPFFTRDRISDFDIFDTHASKALTLAKERLEAGYPVDFQDLVGRFTLDSASVFLFDEDLESLSAGLAYPFNCSKENASNHQYREHPSNLFADAFLDAITKGTRRTFWGQEWPLAEFWSDVVKPGREVIDRFAEKVINGRLKKGGGAEFEERDTLLEHLLNKTTDTRMIKDELFSMLVAGRDTTSCTLSYAMYNMTQHPEVVARLREEVMEYVGPTKRPTYDDIKGMKYIRAFINEVLRLYPPVPLNWRQPQKSTVFKTKDGPRYYIPAKTTVRYSVWAMHRRKDLWGPDADKFDPDRFLDERLKEYLIPNPFIFVPFNAGPRICLGQQFAYNEVSFFLIRLLQQFSEFELAQDAQDPQFAPPASWAQCEGTKGTDKVMPGANLTLYIKGGLWVRMK

SEQ ID NO: 70930 - protein, 404 aa, Listeria monocytogenes EGD-e
MGLVVLKFGGTSVSTVDKIGKTADQAIYEKKQGNKVIVVVSAMGKSTDKLVAMAEEISEAPDKREMDMLLSTGEQITIALLAMTLKEKGHDAISYTGWQAGIETEAVHSNARIADIDSARIESALDAGQIVVVAGFQGFTTDGEITTLGRGGSDTTAVAIASALNAEKCAICTDVVGVFTTDPRYVKKAQKLEQITYDEMLELANLGAGVLHPRSVEYAKNFRIPLEVRASHEQVPGTMIEEDLTMENTKVVRGIAFEDQITRVTIHWKQKEAMRVSKVFTKLAENNIDVDIIIQGITGLGHGNLSFTIKTSALLATLAVLEESKELLQIEKLESEQELAKVSIVGSGMVSNPGVAAQMFEALTENNIPIKMISTSEIKVSTVVPARKMVEAAQVLHDQFELDK

SEQ ID NO: 70931 - protein, 197 aa, Nicotiana tabacum
MSYWKDKVLPKIKKVFEKNGPKKAAAAEACEAFDVAKEQYSKEFDEKKTELQPKVVEIYEAAAAEIKTLVKEPKVAGLKKHSAGVQKFLDELVNIEFPGSKAVSEASSKFGPSYVSGPIIFVLEKVSTFVVTEDKKEEEAATAAAVETTGTVAEEVKEKDIVVEAGDEKKEEAEPATETTKVEEVPAAVATEPPKAA

SEQ ID NO: 70932 - protein, 255 aa, Penicillium marneffei
MDSLTTHPSNAQQAKAFTSPASLSFPGGAGDLTPPSSEKEGNLAGLNGQQQGANANGNGVTPATPAATPGANNVGSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFELIYPVLSDFRKT

SEQ ID NO: 70933 - protein, 469 aa, Shewanella violacea
MSAESVLQQLKELEVKFVDLRFTDTRGKEQHVSIPSHQVDEDFFEDGKMFDGSSINGWKGINESDMVLMPDPASFVLDPFTAETTANIRCDILNPGTMTGYNRDPRSIAKKAEEYLRSTGIADTVLLGPEPEFFLFDDVKYGADMSGCFYKVDAEEAAWNSGTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 70934 - protein, 241 aa, Rhodococcus sp. RHA1
MSRVGEIEAALGTVRARLDAACRDAGRDPADVSLLPVTKFFPESDARILYDLGCREFGESREQEATAKIAEFRTVVTDSSVRWHMIGHLQRNKAKAVAHWAYAIHSVDSERLVGALGRAATTALEAGERPEPLRVLLQVSLDGDPQRGGAAIADLERLAAQVQSSPGLEYRGLMAVPPIDADPDAAFEELQKIHARLRRDHPDATDLSAGMTNDLEHAVRHGSTCVRVGTALLGSRPITSK

SEQ ID NO: 70935 - protein, 216 aa, Physcomitrella patens subsp. patens
MAVNDEQGDVSPALDFVPPPKPQFGALSAHEMNGGKFEFRKVFVPTHRFTPLKEHWMEIYTPVFEQMKIDIRMNLKARKVELKTRRDTPDTGSIQKCADFVHAFILGFDIQDAIALLRLDDLYVESFEIKDVKTLKGEHLSRAIGRLSGKGGKTKFAIENSTRTRIVIADTRIHILGSFANIRVSRDALCSLILGSPAGKVYSKLRAVSSRLAEKF

SEQ ID NO: 70936 - protein, 896 aa, Debaryomyces hansenii CBS767
MLPPGSRRSKIRPPRKSLVSTSIGNSSGDSVIDYDLSWSVLSNAITQIQNKNVSKLSYEQLYRKAYILVLRKYGAKLYDDVSLLIRQHLLQKRQNLLAILNLSSSLNNSINEDFMKAVLVEWDEHLQSMKFISDVLMYLNRVYVKEHKKLLIYDLGIQLFKDNIVKYEDNELGSKLIEIVVEEITKNRKGEVITTKMYITKIINMLELLLETSNSGNDLQYGENYYQRYFEPTFLAGSETFFYNLSQEFINNVLGTKYLHDAHRFIKEEENRINFYLPSSTYPRIIDLMNNILIKDKIDRILCLPFEQQGLSYWLQPVLSNILDQNLSSNREKHHFAELKILYELLGRIDPDYELFRTRLKDLVVSQGSTLPSLVKESISLKDDSTSKKSNANSTAFASTWINSILEYQNQFSMIIKESFSGDVALEQCITMGMREFINGAQNAPGGSKKSNTSSGNSAPELLSIYMDFRIKQLTKNPGSSSKNIPTENDNDMNGSSIDQTDDLINKSVAFLRFIKDKDAFEAHYANHFAKRFLNFKNSQAGNSASNGKLGVDLEELIISKLGEEMGTTSLDKVIKMDKDIKLSRDLTKDWRSYVNQNHKKSLIELDLKVCNVSDWPKSMTKDYKKFSRDDTNNEIGFIWSRQLRSTIKEFEEFWFTNKRNDNKSLFWCPKFGSMDLRITYPTKTYDISMSTYAGIIMLLFAPQSTDADGNEVLAFDEMRELAYDEIRELTGIPEADLKRQLQSIAVAPRLRLLVKIPMTKEVNNSDVFKLNEKFKSPSTKVKVLTVSASSSASSGTKVSSTNDTTLAKTVQEEEFEELQSSILEGRKIEVNAAIVRIMKSRRTINHNDLISELVKQLHNRFQTLTILIKQRIEDLIEKEYLKRDDNDKSIYHYVA

SEQ ID NO: 70937 - protein, 322 aa, Arabidopsis thaliana
MASRIAKDVTELIGNTPLVYLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAEAAAAIKLAQRPENAGKLFVAIFPSFGERYLSTVLFDATRKEAEAMTFEA

SEQ ID NO: 70938 - protein, 157 aa, Zea mays
MGLENIPVNEILRAKGEAEAGTVFWCSPPHLVHKTVQHKAAPNVGAFVVFKSGDMNQLPGIVTKKNFSKKILLPGGPSQQTRVKDFMPKKAKVIPGSGCTNILRAMEVMTTKGIRHVPVFDAKVVGMISPGDVVKTIVGHQPQKVKQLKKFIKGGFF

SEQ ID NO: 70939 - protein, 642 aa, Arabidopsis thaliana
MSSTFRAPAGAATVFTADQKIRLGRLDALRSSHSVFLGRYGRGGVPVPPSASSSSSSPIQAVSTPAKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGTWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCARPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 70940 - protein, 314 aa, Mannheimia succiniciproducens MBEL55E
MIMKKIAILGECMIELNGEPFGRMRQTYGGDSLNTATYLARVSRREQFEISYVSALGKDKLSLGMLAHWRNDGINTDCVLLDEKRQPGLYLIQLDEKGERTFLYWRNQSAARYLLQHEGYTEVLARLATADMIYLSGISLAILPENDRTLLIRQLGNLKKAGVKIAFDSNYRPALWDSFQQTQACYQALLPLVDLALVTFDDEQSLWRDENVQQTISRLVQLGVGTVVVKSGEHGAVFYHNGETQQVATEVVQRVVDTTSAGDAFNAGFLNGYLQQKSLVDCCRQGNKLAGIVIQHKGAIIDKTATQHFIREFN

SEQ ID NO: 70941 - protein, 195 aa, Zea mays
  misc_feature (127)..(127): Xaa can be any naturally occurring amino acid
  misc_feature (131)..(132): Xaa can be any naturally occurring amino acid
  misc_feature (135)..(135): Xaa can be any naturally occurring amino acid
  misc_feature (137)..(137): Xaa can be any naturally occurring amino acid
  misc_feature (139)..(139): Xaa can be any naturally occurring amino acid
  misc_feature (145)..(146): Xaa can be any naturally occurring amino acid
  misc_feature (148)..(149): Xaa can be any naturally occurring amino acid
  misc_feature (153)..(153): Xaa can be any naturally occurring amino acid
  misc_feature (155)..(156): Xaa can be any naturally occurring amino acid
  misc_feature (167)..(167): Xaa can be any naturally occurring amino acid
  misc_feature (170)..(170): Xaa can be any naturally occurring amino acid
  misc_feature (179)..(179): Xaa can be any naturally occurring amino acid
  misc_feature (187)..(187): Xaa can be any naturally occurring amino acid
SSKIGVIESLLEKCDILLLGGGMIFTFYKAQGLPVGASLVEEDKLELATSLLAKAKEKGVSLMLPTDVVIADKFAPDANSQIVPASAIPDGWMGLDIGPDSVASFNAALDTTQDGHLEGPMGVFEFXKSPXXTEXVXKXLAELSXXGXXTIIXGXXSVAAVEKVGVXDVXAHFTGGGAXLEMLEGKXFGCSLKKA

SEQ ID NO: 70942 - protein, 259 aa, Novosphingobium aromaticivorans DSM 12444
MGRLSGKVAIVTGGARGMGAATSRLFVAEGAKVAIADVLDEAGEALAAELGDAARFFKLDVTSEDNWASVVSEVEAALGPVDVLVNNAGILMFKSLLETTKADYEKVLGVNLVGEFLGIKAVAPGMIARGKGSIVNISSVDGMKGANSLVAYASSKWGVRGLTKVAAMELGHKGIRVNSVHPGGVDTVMSNHSGAAREDVDKGYANVPLQRIGGPEEVAAASLFLASDDASYLHGAEIVVDGGMTVGTYYMGFPGSPGM

SEQ ID NO: 70943 - protein, 572 aa, Salmonella typhimurium
MSMSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWQAIDKFAADNTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGLETFKAEVERRAGIKFEPIRPYEFTGRGDRIGWVKGIDDKWHLTLFIENGRILDYPGRPLKTGLLEIAKIHQGEFRITANQNLIIASVPESQKAKIETLARDHGLMNAVKPQRENSMACVSFPTCPLAMAEAERFLPSFTDKVEAILEKHGIPDEHIVMRVTGCPNGCGRAMLAEIGLVGKAPGRYNLHLGGNRIGSRIPRMYKENIAEPDILASLDELIGRWAKEREAGEGFGDFTVRAGIIRPVLDPARDFWE

SEQ ID NO: 70944 - protein, 542 aa, Coccidioides immitis RS
MEDMSRPQCGGAKGNDAEYDLPLHVAALCAGFPVVAKKIPRLQIPPNAFFFCKHFGTGVLIATAFVHLLPTAFTSLNDPCLPPLFTEQYPAMPGVIMLGSLFALFALEMYLNAKTGGHSHGGATGESINRPHQHHHNAQTRNNEISWPTENKVMSDASSDDWYEEKAAYKFVPSRLLGLARKCGVYSGANRFEDSYLSEPSSMPTWFMVFYEQYVREREWTQAMLRTAARRDDDMQTIELKQTAPVQSDIPRDLEVGEVDPAVLRKMSLNITILEGGILFHSVFVGMTVSIETEGFMVLLIAILFHQAFEGLGLGSRIAAVPYPKGSMRPWLLVLAFGTTAPIGQAIGLIARNTYDAESAFGLIMVGTFNAISSGLLIYAALVDLLAEDFLSEEAQHLTKKQKISGFIYVLMGGKLNETLALHSSGGALTPLSTKRPECPLSAHLPKQVLTQNERRASIPTTHGLRLRWGRAKCFSSTARPCRNRQVLESTSNSVNPFYKFIATMQTLCMSRQLEDKIIACLSFCREMFRAEPWSSSISVKK

SEQ ID NO: 70945 - protein, 495 aa, Nocardia farcinica IFM 10152
MAISSPRRRSSLLRTKSVEQSIRDTDEPDSKLRKDLTAWDLTIFGVAVVVGAGIFTLTARTAGNVAGPSVSLAFVFAAIACGLTALCYAEFASTVPVAGSAYTFSYATFGELAAWIIGWDLFLEFALAVSVVSKGWSQYLGEVLNITPIVDLGGLDFDWGAVLLIAVLCVLLAMGTKLSSRVSAIAVAIKLAVIALVIAVGLAYFDTDNLSPYIPPSEAGQGGEGIHQSLFSYLTGAGNSTFGWYGLLAAASLVFFAFIGFDVVATTAEETKNPQRNVPRGILGSLAVVTVLYVAVSLVLTGMVSYTELSGENATLATAFGLHGVTWAEKIIAVGALAGLTTVVMVLYLGQTRVLFAMSRDGLLPRPLAHTGRHGTPVRLTIIVGVACAVLAGFVDMGALEEMVNIGTLFAFVLVAIGVIILRRTRPDLPRGFRVPLVPLVPILAVLACLWLMVNLTVETWIRFIIWMALGLIIYFAYSRRNSLLGKEEVSLRKE

SEQ ID NO: 70946 - protein, 323 aa, Salmonella typhimurium
MSKIYEDNSLTIGHTPLVRLNRIGNGRILAKVESRNPSFSVKCRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEVFLAGISSGAAVAAALKLQEDESFTNKNIVVILPSSGERYLSTALFADLFTEKELQQ

SEQ ID NO: 70947 - protein, 459 aa, Bacillus anthracis str. Ames
MSKLVVIGGGPAGYVAAITAAQNGKNVTLIDEADLGGTCLNVGCMPTKSLLESAEVHDIVRKSNHYGVTLNNGSISIDWKQMQVRKSQIVTQLVQGIQYLMKKNKIKVIQGKAKFETDHRVRVTYGDKEIVVDGEQFIIATGSEPTELPFAPFDGKWILNSTHAMSLKNIPKSLLIVGGGVIGCEFASIYSRLGTKVTIVEMAPQLLPGEDEDIAHILRGKLENDGVKIFTGATLKGLNSYKKQALFEYEGGIQEVNPEFVLVSVGRKPRVQQLNLEKAGIQYSNKGISVNEHMQTNVSHIYAAGDVIGGIQLAHVAFHEGTTAALYASGEDVKVNYHAVPRCIYTAPEIASVGLTEKDAKEQYGDIQIGEFPFTANGKALIIGEQTGKVKVIVEPKYQEIVGISIIGPRATELIGQGTVMIHTEVTADIMRDYIAAHPTLSESIHEALLQAVGHAVHA

SEQ ID NO: 70948 - protein, 184 aa, Vibrio fischeri ES114
MRLTIPNILTFIRLALIPVFVVVFYLPYEWSAVAAAMVFWVAGFTDWLDGLLARKLGQTSRFGAFLDPVADKVMVAAALILITEHYHTIWITIPAITMIAREIIISALREWMAEIGKRASVAVSWVGKVKTVSQMFALWVLIWRYDDWMIWLGYAALYIATILTYWSMVQYLAAAKDDLLNADE

SEQ ID NO: 70949 - protein, 398 aa, Bacillus anthracis str. Ames
MAVEVVMPKLGMAMKEGIITSWNIKAGDNVAKGELIASINSEKIETEIEAPADGTILDIAVSEDEGVPPGTVICYIGKPNEKVEVHESTKVEEELTASEVPQNVQHPEPLGKEVTNKQRIKISPVAKKIAKTENLDIRALLGTGPGGRITKVDVLKALEERVAIPEVLEESKVLPVTGMRKAIANRMHASLQNSAQLTLTMKVDVTDLVALHKEIAEVVQKRYDNKLTITDFVSRAVVLALGEHKEMNSAYIDDAIHQFEHVHLGMAVALEKGLVVPAIRFANNLSLVELSKEIKNAAQKARAGNLNSDDMQGTTFTISNLGSFGIEYFTPVLNTPETGILGVGAIEHVPVYKGKKLKKGSMLPLSLTFDHRVLDGAPAAAFLRTIKRYLEEPVTILL

SEQ ID NO: 70950 - protein, 469 aa, Shewanella benthica
MSAESVLQQLKELEVKFVDLRFTDTRGKEQHVSIPSHQVDEDFFEDGKMFDGSSINGWKGINESDMVLMPDPESFVLDPFTADTTAIIRCDILNPGTMTGYNRDPRSIAKKAEEYLRSTGIADTVLLGPEPEFFLFDDVKYGSDMSGCFYKLDAEEASWNSGTSYEGGNTGHRPSVKGGYFPVPPVDSSQDIRSAMCLILEEMGQVVEAHHHEVATAGQNEIATRFNTLTLKADEVQVLKYVVHNVAHVYGKTATFMPKPIVGDNGSGMHVHISLAKDGTNLFAGDKYGGLSELAIYFIGGVIKHARAINAFSNPATNSYKRLIPHFEAPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSSDFIDSYITLKTEDVERVNQTTHPVEFELYYSL

SEQ ID NO: 70951 - protein, 454 aa, Geobacillus kaustophilus HTA426
MAQLETNTSVESLGYKQELKRSLTFVDLLIYGMVFMVPIAPFGIYGYVAQGSKGMVALAYLIGMVGMIFTALSYARMAEAFPIAGSVYSYAQRGMNEYVGFMAGWVILLDYIFVPALLYLVSAAALADIVPQVPISVWLVLFIAMNTVINILGIEMTAKANKVIVVLELIVLAVFVITGIIAIIKGVNGAQFTFKPLYDPNHFSAETVMGAVSVAVLSFLGFDAVSTLAEETRDGKSSIGKAIIFALLVVGALFIVQTWVAALIWPDYTTFKNADVAFYQIAELAGGPWLKWTTIVATALSWGIANALVAQAAISRILYSMGRDRKLPSVLAKVHPKFQTPYVSTLLVAVISLIVTTVFASQIDKLASLVNFGALTAFLFLHVSVMNYFLRKQKSNDYINHLLFPLIGFVIIGYVWMNLDPLSKKLGLIWIAIGLVYLVFLRLTNKDSRLSGEL

SEQ ID NO: 70952 - protein, 457 aa, Zea mays
MAARKKKPLLIACQATSARITRSQAAANSTRSGLAPSVPVPLKTEHNHPAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNHWLVEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTVRSAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 70953 - protein, 448 aa, Chlamydomonas reinhardtii
MEARTVSVLAGLAHRVASAAWRSASGLRTCTTTTPTYGRTSVYVKEALDLLDFDPQVEKAILNPDREVTVNLVVPMDNGEVNMFPAYRVQHNNALGPFKGGIIYHPGVTLENMRNLASLNTWKFSLLNVQFGGAKGGVGVDPRSLSERETEKLTRKYVQALQEVIGPHTDIPAPDINTDEHHMAWIFDQYSRLRGFAPAAVTGKPTWLHGIVGRDKAGGRGAAIATREFLTRSLRRKVAGTSFLIQGFGKLGSWTAQILQQEMGAKIVGVSCSETAVYNEEGLDIPALRAHVAAGGLLKDFPGGTGVLNDDSFLDLPADVFIPCAVDGTIHAGNVHRCVNFKAVVEAANGALTPEADAALRKAGVPVLPDLIANGGAVVVSFFEWVQNNQNMQWEEDDVKRELDRYLTDAFEALLREQSLHAGCSLRTAGYLVALRRLQQADSVRGHS

SEQ ID NO: 70954 - protein, 577 aa, Streptococcus agalactiae 2603V/R
MTEMLKGIAASDGVAVAKAYLLVQPDLSFETVTVEDTNAEEARLDVALQASQDELSVIREKAVESLGEEAAAVFDAHLMVLSDPEMINQIKETIRAKQVNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITERVQDGQLIAVNGITGEVIIEPTEAQISAFKAAGEAYAKQKAEWALLKDAQTVTADGKHFELAANIGTPKDVEGVNENGAEAVGLYRTEFLYMDSQDFPTEDEQYEAYKAVLEGMNGKPVVVRTMDIGGDKELPYFDLPKEMNPFLGFRALRISISETGDAMFRTQIRALLRASVHGQLRIMFPMVALLKEFRAAKAIFEEEKANLLADGVAVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALSECSTMEEVIELQKEYVDFD

SEQ ID NO: 70955 - protein, 475 aa, Streptococcus agalactiae 2603V/R
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGKRIGKLAGMRPIMLELGGKDAGVVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 70956 - protein, 604 aa, Mycobacterium sp. JLS
MDATPFGHYRLQKLIGRGGMGEVYQAYDTHTDRVVALKVLPPHLAQDATFQRRFRREAQAAAGVQDPHVVPIHSYGEIDGRLYLDMRLIEGRNLGTILEGADKPLLPSFAVKVVEQVATALDAAHAAGLIHRDVKPSNILITDRDFVYLIDFGLARSAGEPGMTTAGSTLGTLAYMAPERFNGGRIDPRSDIYALTCVLYECLTGVRPYPADSLEEQIAGHIVRPVPKPSDTDPRLAAFDEVIERGMAKKPERRYQSAAEMAAAARRALTSPVRWSSRSGRHSARSARIPMRRRLPRRAAAVTGVVLVVVAVSGAVTWQWSGWPERTRAPRQVVVAEDTPTPAPTPGAVPSIAATVPADVRESGRLVIGVNVPYAPNEFRDAYGDIVGFDVDLMKAVARTLGLVPEFRETAFESVIPSVQSGAFTLGMSSITDTLEREKAVDFVTYLEAGTLWAQRAGSEVVDPSNACGLRVGVAYSVIQETDELPAKSEACVAAGREPIRKVVFTEQDDVTAALLAGEVDAMSADSPVTGFAIKTSGGALEPAGEVFDSAPYGWPVAKGSALAESLRQALEHVMATGEYRTIATMWGVEKGMIATPVVNGAVR

SEQ ID NO: 70957 - protein, 528 aa, Saccharomyces cerevisiae
MSYNNGNTYSKSYSRNNKRPLFGKRSPNPQSLARPPPPKRIRTDSGYQSNMDNISSHRVNSNDQPGHTKSRGNNNLSRYNDTSFQTSSRYQGSRYNNNNTSYENRPKSIKRDETKAEFLSHLPKGPKSVEKSRYNNSSNTSNDIKNGYHASKYYNHKGQEGRSVIAKKVPVSVLTQQRSTSVYLRIMQVGEGTYGKVYKAKNTNTEKLVALKKLRLQGEREGFPITSIREIKLLQSFDHPNVSTIKEIMVESQKTVYMIFEYADNDLSGLLLNKEVQISHSQCKHLFKQLLLGMEYLHDNKILHRDVKGSNILIDNQGNLKITDFGLARKMNSRADYTNRVITLWYRPPELLLGTTNYGTEVDMWGCGCLLVELFNKTAIFQGSNELEQIESIFKIMGTPTINSWPTLYDMPWFFMIMPQQTTKYVNNFSEKFKSVLPSSKCLQLAINLLCYDQTKRFSATEALQSDYFKEEPKPEPLVLDGLVSCHEYEVKLARKQKRPNILSTNTNNKGNGNSNNNNNNNNDDDDK

SEQ ID NO: 70958 - protein, 168 aa, Glycine max
  misc_feature (49)..(49): Xaa can be any naturally occurring amino acid
  misc_feature (145)..(145): Xaa can be any naturally occurring amino acid
MIYSPSVTTVNRAGADMGATFTDLNSMAGFPIIKTNNDITSIDTNNGRXQCIQVWPPIGNKKFETLSYLPYLDDAQLAKEVEYLLKKGWIPCLEFKSEHGFLCREHNKTPGYYYRRYCTMWKLPIEGCTDANNVVEEDKHDKTAXPNWLISIFRNDNEMQVHCISVNY

SEQ ID NO: 70959 - protein, 405 aa, Debaryomyces hansenii CBS767
MSEPIRSKHGDISKAPTPQNTPASLTNSYLKSQPPTVSTINEEESGNGISSQLANNPALLSMIQGKLGTLVGQQSGYIDSLPKSVKNRVFGLKSIQQQQMKLEAEFQKELLVLEKRFFKKYEPLYERRKKIINGDEEPSAGEIEEGEALDEADEDEDDEEKDKIEEVEDQGEKGIPGFWLTALENLQTVSETITERDSELLKYLNDIRMEYLSTPGFELIFEFKENPYFSNNILTKTYHYQAELGYSGDFVYDHADGSEINWKSKENNVTINIERRKQRNKTTKQTRTIEKLTPSESFFNFFDPPKPPKVDESESQDKDEDESEEEQDEDEDLEARLELDYQLGEEIKDRLIPRAIDWFTGDAVGFGFPEDFDQDEEFGSESEGDSDEDDDDEPPKENPPECKQQ

SEQ ID NO: 70960 - protein, 151 aa, Chenopodium rubrum
ALLLLLSVSQGNAIDPRKIQEHFEDFYEDLFEELNKYGEIESLNICDNLADHMVGNVYVQYREEEEAANAHRNLSGRFYAGRPIIVDFSPVTDFREATCRQYEENNCNRGGYCNFMHLKRISRELRRQLFGRYRRRHKQKQKQKPIQTQKL

SEQ ID NO: 70961 - protein, 735 aa, Candida albicans SC5314
MNLLNNCDEVSSSSSKTTNNFNNLINSTTAEPPQPQPQPQGLSTSTTTTSVSTRHHSPDIVYSSHTKSTLISKAPSDFIQTQPSSPEPTSSIQTISNQITDDLPNQEVSVVTPFLVKHISDANMIPKDNFHKYCYRHNPDITCNKHTDEARMKLIQDQLDKLPNGDQQAITHVWSIFSAAPVQHRQLILQGLLSQCCFPQLSFISQEVSSLIKIDFISTLPQEISLKILCYLDCRSLCNAAQVSRKWKSLADDDRVWHYMCQQHIDRKCPNCGWGLPLMHMKRAREMTDDDNIKPIKRNDEQQQQQQQQQQGSSQAQSQVLDGEGQPDRKKVKLDTEDNHQKVVPTSVVVRKRPWKSVYSERFKLEKNWRKGTHTIKTFTGHSDGVTCLQFNRKYLMTGSYDTTIKIWKIDSGECVKTLTGHTKGVRALVFDNQKLISGGLDSTIKVWNYHTGQCIATYRGHEDAVVSVDFTNKSIVSGSADHTVRVWHVDSRTCYTLRGHTDWVNHVKIHSASNTIFSASDDTTIRMWDMNSNECIKVFGGMENNGHIGQVQCIIPFTYKEELIEDESESDSENNQNSTTTTTTTSAAATATATAMGATLGTNNISLPNDTATINRSTFTPSNNNTATTATTPNSYPTHFLTSALDNTIKLWDVATGKCIRTQFGHIEGVWSIAADTFRIISGAHDRLIKVWDLQNGKCLHTFSNNSSVSCVGLSDSRFVAGLENGEVKMYCFD

SEQ ID NO: 70962 - protein, 419 aa, Pseudomonas syringae pv. phaseolicola 1448A
MCGFKAAALNPPPHAGRTMPLISPWRGDFPAIAALQRQGQTYLDNAATTQKPQALIDALTHYYVNGAANVHRAQHLPGAHATQAFEASRGKAAHWLNAGESGQIIFTHGATSALNLLAYGLEHSFTAGDEIAISALEHHANLLPWQQLAQRRGLKLVILPLDPDGVIDCHAAASLIGPRTRLLAVSQLSNVLGTWQPLARLIALAKAQGALTVVDGSQGVVHGRHDVQALGCDFYVFSSHKLYGPEGLGVLYGRNDALPNLTHWQFGGEMVLTADYQHAKFRPAPLGFEAGTPPIASVIGLGATLAYLESLDHQAVAEHEANLHRRLLEGLQRREGIQVLGSPDLALASFVVDGIHNADLAHLLTEQGIAVRAGRHCAMPLFDTLGLPSAIRVSLALYNDSDDLLRFFSALDQALELLR

SEQ ID NO: 70963 - protein, 508 aa, Yersinia pestis CO92
MSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 70964 - protein, 340 aa, Yersinia pestis CO92
MEITDMPTDDSNNGIIDYVSTGHLPDPETVVKLVQEAHKRFSTDTAGVVSNVYPALERIPADLFGICMVGTNGKIHSAGDVDYEFTIMSVSKPFVFALVCQAIGAKTAREKLGVNSTGMAFNSVTAIERASDGRTNPMVNSGAIATTSLVPGATSDEQWKFIYDGLCRFAGRELTLNEEVYQSACETNFRNRGIANVLQGYGRLGCDPIIATDLYTRQCSLNVSARDLAVMGATLADGGVNPLTRERVVDNDICHYALAVMVTAGLYETSGDWLYDIGLPGKSGIGGGIVTVSPGKGGLGTFAPLLDSAGNSIKGQLAARFLSRSLGMDMFVSEPYTEKN

SEQ ID NO: 70965 - protein, 232 aa, Gloeobacter violaceus PCC 7421
MGVAERIEWLRGQLPAAVRLVAVTKQVPVERIREAYDCGLRDFGESRIQEVQQKIPQLTDLQGVSWHLIGSLQRNKARPALEVFDWIHSVDSLPLAERLASLMDSVGRRPRLLLQVKLAADPTKSGWSQAELEAALPRLAALPQLDIRGLTAIAPLGLGEQGNRTLFGQVAALARDLGRRAGEAGWQHIRMEELSMGMSGDYPQAIAAGATMVRLGQVLFGSRLPLRRNGDE

SEQ ID NO: 70966 - protein, 428 aa, Nocardia farcinica IFM 10152
MAIIEQVGAREILDSRGNPTVEVEIALDDGTLTRAAVPSGASTGEHEAVELRDGGDRYNGKGVLKAVEGVLDEIAPAVIGLDAVEQRTVDQVLLDLDGTPDKSRLGANALLGVSLAVARAAAESSGLELFRYLGGPNAHVLPVPMMNILNGGAHADTGVDVQEFMVAPIGAPTFKESLRWGAEVYHALKAVLKSKGLSTGLGDEGGFAPDVAGTREALDLIAQAIAKTGLKLGSDVALALDVAATEFYTSGSGYKFEGTVRSAEEMAQFYSELLGAYPLVSIEDPLSEDDWDGWVALTDQIGDKIQLVGDDLFVTNPERLEDGIAKGAANALLVKVNQIGTLTETLDAVELAHRNGYKTMMSHRSGETEDTTIADLAVAVGSGQIKTGAPARSERVAKYNQLLRIEDALGDSARYAGDVAFPRFVFDG

SEQ ID NO: 70967 - protein, 695 aa, Nitrosomonas europaea ATCC 19718
MHTFFVTSTGFGVGLTSTSLGLVRALEYGGLKAGFYKPVAQQHPGNSKLEYSTELISRTLGLAPPAPLPLATVEHLLGEGQIDDLMEDIVRRFKQASEGYDVMVVEGMVPTRHVSYASRVNTRLASSLDADIILVSSAEDDALQAITDRIEIQAQFFGGAQNPRLLGVILNKIRTDHSDDLFEQLKNHSTLFHQSSFQILGCIPWEDSLNAPRMADVVTQLQAQIVNAGDSEKRRVQDIVLFASAAPNSVTLLRPGVLVVTPGDRDDIVMAASLAVLNGVPLAGLLLCSDFPPDPRVLELCKGALTKGLPVCTVTTNSYDTAANLHRMNREIPLDDHERAERITNFVANHIRQELLVKRCGEPQEQRLSPPAFRYRLVKRAQEADCRIVLPEGYEPRTIQAATICQERGIARCVLLAKPDAVKAVASARGITLPEGLEMIDPEKVRRNYVAAMVELRKHKGLNEPMALAQLEDNVVLGTMMLATGEVDGLVSGAINTTANTIRPALQLIKTAPGFKLVSSVFFMLLPEQVVVYGDCAVNPNPTAEELADIALQSAASAQALGIEPRVAMLSYSTGDSGSGQEVEKVREATRLARLARPDLLIDGPLQYDAAAIASVGRQKAPGSPVAGRATVFIFPDLNTGNTTYKAVQRSANVVSVGPMLQGLRKPVNDLSRGASVEDIVYTIALTAVQAASQR

SEQ ID NO: 70968 - protein, 263 aa, Gloeobacter violaceus PCC 7421
MNLGIVGGGAMAEALIAGLIAGAVYAPSEIAVSDPVAERGEWLHRRYGVVAVTDNLVPAAAPTLLLAVKPQAFAVVSNQVAAHVRSELVVSILAGVPLARLQAAFTGRAVVRAMPNTPALVRSGITALSRSERVTPEQFAVARTLFACVGEVVEVPESAMDAVTGLSGSGPGYLALVVEALIDGGVAAGLPRATASQLVLATLRGSAELLIQEKLHPAVLKDRVTSPGGTTIAGIEQLEGRSVRGAFIEAVQAATRRARELSG

SEQ ID NO: 70969 - protein, 434 aa, Pseudomonas fluorescens Pf-5
MGTHVIKMPDIGEGIAEVELAQWHVKVGDQVVEDQVLADVMTDKAMVDIPSPVHGKVISLGGEPGEVMAVGSILISIEVEGAGNLKESAQAAAPAAKEPAAINKPVAAAPVAQAPKAEKTVASPAAACRAAPQAPVAREADERPLASPAVRKHALDLGIQLRLVQGSGPAGRILHEDLDAYLAQDSQPLKGYSAPGAGYAERHDEEQIQVIGMRRKIAQRMQESKHRAAHFSYVEEVDVTALEELRIHLNEKHGATRGKLTLLPFLVRAMVVALRDFPQINARYDDEAQVITRHGAVHVGVATQSDVGLMVPVVRHAEARSLWGNAEEIARLAQAARSGKAARDELSGSTITLTSLGALGGIVSTPVLNLPEVAIVGVNRIVERPMVIKGQIVIRKMMNLSSSFDHRVVDGMDAAQFIQAIRGLLEQPATLFVE

SEQ ID NO: 70970 - protein, 809 aa, Shewanella sp. MR-4
MLTLLDQLDKGTLWRSPGGIHPPEVKFLSNTTPISQLPLAQEYLVPVPQVGENCTLVVKVGDKVLKGAPLTQGTSIWHLPVHAPTSGTVVAIEPRASNHASALPVNTCVIAADGEDRWCELTPGSIELSNHEMIAKIHGAGIAGMGGAAFPSHIKLNPVSEIELVIINGVECEPYISADDRLMREYSQDILAGIGIIHRLLAPKRIVIAIEDNKPEAIKAMQQAVSQSTLPAGSTRVTAIPTKYPSGGEKQLIQIITGREVPSGSIPAKLGIVVHNVGTAFAIHQAVTQGKPLIERVVTVTGQNIGKPGNYWLPIGTPVEHVLKHTEFNAEADQKVIIGGPMMGHALPTIQVPILKGTNCILVPSSQEIGTTPEEKACIRCGECANACPALLLPQQLFWHAKAEEYDKAASYNLKDCIECGCCSYVCPSDIPLVEYYRIAKSALKQAADEKHQAERAKLRFEARIQRLEEEKLAREAKAKEAAARRQATMSSTDKNAVAEAMARIAAKKAAAAETTADNTQVEVVNADANSTEAPKGKAAVAAAIARAKAKKAAAAAQSADDAESSQQAVSSEQTVSSEQSEPTEQAETLSQKDKVAAAIARAKAKKAALKADSDPNSDTDAATDNTDKPATETTANAEADDKKAKVAAAVARAKAKKAAAQQAESTDVVDEQPKLAADAQPASSSEFGNESSSVAEPNAPLSPEDEKKAKVAAAVARAKAKKAAAQQADSTEVTEVQPELVSVAKPESDIESGSESDSESGDESSSVAEPSAPLSPEDEKKAKVAAAVARAKAKKAAREANAISDANE

SEQ ID NO: 70971 - protein, 283 aa, Mesembryanthemum crystallinum
MEGKEEDVRLGANKFSERQPLGTVAQDRDYREPPRALFEAGELTSWSFYRAGIAEFIATFLFLYISILTVMGVNRSPSKCASVGIQGIAWSFGGMIFALVYCTAGISGGHINPAVTFGLFLARKLSLTRAVFYMVMQCLGAICGAGVVKGFQPTPYQLLGGGANSVNPGYTKGSGLGAEIIGTFVLVYTVFSATDAKRSARDSHVPILAPLPIGFAVFLVHLATIPVTGTGINPARSLGAAIIYNRPHAWADHWIFWVGPFIGAALAALYHVVVIRAIPFKSK

SEQ ID NO: 70972 - protein, 342 aa, Nocardia farcinica IFM 10152
MLVTRVTDLIGRTPLFELATTDTGTRLLLKLEQFNPTGAAKIRMAREMVLDAERRGLLEVGGHIIESTSGNTGLGLAVVAAERGYRFTAVVDHHACKDKLRAMAAMGAELVYVADEGDDGLATSAREDLAEAMAAECGGYFTEQHDNDANAVGYYPVAEELLEDVERVDILLSAVGTGGSLFGTATRLRQLGCPPHVIGVEPVGSIAFGGPGGPYWQSGTGTPPGATIGTAVDYSLLDEGVKVSDTDAFATARAVAAELGLMLGGSAGGSVYVGLERLEQFPPGSTVVTIVCDGGEKYLDTVFDDDWMRARDLLAPAVEDRVREHLRRYAPAARRPALAHAR

SEQ ID NO: 70973 - protein, 149 aa, Gloeobacter violaceus PCC 7421
MERTFIAIKPDGVQRGLVGEILQRFERRGFKLVGLKLMQVSEALAQKHYAEHKERPFFGGLVAFITSSPVVAVVLEGKGVVATARAMMGVTNPLNSPLGTIRGDYGIDIGRNIIHGSDSLESAEREIALWFAPAELLEWQATLGSWVYE

SEQ ID NO: 70974 - protein, 209 aa, Streptococcus agalactiae 2603V/R
MRKKPIIIGVTGGSGGGKTSVSRAILSNFPDQKITMIEHDSYYKDQSHLTFEERVKTNYDHPLAFDTNLMIEQLNELIEGRPVDIPVYDYTKHTRSDRTIRQEPQDVIIVEGILVLEDQRLRDLMDIKLFVDTDDDIRIIRRIKRDMEERDRSLDSIIEQYTEVVKPMYHQFIEPTKRYADIVIPEGVSNIVAIDLINTKVASILNEAK

SEQ ID NO: 70975 - protein, 475 aa, Burkholderia sp. 383
MNIHPVILCGGSGTRLWPMSRGGYPKQYLKLTGDRTLVQQTAARLQHIPGAAAPIVLTNNEQRFLVAEQLRQVNITPSSIVLEPVGRNTAPAIAIAALLALHESLDALLLVLPSDHVILNEPAFIAAATEAAAIAADQYLVTFGITPTEAHTGFGYIRRGPAIADGKQVYKVDAFVEKPDAPTAERFVSDGNYSWNSGMFMLKASTYMEELRRHAPEIARQAELAFESAKRDNDFVRLDADVFAACPNVSIDYAVMEKTERAAVVAAADLGWNDIGSWSALADIADADEQGNALIGDIFTDAVTNSYIRAEHRMVAAIGLDDIVIVETADAVLVAHRDKAQDVKKIVEWLNASGRHESVTHRRVVRPWGSYEGIDQGDRFQVKRIIVNPGAQLSLQMHHHRAEHWIVVKGTAMVTNGDKEIMLTENQSTYIPLGATHRLTNPGKIPLELIEVQSGAYLGEDDIVRFEDTYGRAAS

SEQ ID NO: 70976 - protein, 413 aa, Exiguobacterium sibiricum 255-15
MVERLVLENGVRIVSERIENARSVATGIFIKAGSRTETKEEHGISHLIEHMMFKGTKKQSAKEIAVYFDRLGGNINAFTSKDQTCYYVKTLDEHAITAFDVLADMFLESTFDEEELEKEKRVVIEEIKMYEDTPDDLVHELLAVAAYGEDVMARPILGTEESVKQLSRQMIVEYLQEAYAPEQIVISVAGHVTDELITQIKNRFGSLQSSGKIRQITEPVLKSDALRKEKDTEQVHVCYNFRAIPSADDRLPTLALLNNAFGATMSSRLFQSIREDRGLAYSVFSYYTTFDDHGTFTIYVGTSKETLEEVETVLSAEIKQLLEHGLTTKELEDGIEQLKGSLILGNESISSHMNRNARNELHLGMHPTLEDVLTEVEQITPADVQEMIAYIFSEPPAKAYILPEIDEADLETE

SEQ ID NO: 70977 - protein, 549 aa, Pseudomonas fluorescens Pf-5
MKNLHRCKKIFLRVFSRSARRQREPLQDAVLDLHQGAFGGFAPCSAPVQLKRKRPMTKPETTAPTAKAVLPIGLLIAVLAMVAVLLLPLPADLPVAGHRMLAILAFAVVVWISEAVSYEASAIMITALMAFLIGTAPTLQDPSQLYGSSAAIGLALTGFSNSALALVAGALFIAAAMTHTGLDRRIALVTLTRVGTSTRRILIGAIAVTILLSLLVPSATARSACVVPIMMGVIAAFGVDKRSNIAAGLMIVVAQGTSIWNVGIQTAAAQNLLTVGFMDKMLGQRVAWLDWLIAGAPWAVIMSLVLLWLVLKLLPPETDSIPGGKEAVAQSLADIGPMTGPQKRLLTVSVLLLLAWSTEGKLHPFDTTTTTYAGLVILLLPRIGIMTWKDVQSRIPWGTVIVFGVGISLGSALLSTQAGQWLGSQVVAHTGLDQVGPLAVFAILAAFLILIHLGFASATALTSALLPILIAVLQTLPGEFSRLGMTMLLGFVVSYGFILPINAPQNMVCLGTETFNARQFAKVGLLVTLIGYLLMLVFAMTWWKWLGWM

SEQ ID NO: 70978 - protein, 554 aa, Streptococcus agalactiae 2603V/R
MYQALYRKYRSQTFDEMVGQSVISTTLKQAVSSKKISHAYLFSGPRGTGKTSAAKIFAKAMNCPNQINGEPCNHCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKLLAIRDHLAQILDKEAISYDLDALTLVARRAEGGMRDALSILDQALSLAKDNHISLDVAEEITGSISLSAIDDYVSNILAHDTTEALAKLEVIFDSGKSMSRFATDLLMYLRDLLVVQAGGEDSHSSDTFIANLNVKQDILFEMIDKVTSVLPEIKNGSHPKVYAEMMTIQLSEMVEKNSSNIPADVTAELDSLRRELKSLKNEMSQLSRADQSSSTQKVKVNNKTFTFKVDRTKILTIMEETVVDSQRSREYLEALKSAWNEILDNITAQDRALLMGSEPVLANSENAILAFDAAFNAEQAMKRTDLNDIFGNIMSKAAGFSPNILAVPRNDFNQIRSDFAKKMKAQKTETEPEVNHQIPEDFSYLAERIAIVED

SEQ ID NO: 70979 - protein, 151 aa, Zea mays
  misc_feature (134)..(134): Xaa can be any naturally occurring amino acid
MTNEEPLPKKVRLSETDFKVMARDELILRWKQYEAYVQALEGKYTDLNSNDVTGLRESEEKLKQQQQESARRENILVMRLATKEQEMQECTTQIQYLKQVQQPSVAQLRSTMVDPAINLFFLKMKGELEQTKDXLEQAQNELSAWKFTPDR

SEQ ID NO: 70980 - protein, 214 aa, Chlamydomonas reinhardtii
MLTIGGLNIYPIKSCRGVSLQSAMLTESGLAYDREWMVVREDTGKFISQREKGLLALVQVSLPVEALAAAQWGAAGLPPDAALTVTAPGMTAPLKVPLARRPDSEAKKVTVWEWTGTATDEGPDAAAWFTTYLGLPCRLVRYVGSGMQPVAPEFAVKYETRFSDGYPMLIVTQAALADLNTKLAEPLPMNRFRPNIEVAGASPWAEDTWRDIDV

SEQ ID NO: 70981 - protein, 630 aa, Corynebacterium efficiens YS-314
MGTFDHDHLQKLRHEVDDLLTELAQVTEANKAEIDKVAPTHYNGAINLLHYLHLRTRDLRDLQSALASIGSTRLTTTEPSVKARLKSARNVIGAYLGEGPIYPGRDVADAFSDADEILDEHAEILLGAPLEGTPSCIMVTLPTEAATDLEMVRGFAKSGMDLARINCAHDDETVWKQMIDNVHIVAEEAGREIRVAMDLGGPKVRTGEIAPGPEVGRARVTRLDTGKVLTPAKIWITPIPEEGTEPAPVPENLPGRPALAVQVDPDWFDKLSTGSVIGLTDTRGSRRSFTVVRTFDGAVLAEGYQNAYIANGTLLQHDYERTPVRGIPPVSQRINLKVGNRLFLTSEEVVYDPSAGHGRIPKISCTLPEAVGAIKVGHRVLFDDGSIAAVCIDRREHDGHHVVELEVTRARPQGVNLAAYKGINLPDSELPLPSLTEEDLRHLRFVAKHADIVNVSFIRDTGDVEYVLDALAQIAEETGEHDKIRELGLVLKIETIPGYENLAQIMLTGMRHENFGVMIARGDLAVELGFDRMAEVPQLIMALAEAAHIPTIFATQVLENMAKNGLPSRAEITDATLALRCECVMLNKGPHINDAIKVLSRMSKKLGASQRKSRMLLRRIRSWEEPDQQG

SEQ ID NO: 70982 - protein, 180 aa, Triticum aestivum
LPNPPPSQPRPPSSLLRPAAKAKLPRRTMATPPATTSSLSLLFAHPHFHHPSTKQRLDRSHLRLPLRAAAHRTRCATEGASASTATKHRRPAEENIREEAARLRGPATTFSAWYEPFPPASDGDPNERYSLDEVVYRSTSGGLLDVRHDMDALARFPGSYWRDLFDSRVGRTTWPYGSGV

SEQ ID NO: 70983 - protein, 247 aa, Triticum aestivum
  misc_feature (195)..(195): Xaa can be any naturally occurring amino acid
  misc_feature (204)..(204): Xaa can be any naturally occurring amino acid
  misc_feature (210)..(210): Xaa can be any naturally occurring amino acid
LDRTSLYKKAGWYRSGIPGISSTHASVVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGXTTIIGGGDXVAAVEXAGLATDEHIRPGLTSWSSRMQLSQCTALPGVLALNKT

SEQ ID NO: 70984 - protein, 235 aa, Physcomitrella patens subsp. patens
MEEGLIYSFVSRGTTVLAEYASVSGNSNRIAAQCLAKLPGGNNKHTYVCDRHTFNFLVEDGFTFLAVADEDFSRQIAFAFLDRVKNDFQHRYQGGRADLAVTYSLNAEFGPRLKEHMDFVAANPEEIKKMSKIKSQVAEVKEIMMVNIEKLLDRNERIDLLVGKTDDLHSNAHVFEKQGNQIRRRAWCAHFKLKLLVLVLIIIVAFIIYLSICRDFICHNPGMPGTTPANVPPAE

SEQ ID NO: 70985 - protein, 394 aa, Desulfovibrio desulfuricans G20
MYEFPRMHRLPPYVFAVVGELKMQLRRQNVDIVDMGMGNPDMPTPQHIVEKLNEAAAKGVNHRYSVSRGIPNLRKAICEWYMRKFDVYLDPDKEAVVTMGAKEGLSHLALAMLSPGDVVFAPDPTYPIHTYAAIIAGADVRRIPIGKGRDFFEDLLAATRQTWPQPKLLMLSYPHNPTTELATLEFFQKVVDFAKEHKMYVVHDMAYADLAFDGYEPPSFMQADGAKDVGVEFYSMSKSYSMAGWRVGFCVGNREMVHALTRIKSYLDYGIFQPIQIAATVALNGPEDCVKEIVDTYRQRRDVLCEGLNRVGWPIEPPKATMFAWAEIPEPFRQMGSVEFSKLLLREAGVAVSPGLGFGHFGDHHVRFALIENPHRIKQAIKGIKRVLSGSSCG

SEQ ID NO: 70986 - protein, 480 aa, Boehmeria nivea
MVKICCIGAGYVGGPTMAVIALKCPAIEVAVVDISVSRITAWNSDQLPIYEPGLDAVVKQCRGKNLFFSTDVEKHVSEADIVFVSVNTPTKTSGLGAGKAADLTYWESAARMIADVSKSDKIVVEESTVPVKTAEAIEKILTHNSKGIKFQILSNPEFLAEGTAIQDLFSPDRVLIGGRETPEGEKAIQALKAVYANWVPEDRILTTNLWSAELSKLAANAFLAQRISSVNAMSALCEATGANITEVSYAVGKDSRIGPKFLNASVGFGGSCFQKDILNLVYICECNGLPEVAEYWKQVIKINDYQKNRFVNRVVSSMFNTVSNKKIAVLGSAFKKDTGDTRETPAIDVCKGLLGGKARLSIYDPQVTEDQIQRDLVMNKFDWDHPLHLQPMSPTTVKRVSVVWDAYEATKGAHGVCILTEWDEFKNLDYKKIYDNMQKPAFIFDGRNIADMDKLREIGFIVYSIGKPLDGWLKDMPAVA

SEQ ID NO: 70987 - protein, 316 aa, Corynebacterium glutamicum ATCC 13032
MSKKAILDIDTGIDDALALAYALGSPELELIGVTTTYGNVLLETGAVNDLALLDLFGAPEVPVYLGEPHAQTKDGFEVLEISAFIHGQNGIGEVELPASESKALPGAVDFLIDSVNTHGDDLVIIATGPMTNLSAAIAKDPSFASKAHVVIMGGALTVPGNVSTWAEANINQDPDAANDLFRSGADVTMIGLDVTLQTLLTKKHTAQWRELGTPAAIALADMTDYYIKAYETTAPHLGGCGLHDPLAVGVAVDPSLVTLLPINLKVDIEGETRGRTIGDEVRLNDPVRTSRAAVAVDVDRFLSEFMTRIGRVAAQQ

SEQ ID NO: 70988 - protein, 472 aa, Physcomitrella patens subsp. patens
MEALASSGVNIARLNMCHGTHEWHRQVIKNCRRLNAEKGYGIVVMIDTEGSEIHMGDLGGVSSAKAEDGEEWCFTIRKFNGPLPAYTLPVNYEGFAEDVQVGDELVVDGGMVRFEVLEKVGPDVKCKCTDPGILLPCANLNLWRDGYLVREKNVTLPTISSKDWVDIDFGISEGVDFIAVSFVKSPDVIKHLKSYVAARSPDRSIGVIAKIEDANSLRCLDDIIRVSDGVMVARGDLGAQIPLEQVPSVQEAIIDACRKLNRPVIVASQLLESMIEYPTPTRAEVADVSNAVRQQADALMLSGESAMGLHPQKAVEVLRGVSVRMEHWSREESHHEKPPLPEISTSDTGRTSEQICNSATQIANKLGADAILVYTRRGYMASLISRNRPDCPIFAFTESRNVMRCMDLQWGVVPFQFAFRKDLESNLLQSLALLKAHCMVRSGNLVVAVSDVSSASQSGTGVLQSIQVHVLS

SEQ ID NO: 70989 - protein, 300 aa, Bordetella bronchiseptica RB50
MTDTPDPAAVLSPAVKAAVLSEALPYIRRFHGKTIVVKYGGNAMTEERLQRSFAHDVVLLKLVGLNPVVVHGGGPQIDDALRRIGKQGTFVQGMRVTDAETMEVVEWVLGGQVQQDIVMMINEVGGKAVGLTGKDGMLIQATKKLMVNKDDPSQPLDIGFVGDITRVEPAVVKALQDDQFIPVISPIGYGEDGTAYNINADVVAGKMAEVLGAEKLLMMTNTPGVLDKGGKLLRSLSAQTIDELFADGTISGGMLPKISSSLDAAKNGVNSVHIVDGRVPHCLLLEILTDQGVGTMISSH

SEQ ID NO: 70990 - protein, 852 aa, Saccharomyces cerevisiae
MFKSKTSTLSYDETPNSNEGDRNATPVNPKEKSQTKHLNIPGDRSRHSSIADSKRSSSRYDGGYSADIIPAQLRFIDNIDYGTRLRKTLHRNSVVSNGYNKLSENDRWYFDLFDRKYFENYLEEPTYIKIFKKKEGLEQFDRMFLAQELKIPDVYKSTTYQGEPAVANSELFKNSICCCTFSHDGKYMVIGCKDGSLHLWKVINSPVKRSEMGRSEKSVSASRANSLKIQRHLASISSHNGSISSNDLKPSDQFEGPSKQLHLYAPVFYSDVFRVFMEHALDILDANWSKNGFLITASMDKTAKLWHPERKYSLKTFVHPDFVTSAIFFPNDDRFIITGCLDHRCRLWSILDNEVSYAFDCKDLITSLTLSPPGGEYTIIGTFNGYIYVLLTHGLKFVSSFHVSDKSTQGTTKNSFHPSSEYGKVQHGPRITGLQCFFSKVDKNLRLIVTTNDSKIQIFDLNEKKPLELFKGFQSGSSRHRGQFLMMKNEPVVFTGSDDHWFYTWKMQSFNLSAEMNCTAPHRKKRLSGSMSLKGLLRIVSNKSTNDECLTETSNQSSSHTFTNSSKNVLQTQTVGSQAIKNNHYISFHAHNSPVTCASIAPDVAIKNLSLSNDLIFELTSQYFKEMGQNYSESKETCDNKPNHPVTETGGFSSNLSNVVNNVGTILITTDSQGLIRVFRTDILPEIRKKIIEKFHEYNLFHLEAAGKINNHNNDSILENRMDERSSTEDNEFSTTPPSNTHNSRPSHDFCELHPNNSPVISGMPSRASAIFKNSIFNKSNGSFISLKSRSESTSSTVFGPHDIPRVSTTYPKLKCDVCNGSNFECASKNPIAGGDSGFTCADCGTILNNFR

SEQ ID NO: 70991 - protein, 463 aa, Candida albicans SC5314
MTKEQIDEPRYKRIAVIGGGPTGLAAVKALSLEPVNFSCIDLFERRDRLGGLWYHHGDKSLVKPEIPSLSPSQEEIVSDNATPADEYFSAIYEYMETNIVHQIMEYSGVAFPANSKKYPTRSQVLEYIDDYIKSIPKDTVNISINSNVVSLEKVNEIWHIEIEDVIKKTRAKLRYDAVIIANGHFSNPYIPDVPGLSSWNKNYPGTITHSKYYESPAKFRDKRVLVVGNSASGVDISIQLSVCAKDVFVSIRDQESPHFEDGFCKHIGLIEEYNYETRSVRTTDREVVSDIDYVIFCTGYLYALPFLKQERNITDGFQVYDLYKQIFNIYDPSLTFLALLRDVIPMPISESQAALIARVYSGRYKLPPTEEMERYYQLELKEKGRGGKFHNYKYPRDVAYCQMLQTLIDEQGLHTPGLVAPIWDESLIKKRSETRAEKNARLKNVVEHVKRLRAEGKDFSLLE

SEQ ID NO: 70992 - protein, 324 aa, Saccharomyces cerevisiae
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 70993 - protein, 497 aa, Bordetella bronchiseptica RB50
MTAPAAVPAPQSPPKVKIPIGLIAGIIAMVVVLLLPLPAELPPAGHRMLAILAFAVVVWITEAVSYEASAIMITTLMAFLLGTAPNVKNPDVLYGTSAAISMALTGFSNSALALVTGALFIAAAMTFTGLDKRIALVTLARVGTSTRRILLGAIAVTIVLSLVVPSATARSAAVVPIMLGVIAAFGVDKRSNIAAGIMIIVAQATSIWNVGIQTAAAQNLLTVGFMDKMLGERVAWSDWLIAGVPWSLLMSAVLIFVVLRLLPPESDAIAGGKEAVEASLRELGPMTSAQKRLMLVSIMLLLFWSTEGKLHKFDTTSTTYFGLVLLMLPRFGVMTWKDVQTRIPWGTVIVFGVGISLGTALLTTQAGQWLGAQVVTHTGLDHLGPLGIFAILSAFLILIHLGFASATALTSAMLPILIAVLQTLPGDFNRLGMTMLLGFVVSYGFILPINAPQNMVALGTETFTAKQFAKVGIVLTIVGYLLMLLMSVTYWRWLGWM

SEQ ID NO: 70994 - protein, 264 aa, Methylococcus capsulatus str. Bath
MVRRTIWAALALICILSFSRPAGAAGCPSEPDWSYSGANGPSNWNTLFPIQCGTGSRQSPFDIVTANVTKADLPKLSFHYNVADVLYLDHDDQVAFNHGNGNFIKIGKDRFDLINIHEHTPSEYTLNGQQFPMEIHLVHQNKQTGQLAVIGVFVVTGKENKGVKEAPSFNDPSTVALKLTGLIPKKRNYVRFNGSLTTPGENIALPRCAEGVLWTEMLTPIAMSSDQIAAFQDSAQVCWGTSITNRPLQPSNNRFLLSPRNVDP

SEQ ID NO: 70995 - protein, 197 aa, Triticum aestivum
DGPLEPPPASTLISDTPDESLANYFGGAASIGSVSSGSMVGRAHPSTETTAASHTPLIMPSAAQSHQIHPPFGGSSAPPLPLQDTNAHASHSTNLVTPAFFAPPSSSSASLAPPISSMMPTAPPLHSTSSSTQHPQYGHGAPLLQPFPPPSPPPSFAPAHNDGSVISRDKVKDALLRLVQSDQFIDLIYRELQNAHM

SEQ ID NO: 70996 - protein, 193 aa, Bacillus anthracis str. Ames
MNAIPYVVEQTKLGERSYDIYSRLLKDRIVIIGSEINDQVASSVVAQLLFLEAEDAEKDIFLYINSPGGSTTAGFAILDTMNLIKPDVQTLCMGFAASFGALLLLSGAKGKRFALPNSEIMIHQPLGGAQGQATEIEITAKRILKLKHDINKMIAEKTGQPIERVAHDTERDYFMTAEEAKAYGIVDDVVTKK

SEQ ID NO: 70997 - protein, 386 aa, Novosphingobium aromaticivorans DSM 12444
MNSVPSLPGQSVAAVVVAGGKGLRTGGPVPKQFVIWRGKPLLRHCVEALEAAGIAPIVVAIPAGWDEAATQALAGISMVRLVHGGATRQESVKAALEVLEGDAPARVLIHDAARPDLPGSVIERLLTALDKRTGAIPVLPVVDSMVRGSGDAMGETVAREDLYRVQTPQAFHYPAILAAHRAWQGEALAGDDAQVAMRAAHEIALVEGDEALRKVTFASDLEEQSMSVIPRTGMGFDVHRLVEGEELWLCGVNIPHGKGLSGHSDADVAIHALVDALLGAIAAGDIGDHFPPSDPQWKGASSDRFLAHAGTLVTEAGYRIANVDVTIICEAPKIGPHKAAMRETLARILGIDSALVSVKATTTERLGLTGRGEGIAAQAVATVVSG

SEQ ID NO: 70998 - protein, 220 aa, Bacillus anthracis str. Ames
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 70999 - protein, 328 aa, Exiguobacterium sibiricum 255-15
MQLFEMLETKVKAHQPTIVFPEGIDARVLGAAVRLKKDGLVTPIVIGPRGQIEETASANNIDVADLETIDPASYEGIEELVASFVERRKGKATEEQARALILKDVNTFGTMLVHTGKAEGLVSGAMHATGDTVRPALQIIKMQEGYKKTSGVFIMVRDDEQYVFADCAINIAPDANDLAENAIASAKTAKTFGIDPKVALLSFSTKGSAKSPETERVVEATCLAKERAPELSIDGELQFDAAFVPSVAKSKAPESDVAGQANVFIFPSLESGNIGYKIAQRLGGFEAIGPILQGLNKPVNDLSRGCNEEDVYKLAIITAAQAVEERQA

SEQ ID NO: 71000 - protein, 250 aa, Triticum aestivum
  misc_feature (192)..(192): Xaa can be any naturally occurring amino acid
  misc_feature (233)..(233): Xaa can be any naturally occurring amino acid
  misc_feature (240)..(240): Xaa can be any naturally occurring amino acid
NAASVIWSQHPTSIAARSLQLHNRLLNEASVIFKHQSILKIRRLLQQARASPRAEFGTRPHLLPPRNSLLLPEPKLSPVATQNKMQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAXGIVTERDYLRKIIVQGRSSKSTKVGDIMTEENKLITVKPEXRVLKAMXLMTDKRSGIR

SEQ ID NO: 71001 - protein, 337 aa, Bradyrhizobium sp. ORS278
MTVLVTGGAGYIGSHMVLALAEAGESVVVIDNLSTGFSAFVPSEVPLFIGDAGDENLVDGVISQHGVDSIIHFAGSVVVPESVRDPLLYYRNNTMTTRSLLNAAVKRGVSRFIFSSTAAVYGNPAQVPVPETAPTRPTSPYGSSKLMAEIMLHDTAAAYELNYAVLRYFNVAGADPQGRIGLATVGATHLMKIAMEVATGQRAKIDVYGTDYSTPDGTAVRDFIHVCDLVQAHRAALAYLRAGGPSVTLNCGYGRGYSVLETIEAVRRASGRAIPVQTAPRRPGDIMSMVADTSRLRATLDWTPAYDNLDTIAAHALAWEHKLFLERHSHGEQRASA

SEQ ID NO: 71002 - protein, 470 aa, Pseudomonas fluorescens Pf-5
MPVRGNQETNREAKTVIKTLNHLPHPTLDNATLASHFSDLAPPLNARQAHLEASRCLYCYDAPCVNACPSEIDIPSFIRNIHTDNVQGAAQKILSANILGGSCARVCPTEILCQQACVRNNAQECAPVLIGLLQRYALDNAHFTQHPFQRAAPTGKRIAVVGAGPAGLSCAHRCALHGHEVVVFEARDKAGGLNEYGIAKYKLVDDFAQQELEFLLGVGGIEIRHGHKLGANLSLTELHQQFDAVFLGLGLAASKQLGLEHEDAPGLLAATDYIRELRQADDLSQLPLAERCIVLGAGNTAIDMAVQMARLGASDVNLVYRRGVEDMGATEHEQDIAKANQVRLLTWAAPQQVLLDDQGRVRGMRFARTRMLEGRLQTTGDTFELAADAIFKAIGQSFDATALSDPLARELQRSGERIQVDEHLRTSIPGVYAGGDCVSLGQDLTVQAVQHGKLAAEAMHAQLMLNVEAA

SEQ ID NO: 71003 - protein, 235 aa, Vibrio fischeri ES114
MKKLFTTLAVLSALSATPFASASEWGYTGDTGPNHWHGVCQTGVNQSPIDITNAIESELEPITFNYGQAGENIVNNGHTVQVNIKSPQSIQVEGKTFSLLQLHFHAPSENLIAGHSYPLEMHLVHADKDGNLAVVGVMFKEGKANPELAKIWSQMPGSGEVTLDKKLTLTNLLPNDQAYYRFNGSLTTPPCSEGVTWLVMKNPIEISSEQLAQFRELYNGNNRPTQAINARPILK

SEQ ID NO: 71004 - protein, 274 aa, Oryza sativa
MAEHLASIFGTEKDRVNCPFYFKIGACRHGDRCSRLHNKPSVSPTLLLSNMYLRPDMITPGIDAQGNPIDPEKIQADFEDFYEDIFEELSKYGEIESLHVCDNFADHMIGNVYVQFREEDQAARALQALTGRYYSGRPIIVEFSPVSDFREATCRQYEENSCNRGGYCNFMHVKEIGRDLRKRLFGHLHRSRRSHSHGRSRSPSPYHYRRDYDRRSSSRSRDHDDYYRGGSHDYYRGGSRRSSERHRSSYDSDGSEERRAQIEQWNREREAAQV

SEQ ID NO: 71005 - protein, 154 aa, Geobacillus kaustophilus HTA426
MRIIEGNLVGTGLKIGIVVSRFNEFITGKLLSGAIDGLTRHGVSDSDITVAWVPGAFEIPLVAKKMAESKQFDAVITLGAVIRGATSHFDYVCSEAAKGVSHAALASGVPVIFGVLTTDTIEQAIERAGTKAGNKGWEAAVSAIEMANVLRTLA

SEQ ID NO: 71006 - protein, 395 aa, Sulfolobus tokodaii str. 7
MQGYLKCLDCGSEYPIQQDIITCPKCGGLLEIIVEPKKDFSFSKLKGKGVWRYRELIAGEYKHIVSLNEGNTPLIASSTNKNLYFKFEGANPTGSFKDRGMTVAISSAKSLNYKVVVAASTGNTAASAAAYASRAGLRSYIVLPKGKVALGKLAQSILYGTTILEVDGSFDVAMNSVMKLYRELKIVYPLNSFNPWRLEGQKTIAFEIVEDIGVPDNVIVPVGNAGNIYAIWKGFVELMNIGVTDKVPRMIGIQAEGAAPIAKALEKGLDKPEFIDSPETVASAIRIGKPVNWKKAIKAIKSSNGFATYVSDSEILEAQKELARREGIGAEPASAASYAGYLKLVNSGKIDKSEKTVLILTGHALKDPDAMIKAESRRILVNPEHINEIILSDLK

SEQ ID NO: 71007 - protein, 72 aa, Thermoplasma volcanium GSS1
MIIPVRCFSCGRVIASDYGRYLRRINEIRSEGREPTAEEIEKIFDDLGVERYCCRRMIISHVDLINEIMPFS

SEQ ID NO: 71008 - protein, 370 aa, Desulfovibrio desulfuricans G20
MNAYTEIPMVPGPTTLHPDALAAMGRDYGSGQIETAYLQLYADTQKLLGTLAGTGNDMVIMTGEGMLALWGALKSCLAPGDRVLSVATGVFGDGIGDMAAGLGCEVRKITLPFNATLDDLTAVEEAVDRFRPRMITAVHCETPSGTLNPLAELGRLKAAMNVPLFYVDAVASLGGAPVMADDWHVDLLLGGSQKCLSAPPSMAFVGVSPAAWEAVEQRAYQGYDALGPFRTVHSDGRCPYTPYWHGTAALHAAAAAIVAEGTEQVFARHRNVARQCRDGLQEMDIRLFTAENAVNSPTVTAALVPRGWECAAWLQALAARGLRAAGSFGPMAGKVFRLGHMGTQAHPRLMEKALQVMAQVLEQGPAASRR

SEQ ID NO: 71009 - protein, 447 aa, Sulfolobus tokodaii str. 7
MKVIKIGGSIQKDEKDYELILDKLKKEIDYNDKNIIVTSAIKNITNQLLDIIKNTDKAMDIVTDIYDRHVRLLSKLTNGIEFERSFGEISKLADELFKIAWSVRVLDEVTPRVKDYILSFGERFAVILLSAFLRSNNIQSSYILDPPLITDENFGEANVLLQQSKENLTKKIDGINGNVIVIPGFIGKSTQNKFTTIGRGGSDYTATIVGKILGAKEVKLITEVPGIMTADPKKIPQAKTIPRLALEEAIELSQLGAKKLHPRTFDPIFNTNLKVVIEGLYEEGSTVIEGNCTKDDILKGIATRNNLELITIESTNIVGKIGSAATIMSEARNANVNLIAISQPVSETVIQLVIESQDKDRLIERLNNLNNLIEDIQSRKVSAISIVGCGLRNKEISAKVINKASSLDPIFISRGLKGVSLTFIVDEKDENSLAKELHEVILEWQTK

SEQ ID NO: 71010 - protein, 509 aa, Streptomyces coelicolor A3(2)
MANSTHTPAERAHRTIHAGGEWLAASSGATREILDPADAVAFAVVAEGDEKDTDLAVAAARRAFDAGDWPHTPVAERAALLRRVAGLLVRDREKLGLLESRDAGKTVEEGRVDIDCVADAFRYFADLVAGEAPGRVVDAGSPEVHSVVVHEPVGVCAMITPWNYPLLQASWKIAPALAAGNTFVIKPSEITPMTTIALIDLLVEAGLPTGVANIVTGPGHTVGARLAEHPDVDLVSFTGGLTSGVKVAQAAAVTVKKVALELGGKNPNVVFADACATEEGFDTAVDQALNAAFMHSGQVCSAGGRLIVEESVRERFVAELARRAERIRLGRGTEEGVECGPLVSAQQRAKTEDYVASALAEGAELRCGGKRPEPSPQRPESGYFYEPTVLDHCHREMRVVREEVFGPVLTVETFRTEDEAVALANDTEYGLAGAVWTADAGRARRVAGRLRHGTVWINDFHPYLPQAEWGGFGKSGVGRELGPAGLAEYRESKHVYQNLAPKPVRWFSG

SEQ ID NO: 71011 - protein, 417 aa, Zea mays
  misc_feature (225)..(225): Xaa can be any naturally occurring amino acid
MAMSASSSSRALLRRIGGALLRRSFSSSSAAAAAGYHVAGGPSYMRGAVFWEPGRPLTLEEFRMPRPKAGELLIKTKACGVCHSDLHVLKGELPFSTPCVVGHEITGEVVDHGTHTPAEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGXALRHAAEMRPGDSVAVIGVGGVGSSCLQIAKAFGASQVIAVDVLDEKLQNATTLGATHTVNAAKADAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIM

SEQ ID NO: 71012 - protein, 281 aa, Streptomyces griseus subsp. griseus
MIDDFLYGTAGHTGPPAEVEAAVRAAAAAEIMPRHRKLAAHEIIEKSGPHDLVTAADRLAEEHLTAALTKLLPGSVVVGEESVHADPAVYEALDGDAPVWIVDPVDGTRQFVRGEAGFCTLVALALHGEVHASWTYAPVRGEMAIAVRGRGATLNGAPIRSGAPAPGAVLKVAMSHPDYTTEAQKRALLGLRTESIAARPCGSAGLEYLAVARGSLDAVAFNWEYAWDHAAGLLLVTEAGGAQSTLSGAPFRIAGGNDLPFTAARDEATAQRVLAALRTGG

SEQ ID NO: 71013 - protein, 370 aa, Physcomitrella patens subsp. patens
MALKSGIVGLPNVGKSTLFNALVENGKAQAANFPFCTIEPNVGVVAVPDPRLGVLSQLSKSQKTVPTSVEFVDIAGLVKGASQGEGLGNKFLSHIREVDCIVQVVRCFEDDDIVHVNGKVDPEVDIDIINLELAFADMSQIEKRLERLKKGRAKDPQVKAKEEIEIEALKRINEALLNGKPARMVPLSEEENKAVLQLCLLTMKPVIFAANVSEADLADASGNPHVDKVKKCAADLNAEVVVVSAQVEAELTELDAEERTDYLQSIGVTEGGLGSLVRATYNLLGLRTYFTSGEKETRAWTILAGMTAPQAAGVIHTDFERGFIRAETIAYDDYVQAGSYPAAKDKGLMRAEGKDYIVKEGDVMLFRFNV

SEQ ID NO: 71014 - protein, 306 aa, Sulfolobus tokodaii str. 7
MLKGKSLLCLLDFSKQEIEKMMEVSFQMKNFHMLRSVPRSLDGKTVAMLFEKPSTRTRVSFETAIRLLGGNPIVLNKSDIQLSRGEPVEDTARVLGRFVDGIAARVLKHETLELLAKYSNKPTINLLSDLSHPLQALADFMTIKEKFGEYTSLTFVGDGGDNVLVSLMAFVAKMGLEIKIASPKEFKPRDDIMKRIEEEAEKSGAIIEFYEDPYEAVRGSKVVYTDVWVSMGQESIAEKKKELLRNYRVSVDLMRYASKDAIFMHCLPAVRGEEVENEVIDGPKSAVWDQAENRLYTAMSVLSLLL

SEQ ID NO: 71015 - protein, 358 aa, Mannheimia succiniciproducens MBEL55E
MSTYNVAVLPGDGIGPEVMAEAIKVLDKVQAKFGFKLNFTQYLVGGAAIDAKGEPLPAETLQGCDNADAILFGSVGGPKWTHLPPDQQPERGALLPLRKHFKLFCNLRPATLYKGLEKFCPLRADIAAKGFDMVVVRELTGGIYFGQPKGRDGEGSDTRAFDTEVYYKYEIERIARAAFDAAMKRRKQVTSVDKANVLQSSILWRETVAEIAKEYPEVQVENMYIDNATMQLIKAPESFDVLLCSNIFGDIISDEAAMITGSMGMLPSASLNEEGFGLYEPAGGSAPDIAGKGIANPIAQILSAAMMLRYSFNLNEAATAIENAVQKVLADGHRTGDLADNSTPVSTAEMGTLIANAI

SEQ ID NO: 71016 - protein, 520 aa, Zea mays
MLCLSLCAPHLHLHLPRSPTARPAAATCRNARCIGVTLCLRMPTTPEERRQKRGLAQFLDLSAAPTLTPPAPTPVHLTPAAKRRGALREMRRVWWVCGVGYWVQGFRCFPWLALNFHLTRGMGLSPAGLQLLQNAGSLPLVAKPLFGVLSDAVYIGRAHRIPYISLGVWLQLIAWGVLATIPVTGDAFPTLMACILIGNLGASVTEVVSDAVVTEFSRTQKAGVLQSYAFVALAAGSLLGNLSGGYILLKTQEPKIMFTAFSVLLGFQLALSLSTKETLPSSRGNSRNRLVKSSLAANFRKQFSNLMTAIREERILYPLAWIMTSFAVVPVLSGTMFCFQTQYLNLDPSVIGLSKVVGQVMVLSLTVLYNRYLKRIPLRCLTTGLQILYALAVLSDLILVKQVNLVLGIPNEIHVLCFSALAEALAQFKVLPFSVLLSSLCPPGCEGSLFAFFTSGLVLSAILSGVFGVGLSTLIGVSSVDYSSLPLGILLQSLAALLPLGWISFVPEKWTADDTVVIKR

SEQ ID NO: 71017 - protein, 326 aa, Nocardia farcinica IFM 10152
MTASWIENQKNLMLFSGRAHPELAEQVAKELDVHVTPQTARDFANGETFVRFEESVRGSDAFVLQSFPAPVNQHLMEQLIMIDALKRGSAKRITAVLPFYPYGRQDKKHRGREPISARLVADLLKTAGADRIITVDLHTDQIQGFFDGPVDHMHALFQLSEHVRSNYSMENITVVSPDAGRVKVAEKWANALEGAPVAFIHKTRDPLVPNQVKSHRPVGDVDGRTCILIDDMIDTGGTIAEAVRVLREAGAGDVVIAATHGVLSSPAAERLAACGAREVVVTNTLPITEDKKFPQLTVLSIAPLLARTIREVFENGSVTGLFNGNA

SEQ ID NO: 71018 - protein, 196 aa, Helicobacter pylori
MLVTKLAPDFKAPAVLGNNEVDEHFELSKNLGKNGAILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHQGVAEYLKENSI

SEQ ID NO: 71019 - protein, 702 aa, Arabidopsis thaliana
  misc_feature (558)..(558): Xaa can be any naturally occurring amino acid
MGSASIGYQFGISARFYGNFNLSSDITVSSLPCKLDVSIKSLFSAPSSTHKEYSNRARVCSLPNTDGYCDEKFETPILDSIETPLQLKNLSVKELKLLADEIRTELHSVLWKKTQKSMNPSFAAIELTLALHYVFRAPVDNILWDAVEQTYAHKVLTRRWSAIPSRQNSGISGVTSRLESEYDSFGTGHGCNSISAGLGLAVARDMKGKRDRVVAVIDNVTITAGQAYEAMSNAGYLDSNMIVILNDSRHSLHPNMEEGSKASISALSSIMSKIQSSKVFRKFRELAKAMTKRIGKGMYEWAAKVDEYARGMVGPTGSTLFEELGLYYIGPVDGHNIEDLVCVLREVSSLDSMGPVLVHVITEGNRDAETVKNIMVKDRRTYSDCFVEALVMEAEKDRDIVVVHAGMEMDPSLLTFQERFPDRFFNVGMAEQHAVTFSAGLSSGGLKPFCIIPSAFLQRAYDQVVHDVDRQRKAVRFVITSAGLVGSDGPVQCGAFDIAFMSSLPNMIAMAPADEDELVNMVATAAYVTDRPVCFRFPRGSIVNMNYLVPTGLPIESXIGRGRVLVEGQDVALLGYGAMVQNCLHAHSLLSKLGLNVTVADARFCKPLDIKLVRDLCQNHKFLITVEEGCVGGFGSHVAQFIALDGQLDGNIKWRPIVLPDGYIEEASPREQLALAGLTGHHIAATALSLLGRTREALLLMS

SEQ ID NO: 71020 - protein, 398 aa, Geobacillus kaustophilus HTA426
MMFDTIEAALSALKNGEVIIVCDDEDRENEGDFVVLAEKATPDVINFMITHGRGLVCVPITEELAERLELEPMVTHNTDAHGTAFTVSVDYKTTTTGISAYERAATIQALLDPNVKASDFKRPGHVFPLIAKKGGVLRRAGHTEAAVDLARLCGAKPAGVICEIIKEDGTMARVPDLRQIADQFGLKMITIKDLIAYRSQREKLVKREVDVWLPTEFGEFRAIGYTNVLDGKEHVALVKGEIIPDEPILVRVHSECLTGDVFGSYRCDCGPQLHAALRQIEAEGRGVLLYMRQEGRGIGLMNKLRAYKLQEQGYDTVEANEKLGFPADLRDYGIGAQILKDLGVTKMRLLTNNPRKIAGLKGHGLEVVERVPIQMPAKKENEKYLRTKHEKLGHMLHF

SEQ ID NO: 71021 - protein, 552 aa, Exiguobacterium sibiricum 255-15
MFSSTERTAWLEEMGQELLDVLVIGGGITGAGILLDAQSRGMRTGLIEMQDFAEGTSSRSTKLVHGGLRYLKQFEIKLVAEVGKERAIVYENAPHVTTPEWMMLPLVEGGTFGSFSTSIGLRVYDQLAGVRRHERRTMLSKEETLRYEPLLRSEHLVGGGRYVEYKTDDARLTVEVLKAAVGYGGRAVNYTKAESLVYHNGKVVGVEVQDVLTGKTYTIRAKKIINATGPWVDELREKDGSKSGKSLHLTKGIHLVIDQAHFPLQQAVYFDVPDGRMIFAIPREGKTYVGTTDTNYQGDILEPGVTEEDRDYILDATNKMFNVDLQPEHVESTWSGLRPLIHEDGKDPSELSRKDEIFVSKSGLMSIAGGKLTGYRKMAERIIDMVADQFKEEENRIYLASRTHDILLGGGHPDGSKGFARYLKEQQPKGEALGLSPKEATWLIQRYGTDVERVFELIRSRGSEAERYQLPLHWFGGLLYGLEAELVMQPGDFLNRRASAVFFDFPNAEKYADGVLALMRSELGWSAEEEAKANASIQREFDAVRIKTSLPS

SEQ ID NO: 71022 - protein, 542 aa, Citrus x paradisi
MDQAISSVVRKLQMVNTSDHNSVVSINIFVALPCASIVIGHLLEESRWMNESITALLIGVCAGVIILLTTGGKSSHLFVFSEDLFFIYVLPPIIFNAGFQVKKKQFFRNFITIMLFGAIGTLVSCTIISLGVIQFFKKLDIGTLDIGDYLAIGAIFAATDSVCTLQVLNQDDTPLLYSLVFGEGVVNDATSVVLFNAIQSFDLTHINTRSAFQFIGNFLYLFFTSTLLGVIGGLLSAYVIKKLYFGRHSTDREVAIMVLMAYLSYMLAELFYLSGILTVFFCGIVMSHYTWHNVTESSRVTTKHTFATLSFVAEIFTFLYVGMDALDIEKWRFVKGSPGTSVAASAMLMGLIMAGRAAFVFPLSFLTNLAKKSPTEKISIKQQVIIWWAGLMRGAVSMALAYNQFTRSGHTQLRENAIMITSTITVVLFSTVVFGLMTEPLIRLLLPHPKHTTNHILSDPSTPKSLSQPLLEEGQQDSYADLVGPTVPRPGSLRALLTTPTHTVHYYWRKFDDAFMRPVFGGRGFAPFVPGSPTERSVRGGQ

SEQ ID NO: 71023 - protein, 477 aa, Exiguobacterium sibiricum 255-15
MSLTRKKDVSAMIAASQRNSGLARNLGAMDLTFLGIGAIIGTGIFVLTGTGALTAGPGLIVSFILSAIACGLAALAYAEFASTIPVSGSVYTYTYATMGEIFAWIIGWNLILEYGLASSAVAAGWSGYFQSLLGGFGIHLPTALSAAPGAVEGAKTFFNLPAFLILLAITGLLSMGIKETKRVNNIMVIIKLAVVVLFIVVGVGYVEPTNWAPFTPFGWGGVFSGAAIVFFAYIGFDAVTSAAEEVREPQKNLPRGIIGSLAVCTVLYVIVAAIMTGIVPYQKFAGVDHPVSLAIQMAGQNWVAGFIDLGAILGITTVILVMTYGMVRLAFAISRDGMFPKVFSEVHPKYKTPFKATWMIGLGSATVAGLVPLDVIANLVNMGTLAAFVLISVAVLILRKTQPDLPRAFKCPGMPYVPIAAIASCLFLMFNLKLETWIAFFIWLAIGLVLYFAFARKNSNLEPGNMPAAELAASDDK

SEQ ID NO: 71024 - protein, 314 aa, Glycine max
MAEHLASIFGTEKDRVNCPFYFKIGACRHGDRCSRLHTKPTISPTLVLSNMYQRPDMNMNIITNPDQPQPQSLDPDKVQDHFDDFYEDLFEELSKYGPIQSLNICDNLADHMVGNVYVQFREEDHAANALMNLTGRFYSGRPIIVDFSPVTDFREATCRQYEENVCNRGGYCNFMHLKKISRDLRRKLFGRNRRWNGRSGSRSKSPPRNRNHGEHLHSGRGSGRRDFDRSHGHHGRRPRSRSPRYRGKRSRSPVGRDRSPPIRENSAERRAKIEQWNREKEQGETSNKNNTKSNDDYQEQSVAQNGSESGNHQI

SEQ ID NO: 71025 - protein, 315 aa, Exiguobacterium sibiricum 255-15
MAKAIFAGGCFWCMVKPFHKYDGVEQVISGYTGGHTENPTYKEVCSETTGHLEAVEVTYDPSVITYDELLEIFWRQIDPTDGGGQFNDRGQSYEPAIFYVDEDQKQAAERSKAALDASGRFSKPVAVDIRPAKPFWPAEEYHQDYYKKNPFRYQMYSVGSGRAKFVKEAWKDQGKEQELKQRLTPIQYKVTQENGTEPAFRNEYWDEERPGLYVDIVDGTPLFTSKDKFNSNCGWPSFAKPISEDKMEVELDTSHGMTRTEVRSANADSHLGHIFDDGPTELGGLRYCINSAALRFIPVEELDSAGYGEYKKHFE

SEQ ID NO: 71026 - protein, 543 aa, Exiguobacterium sibiricum 255-15
MTCGELSFTTVEWGASFYYVAFSSSFWKVRALFVFSKSVLSKNLNKREANEMNTLQPQRKLDSTEEGLKRGLQARHMSMIAIGGAIGTGLFIASGASVAAAGPGGALLSYAIVGLMVYFLMTSLGEMAAYMPVAGSFSTYGAKFVDPSFGFALGWNYWYNWAVTIAVELVAAQIVMSYWFPDVPGFYFSALFLLLMIGLNYFSVKGFGEAEYWFAMIKVVTVIIFLIVGVAMIFGVFTSEAPVGFKNFALGDAPFVGGIPAVIGIILVAGFSFQGTELVGIAAGESEDPKKNVPKAVKQVFWRILLFYVFAIFVIGMLIPYTSPNLVSNDITDVAVSPFTLVFEKAGLAFSAALMNAVILTSVLSAGNSGMYASTRMLYTLARQGDAPKLFAQVSKNGVPRNALLATGAIGALCFLTSMFGGQVYLWLLNASGMTGFIAWLGIAISHYRFRKGFLAQGHSLSDLPYVAPAFPFGPLFAFGLCFLVIVGQNYAAFLADQIDWVGIAATYVGIPLFLAFWLGHKFKNRTSVVPYEEMEFPEHPRP

SEQ ID NO: 71027 - protein, 304 aa, Oryza sativa Japonica Group
MAEHLASIFGTEKDRVNCPFYFKIGACRHGDRCSRLHNRPTVSPTIVLANMYQRPDMITPGVDAQGQPIDPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPRHRRGNRDRDDFRRERDGYRGGGDGYRGGGGGGGGDGYRGGDSYRGGGGGGRRGGGSRYDRYDDGGRRRHGSPPRRARSPVRESSEERRAKIEQWNREREEKP

SEQ ID NO: 71028 - protein, 545 aa, Zea mays
LREAGGSSIGSDRARAMGLAWMVAAAVAAVLASWAFNALVHLVWRPYAITRRLRAQGVRGPPYTFFTGSLGEIKRLRGEGAAVTLDVDDHDFIPMVQPHLRKWIALYGRTFVYWTGARPNVCVADVNVVRQVLFDRTGLYPKNLMNPHISRLLGKGLVLTDGDDWKRHRKVVHPAFNMDKLKLMTATMSDCTRSMISEWDAQLQKEESGRDGHGHGHVEVELSSRFEELTADVISHTAFGSSYSEGKRVFLAQRELQHIAFSTIFNVQIPALKYLPTEKNLRTRKLDRQVRAMLMDIIEARLASKDTAGGYGNDLLGLMLEACAPPPEHHGETAPTTLSMDEIVDECKTFFFAGHDTTSHLLTWATFLLSTHPEWQHRLRDEVRRECGDDDEVPTGDALNRLKLVNMFLLETLRLYGPVSLIQRKAGSDLDLGGIRVPEGAILTIPIATIHRDKEVWGEDAGEFRPERFENGVTRAAKHPNALLSFSSGPRSCIGQNFAMIEAKAVVAMILQRFALELSPKYVHAPMDLITLRPRHGLPMLLKRL

SEQ ID NO: 71029 - protein, 279 aa, Thermoplasma volcanium GSS1
MFIKIFLITYRYKLTVISIIGGGTIGSSIAIPLKRSGFEVIVTRRNTAVLKHLESYGISVMSDNKTASKEADVVFLTLKPVDIIPEVRKIEENIRGKLLISMAAAIPLKLIKDAAPHSIVVRAMTNIAAKVGAGFTPFCVDDGDQEVAKRASSILSALGEVYLVEEKYMDALTALSGSGPAYILTIIEAMMYGGLKLGLPRDLALKASYQTVMGSAKLLAESGEHPSELKEKVITPGGTTIDGIYELEDARVRTAIMKAIEVSTMKANKISESIKKLEQ

SEQ ID NO: 71030 - protein, 587 aa, Debaryomyces hansenii CBS767
MPEKELNYIRSADAATSNEKDGGVFVDAFEASDNKAPMGKFEKFRDSFRRFDDTELGIDPNLSEVERAAIITANSPLSRSLKNRHLQMIAIGGSIGTGLFVGSGTTLRTGGPAGILIAYIIIGVMIYCTVQALGELAVTFPVSGAFVTYNTRFICPSWGFAMAWNYALQWLVVFPLELVAASITIEYWNLSINSAAFVAIFYVLIVSINFFGVKGYGEAEFIFSLIKVTAVMGFIILGIIIAAGGVGPQGYLGGRYWQHPGAFANGFKGVCTVFVTAAFAFAGTELVGLASAESANPRKSLPKATKQVFWRIVLFYVISLTLVGLLVRYDDERLLSDSSVDAKASPFVIAIKNAEISGLPSVMNVVIMISVLSVGNSSVFASSRTLAALAAARQAPKIFGYIDKKGRPLVGIIVQCTFGLLCFVSASDKQGEVFNWLMALSGLSSIFTWGSINFCHIRFRRALKVQGRDTSEIAYTSQVGLIGSYIGMTLNILVLIAQFWVALFPLGSSPDPSAFFQSYLGFPVVLFFYICHKLYRRNWRLYIRAKDIDIDTGRRDLDLDLLRQELAEERAFIAAKPFYARVWNFWC

SEQ ID NO: 71031 - protein, 220 aa, Arabidopsis thaliana
MPVKWVLHWQPNQGSTVSSQILNEATQCVESINGVKEGRWKATLNYYKPMLKDQANQLEFPRDFLGISLADQPNKYYFIIRTQRIVLEADSSIQLIMEKLQSYKSKVALYFDGFQYQLGDFRLRVGKVVPTHSENVRGIVMEVEYLPISSMEIARKVMEEFLEIWNEALAKRSLPGKFVNKDLNFGEFGLGDNYTPQHTAVRNYALVMAHMIATVQAVSG

SEQ ID NO: 71032 - protein, 451 aa, Saccharomyces cerevisiae
MLRTRLTNCSLWRPYYTSSLSRVPRAPPDKVLGLSEHFKKVKNVNKIDLTVGIYKDGWGKVTTFPSVAKAQKLIESHLELNKNLSYLPITGSKEFQENVMKFLFKESCPQFGPFYLAHDRISFVQTLSGTGALAVAAKFLALFISRDIWIPDPSWANHKNIFQNNGFENIYRYSYYKDGQIDIDGWIEQLKTFAYNNQQENNKNPPCIILHACCHNPTGLDPTKEQWEKIIDTIYELKMVPIVDMAYQGLESGNLLKDAYLLRLCLNVNKYPNWSNGIFLCQSFAKNMGLYGERVGSLSVITPATANNGKFNPLQQKNSLQQNIDSQLKKIVRGMYSSPPGYGSRVVNVVLSDFKLKQQWFKDVDFMVQRLHHVRQEMFDRLGWPDLVNFAQQHGMFYYTRFSPKQVEILRNNYFVYLTGDGRLSLSGVNDSNVDYLCESLEAVSKMDKLA

SEQ ID NO: 71033 - protein, 323 aa, Triticum aestivum
  misc_feature (193)..(193): Xaa can be any naturally occurring amino acid
  misc_feature (283)..(283): Xaa can be any naturally occurring amino acid
NKFVQKSRLVPVRNSRDIGDPRVRGRVGGVKMLEGHSNCNGEDLISEVSTIGRIHHVNVVHLLGFCSEDMRRALVYEYMPRGSLDKYIFSAEKSFSWDKLIEIALGIARGINYLHQGCEMQILHFDIKPHNILLDSNFVPKVADFGLAKLYPRDKSFVPSRALRGTVGYIAPEMMSRSFGVISSKSDVYSFGXMLLLEMAGGRRNADPNTANSSQAYYPSWVYDRLTAQEVCEITPVDDMHELERKLCIVGLWCIQMKSHDRPTMSEVIEMLEGGFDGLPMPXQPFSCVVEHTAVPDSYPLVSGLTEIPGEDEISDSYVPRVL

SEQ ID NO: 71034 - protein, 223 aa, Mycobacterium tuberculosis CDC1551
MCHGGTWAGDYVLNVIATGLSLKARGKRRRQRWVDDGRVLALGESRRSSAISVADVVASLTRDVADFPVPGVEFKDLTPLFADRRGLAAVTEALADRASGADLVAGVDARGFLVAAAVATRLEVGVLAVRKGGKLPRPVLSEEYYREYGAATLEILAEGIEVAGRRVVIIDDVLATGGTIGATRRLLERGGANVAGAAVVVELAGLSGRAALAPLPVHSLSRL

SEQ ID NO: 71035 - protein, 207 aa, Glycine max
LKPWYWWSWPVLPLGLQWHEQRRQTLGYGAELAVILIQSAIYVGVIAMTRLARPSFSKLCYRRSDKSITLVHNSLKLVALWCILAAYVTPFFIIPHTVHPLLGWILYLLATFALCSIAINIFMLPMLPVLVPWLGIVGVLMVMAFPWYPDGVVRALFVFAYAFCSAPFLWASMVRIVQGLQLSLEREAFLPARLGEFSPNSWFNKLY

SEQ ID NO: 71036 - protein, 514 aa, Saccharomyces cerevisiae
MEEQREILEQLKKTLQMLTVEPSKNNQIANEEKEKKENENSWCILEHNYEDIAQEFIDFIYKNPTTYHVVSFFAELLDKHNFKYLSEKSNWQDSIGEDGGKFYTIRNGTNLSAFILGKNWRAEKGVGVIGSHVDALTVKLKPVSFKDTAEGYGRIAVAPYGGTLNELWLDRDLGIGGRLLYKKKGTNEIKSALVDSTPLPVCRIPSLAPHFGKPAEGPFDKEDQTIPVIGFPTPDEEGNEPPTDDEKKSPLFGKHCIHLLRYVAKLAGVEVSELIQMDLDLFDVQKGTIGGIGKHFLFAPRLDDRLCSFAAMIALICYAKDVNTEESDLFSTVTLYDNEEIGSLTRQGAKGGLLESVVERSSSAFTKKPVDLHTVWANSIILSADVNHLYNPNFPEVYLKNHFPVPNVGITLSLDPNGHMATDVVGTALVEELARRNGDKVQYFQIKNNSRSGGTIGPSLASQTGARTIDLGIAQLSMHSIRAATGSKDVGLGVKFFNGFFKHWRSVYDEFGEL

SEQ ID NO: 71037 - protein, 437 aa, Yersinia pseudotuberculosis IP 32953
MAYRQERIMSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLVVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 71038 - protein, 591 aa, Neisseria meningitidis FAM18
MAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSRLLEQSDKALPSVSAGDFIHEWVSSQAIELPSTSHISIVDKAGNVLSMTTSIENAFGSTLMANGYLLNNELTDFSFEPIKQGKQVANRVEPGKRPRSSMAPTIVFKAGKPYMAIGSPGGSRIIGYVAKTIVAHSDWNMDIQDAISAPNLLNRFGSYELETGTTALQWQQALNDLGYKTDVRELNSGVQAIIIEPSRLVGGADPRREGRVMGD

SEQ ID NO: 71039 - protein, 442 aa, Arabidopsis thaliana
MATLEDSFLADLDELSENEAELDENHGDVGKEEEDVDMDMADLETLNYDDLDSVSKLQKTQRYDDIMHKVEEALGKDSDDHEYKLIVDCNKLSVDIEDEIVIVHNFIKEKYKLRFQELESLVHHPIDYACVVKKIGNETDLTLVDFAGLDLTPAIIMAISVTASTTKGSALPEDMGSIAPNLSAIVGSAVAAKLMGTAGGLSALAKMPACNVQVLGHKRKNLVGFSSATSQSRVGYLEQTEIFQSTPPGLEARAGRLVAAKSTLAARVDATREDPLGISGKAFREEIRKKIDKWQEPPPARQPKPLPIPHSEPKKRRGGRRLRKLKARYQVTDMRKLANRTAFGTPEESSLGDGLGEGYGMLGQAGSKRLRVSSVQSKLKINAKVAKKLKERQYAGGATTSGLTSSLAFTSMQGIELCNPQQALGLGSGAQSTSQSQEPSRS

SEQ ID NO: 71040 - protein, 455 aa, Physcomitrella patens subsp. patens
MYHGHSMLAPFTSGSQQMETEPLIIAKGEGVYVWDRNGKKYLDALAGLWCASMGFSEKRLMNAAWNQMTQLPFYHSFWNRTSQPPLDLAKELIDIFKPVKMGKVFFCNTGSEANDTQVKLAWYYNNALGREKKKKIISRHSSYHGSTMSAASLSGLTPLHTGFDLPASYVLHTDCAHYWRYHLPNESEEDYSSRLADNLEKLILKEGPDTIAAFIAEPLMGAGGVIPPPATYWDKIQPILKKYDVLLIADEVICAFGRLGTMFACEKYNIKPDLLTIAKQLSSGYMPISAVLLGQHIFDVLAKQSNRLGTFGHGFTYGGHPVACAVALETLRIYKETDILAHVNEVAAIFQTEMRKFASSSIIGEVRGEGLVLGIEFVSNKETKESFPVDWGVGEYFSGQCTALGMLVRFAGNNIMYSPPLIITTDEIKEIVRMSAAALKATEIYVLELQVNAQI

SEQ ID NO: 71041 - protein, 141 aa, Zea mays
PKRMLVIGGGIIGLEMATVYSTLGAEIDVVEMMDGLMMGADRDLVKVWEKYNAKRFGNVMLKTKTVGAEAKEDGIYVKFEGEKAPAEAQRYDLVLVAVGRSPNGKKIGADKAGVAVTDRGFIEVDKQMRTNVPHIFAIGDV

SEQ ID NO: 71042 - protein, 1518 aa, Saccharomyces cerevisiae
MTGHVSKTSHVPKGRPSSLAKKAAKRAMAKVNSNPKRASGHLERVVQSVNDATKRLSQPDSTVSVATKSSKRKSRDTVGPWKLGKTLGKGSSGRVRLAKNMETGQLAAIKIVPKKKAFVHCSNNGTVPNSYSSSMVTSNVSSPSIASREHSNHSQTNPYGIEREIVIMKLISHTNVMALFEVWENKSELYLVLEYVDGGELFDYLVSKGKLPEREAIHYFKQIVEGVSYCHSFNICHRDLKPENLLLDKKNRRIKIADFGMAALELPNKLLKTSCGSPHYASPEIVMGRPYHGGPSDVWSCGIVLFALLTGHLPFNDDNIKKLLLKVQSGKYQMPSNLSSEARDLISKILVIDPEKRITTQEILKHPLIKKYDDLPVNKVLRKMRKDNMARGKSNSDLHLLNNVSPSIVTLHSKGEIDESILRSLQILWHGVSRELITAKLLQKPMSEEKLFYSLLLQYKQRHSISLSSSSENKKSATESSVNEPRIEYASKTANNTGLRSENNDVKTLHSLEIHSEDTSTVNQNNAITGVNTEINAPVLAQKSQFSINTLSQPESDKAEAEAVTLPPAIPIFNASSSRIFRNSYTSISSRSRRSLRLSNSRLSLSASTSRETVHDNEMPLPQLPKSPSRYSLSRRAIHASPSTKSIHKSLSRKNIAATVAARRTLQNSASKRSLYSLQSISKRSLNLNDLLVFDDPLPSKKPASENVNKSEPHSLESDSDFEILCDQILFGNALDRILEEEEDNEKERDTQRQRQNDTKSSADTFTISGVSTNKENEGPEYPTKIEKNQFNMSYKPSENMSGLSSFPIFEKENTLSSSYLEEQKPKRAALSDITNSFNKMNKQEGMRIEKKIQREQLQKKNDRPSPLKPIQHQELRVNSLPNDQGKPSLSLDPRRNISQPVNSKVESLLQGLKFKKEPASHWTHERGSLFMSEHVEDEKPVKASDVSIESSYVPLTTVATSSRDPSVLAESSTIQKPMLSLPSSFLNTSMTFKNLSQILADDGDDKHLSVPQNQSRSVAMSHPLRKQSAKISLTPRSNLNANLSVKRNQGSPGSYLSNDLDGISDMTFAMEIPTNTFTAQAIQLMNNDTDNNKINTSPKASSFTKEKVIKSAAYISKEKEPDNSDTNYIPDYTIPNTYDEKAINIFEDAPSDEGSLNTSSSESDSRASVHRKAVSIDTMATTNVLTPATNVRVSLYWNNNSSGIPRETTEEILSKLRLSPENPSNTHMQKRFSSTRGSRDSNALGISQSLQSMFKDLEEDQDGHTSQADILESSMSYSKRRPSEESVNPKQRVTMLFDEEEEESKKVGGGKIKEEHTKLDNKISEESSQLVLPVVEKKENANNTENNYSKIPKPSTIKVTKDTAMESNTQTHTKKPILKSVQNVEVEEAPSSDKKNWFVKLFQNFSSHNNATKASKNHVTNISFDDAHMLTLNEFNKNSIDYQLKNLDHKFGRKVVEYDCKFVKGNFKFKIKITSTPNASSVITVKKRSKHSNTSSNKAFEKFNDDVERVIRNAGRS

SEQ ID NO: 71043 - protein, 687 aa, Zea mays
  misc_feature (35)..(35): Xaa can be any naturally occurring amino acid
GSLTYTPAHPKSTPAMAAMPAPAAGLSVLVLFVLXAALPALSADDLNTDAQALQALRSAVGRSALPSWNSTTPTCQWQGVTCESGRVVELRLPGAGLMGNLPSGVLGNLSALRTLSLRYNALTGPIPDDLSRLSELRAIYFQHNSFSGEVPASLFELKNLVRLDIAGNKFSGKISPDFNKLIRLGTLYMDGNSFTGEIPKLQVPALEQFNVSYNQLNGSIPNTLRKMPKDSFLGNTGLCGGPLGLCPGESAPTAAGSPESQPGAGGAADVGGGKKKKLSGGAIAGIAIGSVFGVLLLLALLFFLCRKRSSAPRSAAAAAEKGQELGMGPMDVEPKGQNGSAGGHNGVAAAVAVPTAAAAAAAATAAAKTGGSTGSKKLIFFGPMAAAPPFDLEDLLRASAEVLGKGAFGTAYKAVMENGSAVAVKRLKDVDLPEPEFRERIAAIGAVQHELVVPLRAYYFSKDEKLLVYDYMSMGSLSALLHGNRASGRTPLDWETRSAIALAAARGVAHIHSTGPTASHGNIKSSNVLLTKNYEARVSDHGLPTLVGPSFSPTRVSGYRAPEVTDIRRVSQKADVYSFGVLLLELLTGKAPTHAVVNEEGLDLPRWVQSVVREEWTAEVFDQELLRYQNVEEEMVQLLQLAIDCSAQHPDRRPAMSEVATRIDEIRRSSLGDRQVADSAEGDEPSL

SEQ ID NO: 71044 - protein, 756 aa, Idiomarina baltica OS145
MLVTLQRIVESVNKAADFQLALRTMVSQVRSALETDSCSVFLADAQAHQYVMAASDGLADASGEPIRVDFGDGIISLAAQREEPLNIADISNHPANKELLDSNESQYRALLAAPIIHRRKVLGILVVHQSEARHFTREEEAFVVTLAAQLSVVIAHANTKGLLTDEHSPWVHSIQALPGSPGVAIGDAYVARPEVSLKEVSPQKTDRPLHEVRKFRQAVARTRAELKQLAERVYGQVPDDTLAIFDVYQGMLDAASLGNAVEAMIGQGWRAQTALKHVVEEFVDQFEALEDSYLRERATDVRDIGQRVLMHLQQRQRKRRAFPEQGILVADEVTASMLAELPRTQIAGIISLRGSSNSHAAIMARSMGIPAVLGVDDIELHYFSEKILIVDGYTGEVYINPPPQVREQYQHLADEEEELKSIVAEHAHLPAQTQDGQRVSLHLNLGLDIHQEHLKHLNIDGVGLYRSEIPFMMREQLPTEDEQVEMYKEVLDCFPDQPVIMRTLDVGGDKPLPYLQLQEDNPFLGWRGIRLTLDHPEIFLVQIRAMLRASIGRSNLRILLPMITSVSEVEEASRLLKQAYFEVAEEQGCAVGVNLFQPQLGVMIEVPAAIYQLPMLASKVDFFSVGSNDLTQYLLAVDRNNRRVASLYDAYHPAVLASLDEIARRCEELGKPVSVCGELAGDPGGALLLVAMGYRQLSMNSYNVDRVRWILRNVRSSTLQVMLAKALQARRPEQVRSMISEKMESMGLGGFVRAGK

SEQ ID NO: 71045 - protein, 496 aa, Nitrosomonas europaea ATCC 19718
MMRRTKIVATLGPASSNAEVLGRMLEAGVDVIRINFSHGTKDEHIASVELVRSLARSLGRTVGVLADLQGPKIRIGKFEQGKIRLKTGDEFILDAECQLGNQERVGLDYRELPNDVEAGATLLLDDGRIVLTVAKVRESEIFCEVLQGGILSNNKGINRKGGGLSAPALTAKDLLDIKTSAVIRADYLAVSFPRSGDDIRRARALMQEAQGHSLLMAKIERSEAILALDDILEASDAIMVARGDLAVEVGDAAVPALQKRMIRSAREANKLVITATQMMESMISNPIPTRAEVSDVANAVLDGTDAVMLSAESAAGQYPVEAVEAMARVCLEAEKEYTPSLRARRSPDTQSISIEDAIARATMYAAGSLNIQAIAALTQSGVTALFMSRRSSKAPIFALSPQEDTLGKVTLFRGVYPIEFGQGLCDPEIILGMAEDELLKRGAVRDEDLIIMTIGEPVGKAGGTNTMKIIKVGSSKKAAQAVREVAQQPFSDPQNL

SEQ ID NO: 71046 - protein, 392 aa, Nocardia farcinica IFM 10152
MLDDTRVRADTPGLAADPDLVFLDSAGSSLPPRVVLDTQVAHLRRETEIGGYRAAAERLDDLAGVKTAIGELINADPDCVALSDSASRAWADFFYSVPLRPGDRVLISGADYASNAIAALQRARATGAVVEQIPSDDTGQLDLDALERMVDERVALVSLLHVPTNGGLVNPAAEATKIAHSAGAMVLLDACQSAGQLPLDVAELGVDALSATGRKWLRGPRGTGFLYVRPELATTMEPQRLDLHSAAWTGPQDYELAPDARRFEFWECDVAARLGLGAAVRYLLDLGPADVYAAIAERAGHLREAFAALPRVTVRDNGVRRGGIVSFTVDGVPATEVRDRLAAQNITVTVSFAGSTLLDMSARGLDAVVRASPHCFVGFDELDRFVRAVAEL

SEQ ID NO: 71047 - protein, 392 aa, Nitrosomonas europaea ATCC 19718
MSVIKLVDLDLKNKRVFIRADLNVPVKDGKVTSDARITASMATINHCLKQGAKVMVTSHLGRPEEGVWTEENSLQPVADDIARRLGKPVRLIKDWVEGGFEVASGELVVLENCRINKGEKKNLEETAKKYASLCDVFVMDAFGTAHRAEASTHGIAKYAPIACAGILLTEELDALTKALHQPAHPLVAIVGGSKVSTKLTVLESLAEKVDQLVVGGGIANTFLKAAGNNIGKSLCEDELVPVAKSLMDKMNKRNATIPIAVDVVVGKKFAEDEAAVLKAANAVSDDDMIFDIGPESAQELVDIIMKAGTVVWNGPVGVFEFDQFGEGTRAIAKAIAETDAFTLAGGGDTIAAIQKYDIYDKVSYISTAGGAFLEFLEGKKLPAVEILELRAK

SEQ ID NO: 71048 - protein, 333 aa, Nitrosomonas europaea ATCC 19718
MTIRIGINGFGRIGRMVFRCSIEEFDDIEVVAINDLLEPDYLAYMLTHDSVHGRFRGDVSVSGNNLIVNGKQIRLTAIKDPTELKWDEVGADIVVESTGLFLTKELAQKHIQAGAKKVVLSAPSKDDTPMYVYGVNDKAYGGEAIISNASCTTNCLAPIAKVLNDTWGIKRGLMTTVHAATATQKTVDGPSNKDWRGGRGILENIIPSSTGAAKAVGVVIPELNKKLTGMAFRVPTSDVSVVDLTVELEKDASYEDICNAMKEASAGSMKGILGYTDQKVVSTDFRGETCTSVFDAEAGIQLDKNFVKVVSWYDNEWGYSCKLLEMVRVIASK

SEQ ID NO: 71049 - protein, 205 aa, Escherichia coli
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSF

SEQ ID NO: 71050 - protein, 204 aa, Escherichia coli
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 71051 - protein, 286 aa, Corynebacterium efficiens YS-314
MVEVHKIAVIGSGAMGRQIGMAAAVAGYDAVVQDISADAVEAAEQDMKAWAAGRVSKGRMSQEEVDAALGRLRFTTDQADAVGDADLVIEAATERLDIKRQVFTQIDELAPEHAILATNSSTYGSSSVADATRRPEKVCNMHFFNPALVMKAVEVVRHPETSDDTVDSVIAVIQKMGKHPVVLNAEIPGFIANRLMGAVRTEALNLVEQGIASIEDIDTVAKSALGHPMGPFELMDLVGLDVTYLIRKATFELTGDESEAPHPLITAKYEAGELGRKSGKGWYTYD

SEQ ID NO: 71052 - protein, 343 aa, Exiguobacterium sibiricum 255-15
MLNEQEIREVVGQMIDPTIERSLTDTNGIRDVRIKGDYVSLKIALAQAGSGEQLALQQQIVKELKEKGFKTVGLRFEALGDHGIQAATTPSILKPESGTTFIAIASGKGGVGKSTVSVNLAVALARAGKKVGLIDADIYGFSVPDMMGIETRPTVVNDRIVPPERFGVKVISMGFFVEDNAPVIWRGPMLGKMLNNFFSDVEWGDLDYLLLDLPPGTGDVALDIHSMLPSCQELIVTTPHATAAFVAARAGAMAIKTNHRLLGIIENMAYFESKVTGEKEYVFGSGGGEKLSEALKTDILAKIPLGQPYANDTDFAPSIYRDDHPFETHYNELAARVIEKVEG

SEQ ID NO: 71053 - protein, 470 aa, Novosphingobium aromaticivorans DSM 12444
MAEQYDVIVLGSGPGGYVAAIRCAQLGLKTAIVERENLGGICLNWGCIPTKALLRSAEVLNHMKHAAAYGLAADNIRADLDAVVKRSRGVAKQLNQGVTHLMKKNKITVHMGNGILKSATSVEVTGDKGSETISAKHVIVATGARARDLPFAKADGERVWTYRHAMTPKEMPTKLLVIGSGAIGIEFASFYNDMGAEVTVVEMMDRVVPVEDADVSAFLEKALTKQGMKIMTGAGVESLAVSASGVKAKIKGKDGKVAEGDYSHVIVAVGIVPNTEHIGLEALGVKAERGIIAIDGYGRTNVKGLWAIGDVTPGPWLAHKASHEGVIAAEAIAAELGNKEVHPHPMDRGNIPGCTYCHPQIASVGLTEAKAKEAGYAVKVGTFPFIGNGKAIALGEPEGFVKTVFDAKTGELLGAHMIGAEVTEMIQGYVVGKTLETTEAELMHTVFPHPTISESMHESVLAAYGRAIHI

SEQ ID NO: 71054 - protein, 427 aa, Novosphingobium aromaticivorans DSM 12444
MPIAIKMPALSPTMEEGTLAKWLVKVGDKVSSGDIMAEIETDKATMEFEAVDEGTIVSIDVAEGSEGVKVGTVIATLAGEDEDASAPAPKAVAPAAAPVPVPAPKAEPAPAAVSTPAPAAASASKGDRVIATPLAKRIAADKGIDLKGVAGSGPNGRIIRADVEGAKPAAAAPVSTVAPAVASAAAPARAPAAVPDFGIPYEAQKLNNVRKTIARRLTEAKQTIPHIYLTVDIRLDALLKLRGDLNKALEAQGVKLSVNDLIIKALAKALMQVPKCNVSFAGDELRSFKRADISVAVAAPSGLITPIIVDAGSKSVSAIATEMKALANKAREGKLQPHEYQGGTASLSNLGMFGIKNFDAVINPPQAMIMAVGAGEQRPYVIDGALGIATVMSATGSFDHRAIDGADGAELMQAFKNLIENPLGLVA

SEQ ID NO: 71055 - protein, 249 aa, Corynebacterium efficiens YS-314
MNSLNGRICIVTGAAQGIGKGIAERLAAEGATVVVADLNGEAASATAAELGNDSIGVTVDISDRTAVDAMVAEAKDKYGRIDVLVNNAGWDKIGPFLEIEPEIWDRIININLYGTLHCSQSVARIMVEQEGGGTIINIGSDAARVGSSGEAVYSACKGGVVSFTKTLARELARYGVTANAICPGPADTPLFAQISEENPKLRTALEKAIPLRRLAQPEDLANAVAFFASPESSYITGQTLSVSGGLTMI

SEQ ID NO: 71056 - protein, 324 aa, Streptococcus suis 89/1591
MKIFEQLATKLEGKKVRIVLPEGEEPRILQATKRLVNESDVVPVLLGNPDRIKIYLDIEGITEGFEIIDPAHYDRYDEMVAALVERRKGKVSEEQAHELLKDVNYFGVMLVYMGVVEGMVSGAIHSTASTVRPALQIIKTEPGVSKTSGAFLMVKGEERYIFGDCAINIDPDAQTLAEIAINSARTAKMFGIDPKVAMLSYSTKGSGAGPKVDKVVEATKIAQKLRPELDLDGELQFDAAFVPTTGKLKAPGSSVAGQATVFIFPGISAGNIGYKIAERMGGFAAVGPVLQGLNQPVNDLSRGCNPDDVYNLTLITAVQALEHR

SEQ ID NO: 71057 - protein, 289 aa, Arabidopsis thaliana
MDSSMSTKKKTKLSVRNQTCFKKSSLSSSSTAKKTTNLSMREQTMFKKALELSTLCNIDVCVIYYGRDGKLIKTWPDDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQRTEPLMSGVSNTEQDLSTSSLSQNQSKFSVFLYNHDNCSFYQVPDSVSSFDSLTSTGLLGEQGSGLGSSFDLPMVFPPQMQTQTPLVPFDQFAPWNQAPSFADPMMFPYN

SEQ ID NO: 71058 - protein, 332 aa, Mycoplasma genitalium G37
MKLSIDNKKHVIFSLSKSKTLVENICKKLNISEGKMVCEHFADGETYIRFDESVRNKDIYIFQSTCPNVNDSLMELLIAIDALKRGSAKSITAILPYYGYARQDRKTKGREPITSKLIADMLTKAGANRVVLTDIHSDQTQGFFDIPVDSLRTYHIFLFRVIELLGKKDLVVVSPDYGGVKRARLIANTLELPLAIIDKRRPSHNVAESINVLGEVKNKNCLIVDDMIDTGGTVIAAAKLLQKEQAKKVCVMATHGLFNNDAEQKFMEAFDQKLIDFLFVSNSIPQYKFKAVKQFEVVDLASLYEEVVLCYANSLSVSAIYERHIEWIKKHV

SEQ ID NO: 71059 - protein, 471 aa, Triticum aestivum
  misc_feature (381)..(381): Xaa can be any naturally occurring amino acid
  misc_feature (394)..(394): Xaa can be any naturally occurring amino acid
  misc_feature (406)..(406): Xaa can be any naturally occurring amino acid
RPAAAPDRTGTSSEAGGPDGLKKCKSDSKAISSVLAPPKDVEDLQTEGYGNVNIFTYNELRAATKNFRPDQILGEGGFGVVYKGVIDENVRIGFPSRQVAVKELNPEGFQGDKEWLAEVNYLGQLSHANLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVASLCYRCLSQNPKGRPTMSQVVETFEEVQSMPECQDILLQNCMTGSVTLYEVPKEPVEHVEXEKAKQEPTAKTDXLAVAVPPANGKXPVPQSRRTRPANGRSKSEPPLECKLYIPSPDSDGHQLGLEALASPPSRNSSRDDPPPVDEDLYKI

SEQ ID NO: 71060 - protein, 475 aa, Oryza sativa Japonica Group
MEKERKQGFFAALKEEVVRGLSPARSRGKSPARSASPGRMLIPRRRKEKQQQPPPEKLLQQYFAEPLISRSGSLRPGGEALAPLIEGPDPERLAAGGTSPAGRSRRGGRGSADGSAASWRARRPWRRPPPPPPPPVPGESSSAQYILQQYMAASGGYRLLQSVRNAYAMGKVRMVASEFETATRVVKNRGPSGRGAASVEQGGFVLWQMAPDMWYVELAVGGSKVHAGSNGRLVWRHTPWLGAHAAKGPVRPLRRVLQGLDPLTTAGLFAEARCVGEKKVNGEDCFILKLSADPQTLKQRSEGPAEIIRHVLFGYFSQRTGLIVHIEDSHLTRIQPHSGGDAVYWETTISSALEDYRPVEGIMIAHAGRSAVTLFRFGEAAMSHTKTRMEEAWSIEEVAFNVPGLSVDCFIPPADIRSGPVGESCELPPPAAAPHGERARHPARVAAVDRAPPHHNAGGANVGRRGDKIMWRVEV

SEQ ID NO: 71061 - protein, 374 aa, Vitis vinifera
MDASPIYRLPQDTLHYIFSTLPLRQIIICRSVCKFFYQTLTAPAFMELISTQPPLNLIALRPPHHHHHHHHHHHNRDVSSHNALHVFDPSSNQWVRFPLSFLPFRSPTPVASSLGLVYLWADSLNSLESNKSLIVCNPLTRSFQVLPQLGSAWSRHGSVLVGSPNRVLVLTELATLYFSGSDQWLKFSSNLPSKPRSPILVSDSVLALCDVGSPWRSQWKLFACTLNHLQKSQPWTRLDRHEWGDVFDILRRPRLVKGLGNQILMVGGLKSSFSLNAVCSTILILRLDLDSLEWDELGRMPPEMFRCFQESSKFKVFGAGNRVCFSAKRVGRLALWDYSTETGKGDWRWINGVPGNGDGLFRGFVFQARLTALP

SEQ ID NO: 71062 - protein, 606 aa, Xylella fastidiosa Dixon
MNTVTFPSQGGIDRRRFLKGLALGGVVAGTGLWRLPVHAANPELPLLQRHTTPLELRIGQSSVNFTGRMRPAITVNNSLPGPVLRWRQGDTVQIHVTNTLPDVMTSIHWHGIVLPSNMDGVPGMSFDGIAPGEHYLYRFQLHQSGTYWYHSHAMFQEQAGLYGALIIDPLEPPPYRADREHILLFSDWTDLDPAALFRRLKKMSSYDNTYQRTVRDFFHDIRRDGLRTTLADRRMWGRMRMTPTDLSDVNAHTYTYLLNGTTPAGDWTGLFRPGEKVLLRLINGSAMTYFDVRIPGLKLTVVAVDGQYVHQVTVDELRIALAETYDVLIQPHGQDAFAIFAQDMGRTGYACGTLAVRPGLHAPLPALDPRPRLTMQDMGHRMTHGQHESRASEMADMPGMTHPGRLGDHASHANQPPAQTPHGSHSLPADRTAPRHPASEQNNPLVDMHVDAPQPRLNDPGIGLRDNGRHVLTYADLHSLFDDPDGREPGREIELHLTGHMEKFAWSFDGIPFASAQPLRLNYGERVRIVLVNDTMMAHPIHLHGLWSDLEDANAAFQVRKHTIDMPPGTRRSYRVRADALGRWAYHCHMLYHMESGMMREVQVRP

SEQ ID NO: 71063 - protein, 327 aa, Candida albicans SC5314
MSIKFVKSSKDFEGYLKNNTHLVLNFTASWCGPCQAIKPVIDQAYGQFQNVEIVRIDLDSQRELASKYNITSVPTFVFLETGKEVDRIQGANPQALITKLQEFNTKANGQKRRGNGTASEDLITQNSSLKDIKPLIPKNFEILNATIDYSGYEVLNCLPLYKDSKTKHVVSLDNTDKSAVISDSDSQLLFYIPFLNISKIYSILVKVKSTKTYKEVDESALDVDSDDLDEIQPPNLIKVWCNTQSILSFDEASADTSAPHIEKVSTNDEEQWLDIKFKFVRFQNVQNLTIFVDGEDEDYHTVIEKIVIVGVNGESKEQGKINQIDDE

SEQ ID NO: 71064 - protein, 318 aa, Oryza sativa
  misc_feature (264)..(264): Xaa can be any naturally occurring amino acid
QEGIDSLWGYGQVFQRNVTTSGVVPQLSLIMGPCAGGAVYSPAITDFIFMVQNTSYMFITGPEVVKSVTNEEVTQTELGGTKPHTTHSGVAHGAFANDVGALRKLRELFSFLPLSNDSPLPHIPTFDSRDRNIPSLNTIIPPDPNQAYDMKEIIEKLVDDFNFFEIMPDYAKNIIIGFGRMEGTTVGIIANQPRELAGVLDINASVKGARFVRFCDAFGIPIIILADVPGFLPGVAQEHGGIIRHGAKLLYAIAEATVPKIQLXNKKMYGGAYLVMGSKSLTVDTNYVWATTENAGMGAKGAVEIIFRGQRWLRELLI

SEQ ID NO: 71065 - protein, 484 aa, Thermoplasma volcanium GSS1
MLSFERVRIRKADPVKRVGTFELEPLENYNDGEAIAEASRCIGCNMCSAACPASLDIGGYVRSTAAGDPAQTIRIIMETLPFPAIIGRVCTHMCEDVCVLYDGGGPIAIRHLKRYAADKFDDYGEILKPQKRKFIGKRVAVVGGGPAGLTVAYYLTLQGVKVTVFEERPALGGFMKTGIPRYRLPQNVLDKEIGYILSRGVQVKLNTAVGRDVKFEDLMKEYDAIFLGVGNHKPRMTGTPGSDAPNVMHATEFLERVSFGEKINVGETVAVIGGGFTANDSARTSLRLGAKHVYIMYRRRDVDRPGYPSMNADEEMEEAEEENVEYVWEVTPFEYVKENGRVVAMKYWKNEMVSQGKGRAKPVPIKDKFYTIKVDMVIEATGQETDYSFLGSYVEKLRLNDRGEPIVDQYGMTSIPGVFTGGDSTNPNRDLISAVRDGDIAVQGILRYLNVMDQVSYDDLPLLDRFKPYSYTAAAEAYASRGLE

SEQ ID NO: 71066 - protein, 269 aa, Idiomarina baltica OS145
MTSASKQPAPNDQAQGGVERVYGRKALKTFRNQHIAIAGLGGVGSWAVEALARSGIGELTLIDLDDVCVTNINRQLPADFNTIGQLKTEVLAERIRAINPACKVNIVDDFLLEENFATHLSGVTAVLDAIDSVNTKAALVAHCKRNKLPLVVCGGAGGQIDPTQIRVADLAKAKQDPLLAKVRSKLRRDFNFSKNPKRKWGVDCIYSEEQLRYPWVAGEHEGEVTLQKPGSGTMQMNCSSGFGAAMVVTCSFAMFAVSTLLKRIERRAA

SEQ ID NO: 71067 - protein, 310 aa, Saccharomyces cerevisiae
MTTSILDTYPQICSPNALPGTPGNLTKEQEEALLQFRSILLEKNYKERLDDSTLLRFLRARKFDINASVEMFVETERWREEYGANTIIEDYENNKEAEDKERIKLAKMYPQYYHHVDKDGRPLYFEELGGINLKKMYKITTEKQMLRNLVKEYELFATYRVPACSRRAGYLIETSCTVLDLKGISLSNAYHVLSYIKDVADISQNYYPERMGKFYIIHSPFGFSTMFKMVKPFLDPVTVSKIFILGSSYKKELLKQIPIENLPVKYGGTSVLHNPNDKFYYSDIGPWRDPRYIGPEGEIPNIFGKFTVTS

SEQ ID NO: 71068 - protein, 322 aa, Zea mays
MDGEEIGLVLARASDLRTRISACAAAAAGAPGPRRDDEEAAKRLDAAEGDEEGAEEEEDEEEEVESLVGISDALESLERQLAALQDLQHQQRYERETILSQIDRSRRSLLAKLREYKGQDCEVIHEAAAFAGERIERDDSLVLPPYSDHVTNSFALDDLYPLSYMSKPKRLHTQPDSEDDGTAQDDARRNGRESRDTRASKRGSGGGGGGGGGGGIGAFMGWVAKTAVMVVGAVCVMKAAGYESVTWRNGGARLDIAGLFGGGGGKQAVAAGGGDERRAPLRCPPGKAMVVENGRARCVVKERVEVPFDAVLAPPSSRYGLG

SEQ ID NO: 71069 - protein, 145 aa, Vitis vinifera
MVEEDAFFNEQADQPEGTSFGTLAAEITSTTSEFFYNNDELDLDCPTEGFSSVAEAIEDIRQGKFVIVVDDEDRENEGDLIMAGSLVTPHAMAFIVKHGTGIVCVSMKGEDLERLQLPLMVTQKENEEKLCTAFTVSVVCIDIVE

SEQ ID NO: 71070 - protein, 355 aa, Triticum aestivum
MAASSLWDELVVAASTGGSSGTVVSICVFTAVLCLCLVAGHLLEENKWVNESITALIIGCIVGALIFLLSKGRNSHILRFDEQLFFIYVLPPIIFNAGFQVKKKQFFHNFLTIMSFGVFGVFISVAIVSAGFYWLLPKVGFGKLDAVDYLALGVIFSSTDTVCTLQVISQDETPRLYSLVFGEGVVNDATSVVLFNAIKNMDITKIKSRAVLKVIGDFLYLFATSTILGATIGLFTAYVLKALYFGRHSTDREVALMALMAYLSYMLAELLSLSGILTVFFCGIVMSHYAWHNVTESSRITTRHIFATLSFIAETFIFLYVGMDALDMDKWKTTQASFKTSIGIFGVIISLILLG

SEQ ID NO: 71071 - protein, 204 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSF

SEQ ID NO: 71072 - protein, 355 aa, Nitrosomonas europaea ATCC 19718
MTEQLKQLRNEIDAVDDELLRLISTRARLAQQVGRQKSGTAYRPERESQIFSRLQQSNPGPLRDEHIVHLFTEIISVCRALEEPLTVAYLGPQGTFSEEAVTKRFGSAVTSLPCSSIDDIFRKVESGAASYGVVPVENSTEGAVGRTMDLLLQTPLKICGELELPVHQCLMAQQTDLTAIRKIYSHPQSFAQCQVWINENLQSLTAVDRIDAASNADAARQAAADSSAAAIAGKKAAEVFGLKVCAANIEDNPNNTTRFLVIGSRDVARSGRDKTSLAMATHNRPGAVHELLAPFARYQVSMTRLESRPSRASLWEYVFFTDIAGHQEDENVARALQALRDNTTFLKIFGSYPAA

SEQ ID NO: 71073 - protein, 282 aa, Mycobacterium sp. MCS
MVTRPNDELHGRVAIVTGGASGIGRGVAERFVAEGAKVVIADVQDELGEALAEQCGPNALFHHTDVGDQEQMRRLVDVAVERFGALDVMVNNAGISSPLRRGLFTEDLEEFDRVMRVNLLSVMAGTRDAGRYMSEHGGGSIINLSSIGGIQAGGGVPVYRASKAAILHFTKCAAIELAHYDIRVNCIAPGNIPTPILQSSATGEDRERLEKFEARIRAQMRNDRPLKREGTPDDVAEAALYLATDRSRYVTGIVLPVEGGTIAGKIIPRKAEPGATVNGAQT

SEQ ID NO: 71074 - protein, 205 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSIQ

SEQ ID NO: 71075 - protein, 185 aa, Triticum aestivum
MAITLNNGFKMPIIGLGVWRMEDLVSSGLVRSIGISNYDIFLTRDCLAYSKIKPAVNQIETHPYFQRDSLVKFCQKHGICVTAHTPLGGAAANAEWFGTVSCLDDQVLKGLAEKYKKTAAQISLRWGIQRNTVVIPKSSKLERLKENFQVFDFELSKEDMELIGSIDRKYRTNQPAVFWGIDLYA

SEQ ID NO: 71076 - protein, 480 aa, Idiomarina baltica OS145
MNKNVYQFLDVQRIDPPKQPVASRRIEFKEIYEPMTDVQLQGQADRCLDCGNPYCEWKCPVHNYIPQWLQLANEGRVFEAAELMHKTNSLPEVCGRVCPQDRLCEGACTLNDDFGAVTIGSIEKQMVDQAFAQGWRPDLSAVEARTEKVAIIGAGPAGLACADVLVRNGVKPVVYDRYPEIGGLLTYGIPPFKLDKNVLKLRREIFSDMGIEFKLGVDVGKDVSFDDIMTQNDAVFLGLGTYKALDGRLEGLDTPGVYPALPFLIGNTQRLLDSPMPDYPLIDVKDEQVVVLGGGDTAMDCVRTSIRQGAASVVCAYRRDEHNMPGSRREVQNAREEGVQFEFNLQPLAIVSDEAGHVAGVKMVKTELGQPDEQGRRRPQPVPDSEFIMPATAVLIAFGYQPNPPEWLDAHQVELSEWGTVLATATPDAMGRFAMQTSNPKIFSGGDMVRGADLVVTAIAEGRTAAEGILDYLDSVADNL

SEQ ID NO: 71077 - protein, 201 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 71078 - protein, 37 aa, Tragopogon dubius
VEQSRRDDLESLGYVLMYFLRGSLPWQGLKAGTKKQK

SEQ ID NO: 71079 - protein, 203 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 71080 - protein, 404 aa, Vibrio fischeri ES114
MQNIGMSSKLSSVCYDIRGPVLKHAKRMEEEGHKILKLNIGNPAPFGFDAPDEILVDVIKNLPTSQGYCDSKGIYSARKAVVQHYQRRGLLDLDVEDVYIGNGASELIVMAMQALLNNGDEMLVPAPDYPLWTAAVSLSGGKPVHYMCDEGADWYPDLDDIKKKITPNTKGIVLINPNNPTGAVYSRDFLLQVVEIARQNNLIIFADEIYDKVLYDGAVHTTLATLAPDILTVTFNGLSKAYRVCGFRGGWMFLNGPKDHAQGYIAGLDMLASMRLCANVPMQHAIQTALGGYQSINELLLPGGRLLEQRDKAYDLITQIPGVSCVKPKGAMYLFPKLDPKMYKIKDDQKFVLDFLIKEKVLLVQGTGFNWPTPDHFRIVTLPRVDDLETAIGRLERFLHTYKQ

SEQ ID NO: 71081 - protein, 325 aa, Streptococcus suis 89/1591
MVQPLGEHNIKLFSLNSNRDIAEKIADSAGIPLGKLSSRQFSDGEIQINIEESVRGVDVYIIQSTSYPVNNHLWELLIMIDACKRASANTITAVIPYFGYARQDRTASPREPITAKLVANMLVKAGVDRVLTLDLHASQIQGFFDIPVNNLLTEPLFAAYYMEKGLCGEDVVIVSPKNSGIKRARNIAEFLNAPIAIIDYAQDDSERSEGYIIGDVAGKKAILVDDILNTGRTFSQASKIVQEGGATEIYAVASHGLFAGTATQLLDEAPIKEILVTDSVASKEQHPKNIAFLTASDLIADAIHRIQEHQPLSPLFKFTSPEKEN

SEQ ID NO: 71082 - protein, 274 aa, Novosphingobium aromaticivorans DSM 12444
MAAISGLIRVMERAARKAGGRLRRDFGEIEHLQVSKKGPADFVSKADRQAERTLWDELRAARPGWGFLMEEGGEIEGEPGKPRFIIDPLDGTSNFLHGIPHFAISIAVQEPTLDGKGWGEVTAALVYQPITDESFWAEKSQGAWLQDRRLRVSARRHLDEALIATGIPFAGRGDMGEWIRIYAELGPRIAGIRRNGAASLDLAWVAAGRFDGFWESSLAPWDTAAGCLLVREAGGFVSDYKGRSHPICDETVLAGNDALHSKLHKLLVGALRNA

SEQ ID NO: 71083 - protein, 441 aa, Burkholderia mallei ATCC 23344
MSDKATRIELLDWRTVPMRAFHLTWIAFFVCFFAWFACAPLMPLIAREFRLSADQVANVNIAAVAATIAVRLVVGPLCDRFGPRRVYAGLLACGAIPVFAVTLSHDYLTFLLCRLGIGAIGASFVITQYHTSVMFAPNVVGTANAAAAGWGNAGAGAAQAAMPLVVAAALLLGLPDACAWRAALAVPGAAMLVMAIVYWRGTQDCPQGDFVALRARGVTIDSGKKGGFASFAAACGNYRVWMLFVTYGACFGVEVFMHNIAALYYVNHFALSLKDAGLAAGIFGLLALFARALGGWLSDRVAARRGLDVRATLLFALILGEGLGLLWFAHAGSVPVALVAMVAFGLFTHMACGATYALVPFIDRRALGGVAGIIGAGGNAGAVAAGFLMKGVGDIQQTLTLLGLFVTVSAFCALAVRFSSEHKAREAALRERALAASGFTH

SEQ ID NO: 71084 - protein, 482 aa, Vibrio fischeri ES114
MYTDCYNENHFVEWNNNMSSVANLLDQFEQLKHAYQASPNSSKDERLLLLGQLKQALLSEKENITSALEKDYGYRSHFDSTICDLMPSIQHINYTTKRLSKWLKPQKRSAGLLLSPSRLQVVYQPLGVIGVIVPWNFPIYLSIAPIVTAIAAGNRVMVKLSEYTLETNQVLRRVFSDLSEHVCIIEGAADVAAEFSQLPFNHLLFTGSTQVGKLVASAAAKNLTPITLELGGKSPVIIADDADLTSSVDAIMLGKSMNAGQICVAPDYVFIPKNKVEKFISLYVRRFSQVFPEKKGKREYSHIINQAQYERLESYFTDAKEKGATLTSIECDVQSEGRSFLPHLLTDVNDDMLVMQEEIFGPILPIIGYEAIEEAFDYIKKRPRPLALYVMSSDKLLIKQIIENTHSGGVAINDTMMHVAADDAPFGGIGDSGMGSYHGIEGFITFSHAKTVLSTPTWLPRARLLLKHKKSMLKVLGLKFMK

SEQ ID NO: 71085 - protein, 136 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFDTDLCTVSTVTHPDTMMDGTGQCGSFPCSVAPTPLKC

SEQ ID NO: 71086 - protein, 298 aa, Neisseria meningitidis FAM18
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGYIPVVAPVGVGEKGEAFNINADLVAGKLAEELNAEKLLMMTNIAGVMDKMGNLLTKLTPKRIDELIADGTLYGGMLPKIASAVEAAVNGVKATHIIDGRLPNALLLEIFTDAGIGSMILGGGEDA

SEQ ID NO: 71087 - protein, 259 aa, Xylella fastidiosa Dixon
MVAVNLKTKEEIEQMRIAGRLAAMVLDVVAPYVKPGVTTAELDQICHNYIVTVQGAIPANLGYRGFPKTICTSVNNVICHGIPSDAKVLKDGDIINIDVTVIKDGWHGDTSRMYYVGNPSVMARRLVETTYEAMWRGIRAVKPGATLGDIGHAIQTYAENERFSVVREYCGHGIGKVYHDNPQVLHYGRPGEGLILESGMTFTIEPMINEGTRHHKVLPDGWTVVTKDRKLSAQWEHMIAVTEDGVDVLTLSPNDIGST

SEQ ID NO: 71088 - protein, 525 aa, Yersinia pseudotuberculosis IP 32953
MTKNIHKHRILILDFGSQYTQLLARRVREIGVYCELWAWDVTEAQIREFNPSGIILSGSPESTIENGSPRAPDYVFTAGVPVLGVCYGMQTMAIQLGGKVESSNQREFGYAQVEIKADSALIRDIKDAINPAGEAVLDVWMSHGDKVAEIPADFVTVASTDTCPFAIMANEEKRFYGVQFHPEVTHTKQGLRLLERFVLGICGCEALWTSATIIEDAIVRLREQIGDDHVILGLSGGVDSSVTAMLLHRAIGKRLTCVFVDNGLLRLNEADQVLEMFGDKFGLNIVHVAAEDRFLSALAGVDEPEAKRKIIGRVFVELFDEEACKQEQVKWLAQGTIYPDVIESAASATGKAHVIKSHHNVGGLPKEMKLGLVEPLKELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETVDFMTAHWAHLPYDFLGRVSNRIINEVNGISRVVYDISGKPPATIEWE

SEQ ID NO: 71089 - protein, 212 aa, Capsicum annuum
MSNPKDNFNVADLSAALNAGDRADLVNVLKNKLQDLTGKHTNLLENLSPNVRKRVEVLREIQTQHDELEAKFFEERAALEAKYQKLYQPLYTKRFDIVNGVVEVDGAVTEVPAVDQEEDKAAVEKGVPDFWFTAMKNNDVLAEEISERDEAALKFLKDIKWTRIDNPKGFKLEFFFDTNPFFKNTVLTKTYHMIDEDEPILEKAIGTEIDWH

SEQ ID NO: 71090 - protein, 277 aa, Idiomarina baltica OS145
MNILLLGYGDIAQRSARLMVAEQHHVIGACRHPDDKPLIPGVETVSADASNEQDLRGLFNAHGKIDLVVVTLTPSEYSKEGYRQGYVVPCRHLQQIISELDYSPYVIYVSSTGVYGQHEGEWVDESSPTAPDSDSGKMLLQAEYLIRDLPVPSTILRCSGIYGEGRDFMRKQLQAGKATLRDSWTNRIHQDDVASFIYHLVRFPQHRHRMFLVSDDQPSKQYQVYQYLAEQAGITLNEPVQPGPGPRGSKRCSNRLLRSTGYTLMYPTYKEGLAHTE

SEQ ID NO: 71091 - protein, 414 aa, Shewanella sp. ANA-3
MSDIRQQALDYHEFPVPGKTAVCLTKPAETSHDLALAYSPGVAEPVREIAANPDNAYRYTNKGNTVAVITNGTAILGLGNLGPLASKPVMEGKALLFKHFANIDSTDIEVTHNTPEEFINTVAAIAGTFGGINLEDIKAPECFVIERELIERCNVPVFHDDQHGTAIVTAAGMINALEIQGKLISDATFVCMGAGAAAIACMTMLVKCGANRANIYMLDTKGVIHTGRTDLNEYKALFANDTDKRTLQDVIKGADVFLGLSGPNVIGAEEVAMMADKPVIFACSNPDPEIKPELAHATRSDLIMGTGRSDYPNQVNNVLCFPFIFRGALDVRASCINDEMKVAAVHAIAGLAKEEVPASVLKAYPKVSSLSFGPEYVLPKPMDPRLLPRVARAVAQAAIDSGVAAITALPHYAD

SEQ ID NO: 71092 - protein, 166 aa, Sulfolobus tokodaii str. 7
MERSVPNVEYDPDQFPGLIFRLEAPKVTSLIFKSGKMVVTGAKSTDELIKAVKRIIKTLKRYGMNLTGKPKIQIQNIVASANLHVIVNLDKAAFLLENNMYEPEQFPGLIYRMEDPRVVLLIFSSGKMVITGAKREEEVHKAVKKIFDKLVELDCVKPFEEEELEF

SEQ ID NO: 71093 - protein, 290 aa, Physcomitrella patens subsp. patens
MAAPWGLFPQPDSGILSVVPLVILGIGILMMLSELTGNQLQYSKFATGNDSKTRTLSGKTGMFLNYLPSGVVASVLVAYMLGVLPMLPSLLQSCGASSAASLIEQAVSNDSDNRLLLVALALSLLFDKRLLEVLFVQKFSGTTTANTVAFITNAYFSNTIILLYAQLWVTAQGFAAPTPNLKWPGLALFLVAITGNGYHHWLLANLRKGSNMGYMAPQGGLFGVFVCPHYVCEILSFVGIALISQTLVACSLAALVSFYLTSRSASTKKWYLKKIDGFPKERCVLIPGVW

SEQ ID NO: 71094 - protein, 195 aa, Arabidopsis thaliana
  misc_feature (52)..(52): Xaa can be any naturally occurring amino acid
  misc_feature (104)..(104): Xaa can be any naturally occurring amino acid
  misc_feature (118)..(118): Xaa can be any naturally occurring amino acid
  misc_feature (139)..(139): Xaa can be any naturally occurring amino acid
  misc_feature (164)..(164): Xaa can be any naturally occurring amino acid
  misc_feature (180)..(180): Xaa can be any naturally occurring amino acid
RSKRRREKKRSSNGFPLCFSSAAVVTSRAQATRVAPLTGLKSSAAFRVTRKXQTKDITFNRKARGGRVSCMKVWPQMGKKKLETLSYLPDFSDVEWAKEVDYLXSANKWIPCVEFELXEHGFVYREHGNTPGYYDGRYXHLKLPLFGCTDSAQVLKEVEECRRXPGAFIRIIGFDNTPQXCIVFIAYSPPSFTDA

SEQ ID NO: 71095 - protein, 201 aa, Idiomarina baltica OS145
MAVLVGRKAPDFTAAAVMGSGEIVEDFKFSDAIKGKKAVLFFYPLDFTFVCPSELIAFDKRLDEFKKRGVEVIGVSIDSQFTHSAWRNTATEDGGIGQVKYPLVADVRHSICKAYDVEHPEAGVAFRGSFLIDEDGVVRHQVVNDLPLGRNIDEMLRMVDALNFNQKHGEVCPAGWEEGKEGMKENAEGVAAYLSKNADKL

SEQ ID NO: 71096 - protein, 436 aa, Magnaporthe grisea 70-15
MELLIMISACKGGSASKITAVLPYFPYNRQSKKKSHRGAITARMLANLLHVAGVKHVITVDLHASQMQGFFQCPVDNLHAEPLIARWIRLNVSNWREAVVVSKNAGGTKRVTSLADALKLNFGMVTTDKKRGGGNMTASMILEQLDRPDPVAVPTKDGGVATTPTAEAPFPNLDGTSEATSSKTRVVADSRGSPKRIPVRTNGRSRVTSHPIQTETVAEEKEQAEGDVVDNGEDADDENDGRPDEVTHARLFQGHIVPDDFPSPSTSAADASLPDDDPMMMSHASSFFQPDNHALGGSGDAASSDEEEDKLKDPRIEHMITLVGNVRNRTVFIVDDMIDKPGSWIAAAEAVVKRGGATTVYCMATHGVFGGDCLEQLEACDCIHRIVVTDSYPIRPEKARSASKLVILDLSHLLAEAIRRNHNGEAISPLFQHIVD

SEQ ID NO: 71097 - protein, 305 aa, Brassica napus
  misc_feature (231)..(231): Xaa can be any naturally occurring amino acid
  misc_feature (259)..(259): Xaa can be any naturally occurring amino acid
  misc_feature (263)..(263): Xaa can be any naturally occurring amino acid
  misc_feature (265)..(265): Xaa can be any naturally occurring amino acid
  misc_feature (270)..(270): Xaa can be any naturally occurring amino acid
  misc_feature (274)..(277): Xaa can be any naturally occurring amino acid
  misc_feature (289)..(289): Xaa can be any naturally occurring amino acid
  misc_feature (292)..(292): Xaa can be any naturally occurring amino acid
  misc_feature (299)..(299): Xaa can be any naturally occurring amino acid
  misc_feature (301)..(302): Xaa can be any naturally occurring amino acid
  misc_feature (304)..(304): Xaa can be any naturally occurring amino acid
MASSSSEPLELIVTVVSAKHLKNVNWRNGDLKPYVVLYLDSDHRLSTRSDDSTKPVWNERITLPLTRSVHESVLNVEIFHSNSSDLGKALVGSVRFPLVRLIDSEGAINSLELIRPSGRTQGKIRLKLEIKERLIQPQNYYSAPTGLRPIQPQNFYSAPEGNRYYSPPPAPITSPSPQRDYRDFSPYPYTDHYYSRFYYPPPPPPPRSMYDRASNYSLPRVPSAPVDHNPXLPPRVPDYPPPPPSAPVDAFQVSEHQLXAPPXGXRDSPXYGAXXXXSAPVDYSPYDHXELXKTVGGLXLXXEXD

SEQ ID NO: 71098 - protein, 395 aa, Novosphingobium aromaticivorans DSM 12444
MSFKTLDDIGDLTGKTVLVREDLNVPMQDGAVTDDTRLRATIATLNELSDKGAKVLVLAHFGRPKGQPSEEFSLKKLAAPLAHVLGRPVSYIDWESDKAAVAALTPGAIAVLENTRFFDGEEKNDPAVIERFASLGDIYVNDAFSAAHRAHASTEGLAHVLPAYAGRAMEAELKALQKALGEPERPVAAVVGGAKVSTKLDVLKHLVSKVDHLIIGGGMANTFLAARGVNVGKSLCEHDLTGTAEEILDNADKSGCTVHLPYDVVVSKEFTANPPSLRTCNVHEVAADEMILDVGPAAVEALADVLKTCKTLVWNGPMGAFETEPFDAATVALARTAAALTKEGSLVSVAGGGDTVAALNHAGVVGDFSYISTAGGAFLEWMEGKELPGVAALEG

SEQ ID NO: 71099 - protein, 335 aa, Novosphingobium aromaticivorans DSM 12444
MAIKVAINGFGRIGRNVARAILERPDCGLELVSINDLADAKANALLFKRDSVHGAFSGEVSVDGNDLIVNGKRIQVTAERDPANLPHGANGIDIALECTGFFTNRDGGQKHLDAGAKRVLISAPAKNVDLTVVYGVNHDKLTGDHKIVSNASCTTNCLAPMAKVLHESIGIERGLMTTIHSYTNDQKILDQIHSDPRRARAAAMNMIPTSTGAAVAVGEVLPDLKGKLDGSSIRVPTPNVSVVDLTFTPKRDTSVEEVNGLLKAAAEGALKGVLGYTDEPLVSIDFNHDPHSSTIDSLETAVLEGKLVRVLSWYDNEWGFSNRMLDTAGAMAKFL

SEQ ID NO: 71100 - protein, 224 aa, Streptococcus suis 89/1591
  misc_feature (188)..(188): Xaa can be any naturally occurring amino acid
MTNLKEQVGIKAAEFVTDGMIVGLGTGSTAYYFVQEIGRRVAEEGLQITGVTTSHATAEHAASLGIPLKNIDEVEYVDLTVDGADEVDGDFNGIKGGGAALLMEKVVAVNSKDCIWIVDESKVVQTLGAFKLPVEVVQYGAENLFRLFEKKGYRPSFRMRNGEKHITDMQNFIIDLDLRRIEDTYALXEELDRTVGVVEHGLFIGLISKVIVGTPEGPNIIEKK

SEQ ID NO: 71101 - protein, 708 aa, Vibrio fischeri ES114
MSYQVLARKWRPHHFKDVVGQPHVLTALENALDHNRLHHAYLFSGTRGVGKTTIARLFAKGLNCEEGITSTPCGVCSTCKEIDEGRFVDLLEIDAASRTKVEDTRELLDNVQYKPARGRFKVYLIDEVHMLSRHSFNALLKTLEEPPEYVKFLLATTDPQKLPVTILSRCLQFHLKHISVDQIHEQLDFVLDKEEVSKEARALGLIAHAADGSMRDALSLTDQAIALGNGSVTAEIVSAMLGTLDTDQAIRILEAISTKNMQTLMNCVNDLADIGVEWDGLAKELANQLHKLAMYQALPATLDKTQPDAERIELLSTQLSPQEVQLFYQIVLQSRKDLPLAPNERTGAEMMLLRMVAFRPVHAQALEAQPIAVPSTEPQTTNAAPRVQQAPSAPVNVAPQAQRPMASQQRPTTPQQTQQGYAPANVPPMQTEQPPVYDAPPMGTPSGESASQAPQHSSSAQSPMQETPAPRSGLLGVRNQLRSAKNNLTNTGTGSKKASAASDKKKTSSVLERIAEKQHLAPRAQVSQIGNSATQEKKPEEPYRWKSTQPEMKKVVSDVTPTKLKQALEHEKTPEMVKLLVEESSKQDTWSALAMSLTLPKLVQQLVLNSAFVEQDNQVKLHLRAAQSHLNGDKANELITQALTQTLNREVTVTIDISDEGTTPLELREQMYQTKLQTAYQSLQQDPHVNFFIQRFGAEMDQESVRPI

SEQ ID NO: 71102 - protein, 84 aa, Triticum aestivum
PYKVIKNWNYTGLVDAIHNGEGNCWTAKVTCEEELMAAIATATEEKKDCLCFIEVVAHKDDTSKELLEWGSRVSAANSRPPNPQ

SEQ ID NO: 71103 - protein, 181 aa, Vibrio fischeri ES114
MSTETLTLIKNSIKSIPDYPKAGIMFRDVTSLMEDPKAYQATIQSLVEKYKQGGFTKIVGTEARGFLFGAPLALELGVGFVPVRKPGKLPRPTIAQTYDLEYGTDTLEIHTDAIVEGDKVLVVDDLLATGGTIEATVKLIRQLGGEVEHAAFVINLPEIGGETRLEGLGLNVYSICEFAGH

SEQ ID NO: 71104 - protein, 113 aa, Chlamydomonas reinhardtii
MGGSVIVIDSKAAWDAQLAKGKEEHKPIVVDFTATWCGPCKMIAPLFETLSNDYAGKVIFLKVDVDAVAAVAEAAGITAMPTFHVYKDGVKADDLVGASQDKLKALVAKHAAA

SEQ ID NO: 71105 - protein, 255 aa, Zea mays
QKRRWLLEASLAGSVATNAPRKISSPTAMAAADASRTLLAAVSLALAACCLAQLAAGDTNGVYEPCSDGRIQRGDGFTFGVVFAGYNAFFSGNTQLSPCDRRLNLAASGQLAVFRPKASAGGFMVAFAGRKYAARSIPIFVSNTSVTVSSFTLVLEFNKGRLENLHWKKDGCGACSGKSNFVCLGKQTCAIRTQSCKSQGPVDCSVGIQLAFSGTDKHESVLNSWYEVSNLRQYSLYGLYSNLKGTLSGQFNKIF

SEQ ID NO: 71106 - protein, 299 aa, Geobacillus kaustophilus HTA426
MQDGKPFSFGWIHQGKEEWNDEQRTNDRAHRRGSMAEALIAGMTKAFCHPAHIVVANRQNRARLEELARQYGVCTAGCAQEAVKQADIVILAMKPKDVVEAMNAIAPTLRAHQLILSLLAGITTETIERLAGRNIPVVRAMPNTSAAVGLSATAIAGGRFAAKEHLEVAKQLFETVGIVAVVPEKDLHAVTGLSGSGPAYVYYLVEAMEKAAADIGLERDVAKRLILQTIIGAAEMLKASDKHPSVLRREVTSPGGTTEAGIGVLEQYRFQEAVIACIRRATARSEELGSALLAAIAEA

SEQ ID NO: 71107 - protein, 287 aa, Arabidopsis thaliana
MDSSMSTKKKTKLSVRNQTCFKKSSLSSSSTAKKTTNLSMREQTMFKKALELSTLCNIDVCVIYYGRDGKLIKTWPEDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQWTEPLMSGVSNTEQDLSTSSLSQNQSRISVFLYNHDNRSFYQVPDSVSSFDQSALLGEQGSGLGSNFDLPPMVFPPQMQTQTPLVPFDQFAAWNQAPSFADPMMFPYN

SEQ ID NO: 71108 - protein, 497 aa, Geobacillus kaustophilus HTA426
MDNMNPKSIIVIFGATGDLAKRKLFPSLYRLYEKGHLNEQFAVVGVARRPLSADEFRNYVRDSVETAFHQKLADGRFTSHFYYHPFDVTEAESYQRLKSLLEQLDGTYKTEGNRIFYLAMAPEFFGTVTSRLQSEGLTETHGFKRLVIEKPFGHDLASAEKLNDEIRRVFSEREIYRIDHYLGKEMVQNIEVIRFSNAIFEPLWNNRFIANIQITSSETLGVEDRGRYYDHSGALRDMVQNHMLQMVALLAMEPPIKLTTDDIRHEKVKVLRALRPIAHDEVDRYFVRGQYGRGVIHGKNVPAYREEPNVDPDSNTETFVAGKLLIDNFRWAGVPFYIRTGKRMAEKSTKIVVQFKDVPMNLYYRTNETIAPNLLVIHIQPDEGITLHLNGKKTGESTTITAPFQLDYCNNCIDGINTPEAYEKLLYDCMRGDATNFTHWDEVAASWQFVDPISEVWANTKASDFPNYAAGSMGPAAADELLKKDGFHWWPIEHPRS

SEQ ID NO: 71109 - protein, 401 aa, Rickettsia akari str. Hartford
MALIIQKFGGTSVANIDRIKQIVSIIKAAIAKNNQVIVVVSAMAGVTNQLVTLCNEVSSLNSISQFAEYDVALSSGEIVTASLLALALQEKDIKARSFLAWQLPILTNNNHSKSVVESVTTDLLKKCLQLNIVPIIAGFQGINKSNRLTTLGRGGSDTTAALIAAAMKADRCDIYTDVEGIFTADPRIIPNAKRIKEIDFLEMLELASSGAKVLHPRAVELVMRYKIDMCVLSTFSPNKEGTLITSKDKNMENGIINSITSNKNLLKISVKSISLSFLQVANIITQNNNHIEFMQEVNNNEEYSFIASLTDKNNLQALLTNLKNDKQIQDFTFDAEIATISLIGYGIKNDCKVLETILSKLTKDNINVNMIQLSEVKITLLINDQDVEKTIFNLYNLFKIS

SEQ ID NO: 71110 - protein, 400 aa, Candidatus Kuenenia stuttgartiensis
MFREGVFFFMVLSRVAREIQASATLAITAKAKQLAAEGKDVIGFGAGEPDFDTPENIKNAAIKAIKNGFTKYTPTSGVPKLKEAICEKLFNDNHLKYASSQILVSAGAKQSICNIALVLCDTGDEAIIPSPYWVSYPEMVTLAGAKPVFLETTDKDSFKITKESLAKVITPKSKLLFLNSPSNPTGMVYTEEELREIVMFAVEKGLYVISDEIYEKILYDGAAHFSPAAINDDCYNKVVTVNGFSKVYSMTGWRLGYAAGPEKIIKAATNIQDHTTSGANSITQLAGLEALRGSQESVTVMVKEFDRRRKYIVERLNTIKGISCLLPQGAFYAFPNVSRLCENLSLKGSFDLVSLLLEKAHIAFVPGAPFGADAHIRISYATSMENIEKGMDRFEKFLNT

SEQ ID NO: 71111 - protein, 253 aa, Escherichia coli
IVAAGIKEIVLVTHASKNSVENHFDTSYELEALLEQRVKRQLLAEVQSICPPGVTIMNVRQAQPLGLGHSILCAHPIVGDNPFVVVLPDIVLDNASADPLRYNLAAMVARFNETGRSQVLAKRMPGDLSEYSVIKTKEPLDVEGKVSRIVDFIEKPDQPQTLESDLMAVGRYVLSADIWPELAKTVPGAWGRIQLTDAIAELANKQSVDAMLMTGESYDCGKKMGYMQAFVQYGLRNLKEGAKIRKSIEKLLS

SEQ ID NO: 71112 - protein, 693 aa, Candidatus Kuenenia stuttgartiensis
MSNKVNVTIDGKDYQFDTGMTIYDAAKSLGVEIPTLCHNDKISHYGSCWVCTVEQKSGRGGMVPSCSTKLENGMVVELENEKVRASRKAALDLLLSDHFGDCYAPCNQKGCPANINIQGFLFLEARGLYKEAANLIREKAPFPNVLGRVCPRPCEEVCRRQKVDKPILIGIQKRYISEMEEKEGGPFLPKTPQKSSGKKVTIIGAGPAGLSAAYYLRLQGHEVTIYERHPKHGGMLRYGIPYYRLPEKVMDLEGDAIINQLDVTIHYNTEVGKDIDFEKIMQDSDAILLAVGASRASYMNIEGEDLPGVFSGIDLLEKLAKYEPVNIGRRVVVAGGGSTAMDAARASVRLGAKATIVYRRTEKEMPAHHAEVRDAYDEGVDIQVLTNPIKIEKSGKGLKIICVKMELSEPDESGRRRPVTLEGSEFAIEADSIIMAIGQKTDFSFVKNKAVNKWGMFDTKGNSYQTVADPRIFVAGDCYKGPDLAVRAVADARKAAQSINQFLNGEEVVGEKIRFSSYPGDLDTLPAEMFESFKPVTRKEIDLLPVEKRLGNFEEVECSFTRDEMTNEANRCLECGCNVVDICSLKKHSQKYQADQNLYVGERRTYKTDYSHEKIKMEIHKCINCNACVRACDEVKKCYILGDAGRGFSTRITPMINIPLGETHCDGCEECVNVCPTAGVRIDRDIYLTNTCE

SEQ ID NO: 71113 - protein, 310 aa, Mesorhizobium sp. BNC1
MKLFAGNSNRVLAEAIARYLNISLGKAMVRRFADQEIFVEIQENVRGEDVFVLQSTSYPANDHLMELLIMIDAFRRSSARRITAVLPYFGYARQDRRTSGRTPISAKLVANLITQAGADRVLTLDLHAGQIQGFFDIPTDNLYAVPVMARDVKAHYKLENVMVVSPDVGGVVRARALAKRIDAPLAIVDKRRDRPGESEVMNVIGDVHGRDCLLIDDIVDSGGTLCNAAEALIANGATSVTAYITHGVLSGGAVARITGSKLKELVITDSIQPTSSVEAAHNIRAITIADLIGEAISRTASEESVSSLFN

SEQ ID NO: 71114 - protein, 275 aa, Gluconobacter oxydans 621H
MRLSPHMAVMQGAAQKASRRLLRDFAEVEQLQVSIKGPGDFVSQADLRAETILREELSRARPGYAFLMEESGASGGDNWTWRWIVDPLDGTTNFLHGIPHWAISIGLQRKLPDGTIEMAAAVVYNPAANEMFWAEKGVGAFLNERRLRVSGRRNMHEALFATGIPFAKVPSSSRLPFARVLGALMPQVAGIRRFGAAALDLAWVAAGRYDGYWEFGIKPWDCAAGLLLVREAGGYATDPDGTELHDLPDDVNVVAGNTNLHGPLRALVHEALNRS

SEQ ID NO: 71115 - protein, 367 aa, Mesorhizobium sp. BNC1
MGFKCGIVGLPNVGKSTLFNALTKTAAAQAANYPFCTIEPNTGEVAVPDPRLKKIAEIAASKETVPTRISFVDIAGLVRGASKGEGLGNQFLANIREVDAVVHVLRCFEDDDITHVEGRIDPVADADTVETELMLADLESLERRIVQVRKRATGKEKEAMSILPVMEEALKLLQDGKPVRLVAAELDPEGMRILRSLNLLTSKPVLYVCNVAEGDAATGNAHTSAVEKMAEAQGARTVIISAAIEAEVAQLPQEEAAEYLEAMGLHEPGLDRLIRAGYELLDLITFFTAGPKEARAWTVQKGAKAPQAAGVIHTDFERGFIRAQTIAYDDFVQLGGETAAREAGKARDEGKDYVVQDGDVMLFKFNV

SEQ ID NO: 71116 - protein, 234 aa, Zea mays
  misc_feature (225)..(225): Xaa can be any naturally occurring amino acid
MKLNISYPANGSQKLIDIEDERKLRVFMDRRMGQEVPGDSVGDEFKGYVFKITGGNDKQGFPMKQGVMHPTRVRLLLADGHSCYRPRRTGERKRKSVRGCIVAADLAVLALSIVKQGDAELPGLTDTVHPKRLGPKRATKIRKFFGLSKEDDVRKFVIRREVQPKAEGAKPYTKAPRIQRLVTPQRLQHKRHRIALKRRQAEASKDAANEYAQLMHKRVHEEKAXEGEIRKRRA

SEQ ID NO: 71117 - protein, 238 aa, Polaromonas sp. JS666
MTMIVRNLQLVRDRITTACVAAGRDPASVRLLAVSKTFGADAVIDAMSDGQRAFGENYVAEGVEKILALRAWQAAQAGAPAVLEWHCIGPVQSNKTRLVAEHFDWVQSVDRLKTAQRLSEQRPPHLPPLQICLQVNVDGGANKSGAAPEEALALAQEIAQLPRLTLRGLMAIPEPAIDFVAACAVHARTRAIFDQINAAGVLPAPMDTLSMGMTADLEAAIHSGSTMVRVGTAIFGKR

SEQ ID NO: 71118 - protein, 136 aa, Zea mays
  misc_feature (12)..(12): Xaa can be any naturally occurring amino acid
  misc_feature (52)..(52): Xaa can be any naturally occurring amino acid
LTKYLNSAVAGXLMQKGLVYLVGAGAHQNKPFVPILATSKVLYKITYIEFTXRIVHILILGKPLIYTSYKAQRSSPLKPLGEYQKLQLATSFIKIANAKGVYVLPPTDIIIPDKFAAYAHSNIVPGTDITDDWMRF

SEQ ID NO: 71119 - protein, 189 aa, Zea mays
TQESDSSDSDSDEDESVDDIPAKAQVVAKKKEESSSSSDSDSDSESEDEKPAANLKKPPVPSVQKKTQESDSSDSDSDEDESDDIPAKAQVVAKKKEESGSSSDSDSESESDDEDSNAKTVPPAKAAAIKKKGDSSESSETDSQSDSEDSEPEKPTVPAKRPLATNKKNEQVLSYKILFYLLVLPLPVY

SEQ ID NO: 71120 - protein, 244 aa, Arachis hypogaea
VSVIAAYTEAQGPTNEKFDKRRIPYNSLSGTSMSCPHISGIVGLLKTMYPSWSPAAIKSAIMTTATTLDNEAEPLLNAANRKATPFSYGAGHVDPNSAMDPGLVYDTTMDDYLNFLCALGYHETQLSMFTEGHHYKCATNFSILNLNYPSITVPEFPGSLTLTRTLKNVGAPATYIAQVQNPRGISVFVKPNILEFKEVGEEKSFEVTLKGRQGEARNNHFKFGKLIWSDGNHYVKSPIVVKSN

SEQ ID NO: 71121 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVEVRRYGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADIPLDGLVDALLERLPPSDRTTRGKEPHAYPTGLQADDGPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFAEMAAGMGGDGVRVRTRAELKAALDKAFATRGRFQLIEAMIPRGVLSDTLARFVQGQKRLHAAPRE

SEQ ID NO: 71122 - protein, 453 aa, Nitrosomonas europaea ATCC 19718
MQVAEVKKVLVPDIGDFEDIPVIEIMVKPGDSVQVEDPLIVLESDKATVEVPSPYSGIIREIRVQMGSKVSKDSEILTMEVVSAESDNKTTSSQPQPSAGSQPAQPTRPIETGAGQSEEEPAAKPAATTTKPATPSAPIQIPDHTIDQHNKIIPHASPSVRRFARELGVDLSKVVGTGPKQRILKEDVQAFVKQALTGGRNARGGTLDLLPWPHVDFAKFGPIELKSLSRIREISGANLHRNWVMIPHVTQFDEADVTDLEALRKNHNETRQNNGTKLTILAFLIKAVTAALKKFPEFNASLDNSTTESQLIIKRYYHLGFAADTPNGLVVPVIRDADQKGVIGIAEELTRLSSLAREGKLKPGDMQGASFTISSLGGIGGTGFTPIINAPEVAILGVSRASLKPVYQNGQFVPRLVLPLSLSYDHRVIDGASAARFTAHLASILADMRLALF

SEQ ID NO: 71123 - protein, 446 aa, Novosphingobium aromaticivorans DSM 12444
MGTYTFRLPDIGEGIAEAEIVAWHVKVGDTVEEDGRLADMMTDKATVEMESPVAGKVVSVAGEVGDVVAIGSALVVIETEGEDEAPAPAAAPAPKAAIVEERIEVETPEPPQPPSPPQPLFVSREVEAPPAVPATGSGVAPGPRASTAPDTIGGAGAKVLASPAVRQRARDLGIDLSEVRPSEEGRIRHADLDQFLSYNASGGYRAAGAERGDEVIRVIGMRRRIAENMAASKRHIPHFSYVEECDVTALEIMREQLNAGRGDKPKLTMLPLLITAICRALPQYPMINARYDDEAGVVTRYGAVHLGMAAQTPAGLMVPVIRNAQTLNLWQLAREIVRLAEAARSGSAKSDELSGSTLTVTSLGPLGGVATTPVINRPEVAIIGPNRIVERPMFVSDGMGGERIEKRKLMNISISCDHRVVDGHDAASFIQAVKKLIETPVLLLAD

SEQ ID NO: 71124 - protein, 139 aa, Zea mays
  misc_feature (7)..(7): Xaa can be any naturally occurring amino acid
QDNVAAXNFTPSSKLGKMLMAKCRTLQEENEEIGAMASEGKIHELGMKIAVLKSQNNELRNQFDVLYKHMDGVTNDVERSNELVSILQEELEAKDLELTRLKEVLAQKGATQDAPVETSDDAGNGQEADSDTLQVKAES

SEQ ID NO: 71125 - protein, 543 aa, Hypocrea lixii
MAIGNIYVIAGVSVVGGALFGFDISSVSAQLAEQSYLCYFNQDENPPTTADGKCGGPRSLVQGGITASMAAGSWLGALISGPLSDRLGRKYSIMVGCIIWVIGSTLSCASQNIGMLIVARIINGISVGIESAQVPVYIAEISPPSKRGRFIGMQQWAITWGILIMYYISYGCSFIGEDNPVSYNTAAWRIPWGLQMIPAFFLFFMMMPLPESPRWLARKDRWEDCRAVLTLVHGKGDPNHPFVAYELQDIKDMCEFERQHADVTYLDLFKPRMINRTFIGLFTQIWSQLTGMNVMMYYIANIFSMAGYSGNANLLASSIQYIINVLMTIPALLWVDKWGRRPTLLIGSVLMALWMYANAGILATYGEVVPGGIDHVAAQSMRVTGAPAKGLIACTYRFVASFAPTWGPVSWTYPPELFPLRLRGKGVAMATSGNWAFNTALGLFTPVAFANIKWKSYLIFAVFNTVAFFHVFFVFPETAGKTLEETEAMFEDPNGIPYMGTPAWKTKVATSLTVRAEQGDLEAKIAHDTEKPPIHTHEEETTQ

SEQ ID NO: 71126 - protein, 205 aa, Geobacillus kaustophilus HTA426
MKVYDVTAPIYEGMPVYKNKPEKQPKRTTITNGYVTESRIDMDVHTGTHIDAPLHMVEGGATFETIPLNDLVGPCKLFDLTHVNDRITKDDIAHLDIQEGDFVLFKTKNSFEDAFHFEFIFVAEDAARYLADKQIRGVGIDALGIERAQEGHPTHKTLFSAGVIIIEGLRLKDVPEGRYFMVAAPLKLVGTDAAPARVLLFDREP

SEQ ID NO: 71127 - protein, 355 aa, Magnaporthe grisea 70-15
MGACMSASSEESEQKKRSQKIDKDLEEDSKRLRRECKILLLGSGESGKSTIVKQMKIIHLKGYSDDELYNYRPTVFKNLIECAKAVISAMRQFDIEPQLEGNKELCDYLLDYMVESGPQAEIDPKVGQAVQSIWNDPAREQLMDRQTEFYLMDSAEYFFQEVLRIVSPDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLGNYFPDYSGGNDVNKAAKYLLWRFNQVNRAHLNLYPHLTQATDTSNIRLVFAAVKETILNNALKDSGIL

SEQ ID NO: 71128 - protein, 403 aa, Burkholderia sp. 383
MSIDYSPIPCPVVVPLDAILPEEPLLMMGAGPVPIPAAVAKANTVVINHLGATMAKIIEQVKEMARYVFQTRTKWVLGVAGPGSAAMEMAISNLAWRGTRVLSIRNGFFSARMAEMATRVGADVAMLEVADRAVASLDEIADAIARERPEIVTIVQGETSNTVWNRDLRDIAALAKAAGALVVVDAVCTLSTMPLEMDAWGIDAVITGGQKGLSSIPGVSLIAFSDAAWNRMKQRPEPNAHWCLDMALAENFWHNAGYHYTAPVSGVLALHEALRLVCAETLESRFARHLRCSLALQAGVESMGLKLYAPKDCRLNSVVGIETPEGLTPGMVCGHISKQYQVEISGSFGLPIVRIGQMGEQCREHNLFRTLHAFGRTMVDLKVPVDLPAGVAALEQELSRRGA

SEQ ID NO: 71129 - protein, 572 aa, Aspergillus oryzae
MASSVLPVALQNKLLGYSRAPNAQLAALNLDILKNIVFLFFILRYVRKTFYSLRGYGVLGSLRNVYAAIRLFCYSVFLRFPGVRGQVDKQVSSAIENLETKLVATGPGVTRYLNLPKEGWTPEQIRAELEKLANMEHTRWEDGRVSGAVYHGGQDLLKLQAEAFGQFGVANPIHPDVFPGVRKMEAEIVAMVLALFNAPSDGAGVTTAGGTESILMACLAARQKAYAERRVTEPEMIIPDTAHAAFYKASEYFGIKLHRVPCPAPEYKVDIPSVRRLINPNTVLLVGSAPNFPHGIVDDIPALSRLATAYKIPLHVDCCLGSFVVAFLKKAGFPSPYEEEGGFDFRLPGVTSISVDTHKYGFAPKGNSVLLYRNRTYRSYQYFVYPDWSGGVYASPSVAGSRPGALIAGCWASLMSVGESGYIKSCLDIVGAAKKFEASIREHPLLSKNLDVVGKPMISVVAFQSKNGAVDIYDMADALSAKGWHLNALQSPAAIHVAFTIPTASALDKLTADLVEVVEKELDKAEERKRQGKSYIIKRGDTAALYGVAGSMPDKSIVSRLAEGFLDTLYKA

SEQ ID NO: 71130 - protein, 328 aa, Solanum habrochaites
MAVNGASSSGLIVSFGEMLIDFVPTVSGVSLAEAPGFLKAPGGAPANVAIAVTRLGGRSAFVGKLGDDEFGHMLAGILKTNGVQADGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILADEARLKEVLRFSCACGAITTTKKGAIPALPTASEALTLLKGGA

SEQ ID NO: 71131 - protein, 181 aa, Mesorhizobium sp. BNC1
MKQSLEDTLLAAIRTIPDYPRPGILFRDITTLLGDARAFRRAVDELVHPYAGAKIDKIAGIEARGFILGGAIAHQLSSGFIPIRKKGKLPHETVRVAYSLEYGLDEMEMHIDAVSPGEKVILVDDLIATGGTAEAAVRLLRQMGAEIVAACFVIDLPDLGGRAKLEAEGVDVRTLVSFEGH

SEQ ID NO: 71132 - protein, 735 aa, Oryza sativa Japonica Group
MAAGGSSGGGSLPLPAFLLRQIRRPPPEGEPASSRATSSAESSIASLIDRATSTTSPSVDPALLRAIKSAARASDGAIRDAFRILLSLMSKPHAHVRLLAFIIADELFMRSKLFRSLLTDVLDGFLPLAVGFRRAHPLPPPAASATLLRKAAVQALERWHHLFGAHYRQLRLAVEYLKESARVQFPGLRAAVEARAAREARTQEILTAKVEQLRRNLAAIKAEIRSAIDEIRNGLDIIRIESEKFNNYANDEDEEQEIASLAMRSIRMASLMAGEWVPETQENEAVFDALRESYRLLVSKHLVTVQEWISVLVRVNLADNRFRDSALKEFIDVKNEIRAVRNRCSELGLNLDNVHRRKGVQEEEDDDFWVEGNIEVPSPGRVGTSADVASSSKDTRKGKKPVGGTDTDDGKAPNAGNSPQELDPERAKLHAEAPVLPWSSVLDRWGSNRDALVNQRGLELESHWGRVDNDAVIPAAKIAELNVHSSIYREDPVEILPCLAPLKKGGLCQRRDLKICPFHGPIVPRDAEGNPIHQSDGHCDAEGNPVGQTDGHYDAAVSPIDPNEDSSDVRENMIMPDGSSDGECIYESSPSRTANINNDISDSDVGHDLGKITVEQLARQAVQNVRKRDRDDKKALEKAQRARIRQHNQDVLREAALASTSRSAADYDLPSPAVSRRGRRGKTKGPTLASMLKKKVTSKDRIAERLLNARARDATIREVSHTEDMSYREAFPNQW

SEQ ID NO: 71133 - protein, 180 aa, Capsicum annuum
MASSVMSTATVATGANAAQASMIASFNGLKSAASFPVTRKQDLDITSIASNGGRVQCMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEGY

SEQ ID NO: 71134 - protein, 125 aa, Francisella tularensis subsp. holarctica
MAITKEDILNAVAEMSVMDVCDLVKMMEDKFGVSAAAAVAVAAGPVAGPVEAAEEKTEFDVVLVDAGSNKIAAIKAVRGATGLGLKEAKDAVEGTPFTVKEAASKEEAEALKKQLEEAGAKVELK

SEQ ID NO: 71135 - protein, 142 aa, Yersinia pseudotuberculosis IP 32953
MALERTFSIIKPNAVANNNIGAIYARFESAGFKIIAAKMLHLTKEQAEGFYAEHKGRPFFDGLVEFMTSGPIIVQVLEGENAVQRHRDIMGATNPDNALAGTLRADFADSFTANAVHGSDAVESAQREIAYFFAADEIFPRS

SEQ ID NO: 71136 - protein, 367 aa, Debaryomyces hansenii CBS767
MTAEYTKPVRRITNTEDLEIWNGSQAYSTILDFVQDLQDLVVGLTNDAQVTVSSSSEELLKVLDKVNEIIENNPVVHEKDISRFGKIEFRDFYDEICKKSFDILKPLVEKLEDDPRIELATYFNESWGNRTRIDYGSGHELNFIAFLACLQKLGIIKHEDYPCVIVRVFTKYMTVMRALQKLYWLEPAGSHGVWGLDDYHFLPFLFGSSQLATHPHMKPKLIHNEELVESFYKQYMYLECIHFINTIKTTPANQDQKLSLRWHSPMLDDILSAKSWAKIKEGMIKMYKAEVLGKLPIVQHFMFGSIIPCPDGVSEYHEHDDDSDCGHDHGGTVNTWGDCCGIKIPSALAASEMNKINNPNNKPIPFD

SEQ ID NO: 71137 - protein, 153 aa, Saccharomyces cerevisiae
MSSQTERTFIAVKPDGVQRGLVSQILSRFEKKGYKLVAIKLVKADDKLLEQHYAEHVGKPFFPKMVSFMKSGPILATVWEGKDVVRQGRTILGATNPLGSAPGTIRGDFGIDLGRNVCHGSDSVDSAEREINLWFKKEELVDWESNQAKWIYE

SEQ ID NO: 71138 - protein, 249 aa, Candida albicans SC5314
MSAEAPKRQFGDRRRGGRRGGRRDGEEKGWTPVTKLGRLVKAGKITSVEQIYLHSLPVKEYQIIDLLLPDLKDDVMKIRSVQKQTRAGQRTRMKAVVVIGDSNGHVGLGIKTAKEVASAIKAAIVIAKLSIIPIRRGYWGSNLGQPHSLPCKVTGKCGSVAVRLIPAPRGKGIVASPVVKRLMQLAGVEDVYTSSSGSTRTTENTLKAAFAAIGNTYSFLTPNLWAETPLAASPLEVYAEEAAAGKKRY

SEQ ID NO: 71139 - protein, 412 aa, Aspergillus oryzae
MLSTLRVASRKAASRDANLRTVVVGARHASAWSNVPQGPPDAILGITEAFKADSFKEKINLGVGAYRDDKGKPYVLPSVRAAEDKVVASRFDKEYAGITGVPSFTKAAAELAYGKDSPAIKEDRLVITQSISGTGALRIGGAFLQRFYPHAKKIYLPNPSWANHNAVFKDSGLEVEKYRYYNKDTIGLDFEGLIADIKAAPENSIILLHACAHNPTGVDPTQEQWRQISDVMKQKGHFAFFDMAYQGFASGNADKDAFAPRHFGLYGERVGAFSLVCENAEEKKRVDSQVKILIRPFYSNPPIHGARVASTIMNDPELNQQWLGEVKGMADRIIEMRSLLRKNLEELGSKHDWSHITSQIGMFAYTGLKPEQMDALAKEHSVYATKDGRISVAGITSDNVKRLAESIFKVTG

SEQ ID NO: 71140 - protein, 301 aa, Gluconobacter oxydans 621H
MNAPTTSVSLKDALARACSEIESTIDTLLPMVPGDESVLIEAMRYAALGGGKRLRGFLAVEVATLFGADRKAALRVAASVELLHAYSLVHDDLPSMDDDDLRRGQPSTHKQFDEAIAILAGDALQTRAFEILVEPETSPNATVRANLALALAQASGSAGMVGGQVIDIRGEGRALPLDQVRRLHALKTGALIRYAAESGAILADVDDARRAAIVAYGRDLGTAFQVADDVLDSTATAEELGKTAGKDEASGKSTYVSLLGIDGARAEARRLSDRAREALSSFGAQADALRALADYVVERRN

SEQ ID NO: 71141 - protein, 669 aa, Gluconobacter oxydans 621H
MSSSAGTDPMSKKTSTIPTYGRYPELDRVRFPADMRNLSVDQLKQLADELRSETVDAVSTTGGHLGASLGVVELTVALHAVFNTPDDRIIWDVGHQAYPHKILTGRRDRIRTLRQPEGLSGFTRRAESEYDPFGAAHSSTSISAGLGMAVAHHLRAEEDPSYHERNVIAVIGDGSISAGMAYEAMNNAAVAGPGANRLIVVLNDNEMSIAPPVGSMSDYLSRLMSSRQFFSLRDLAGKVAKRLPGKIERTAKRAEEYARGMITGGTLFEELGFYYVGPVNGHDMSQLVPILRNLRDADDQGPILLHIITEKGRGYKPAEAAGDKYHAVSKFNVVTGEQKKAPAGPPSYTSIFSRELMRRAKTDDKLITITAAMPSGTGLNAFAKAYPDRFFDVGIAEQHAVTFAAGIASEGLRPFCAIYSTFLQRAYDQVVHDVALQNLPVRFAIDRAGLVGADGATHAGAFDLNYLCCLPNMVVMAPSDEVELLHATATACEYDAGPIAFRYPRGNGIGLDLPEKGEVLEIGKGRIVREARRAPNARGGVAILSLGPRMHESLRAADQLAAQGVPVTVADARFAKPIDKALVEDLARQHEVFITIEEGAIGGFSSLVVQHLAETGLLDKVKFRPMALPDRYIDHNTQDAQYEDAGLTAPHIVRTAADALGVEVAQQSA

SEQ ID NO: 71142 - protein, 238 aa, Glycine max
MISSRQDQTGAPLSSSTTTTTPVVAPISVVDHGLPYDTHNLYDVSFNNTHTIYTLLTSDPSLVDSWISTVLRDHQHQHQQRVLTVGLDIEWRPNTQRNMQNPVATLQLCVAERCLVFQILHSPSIPPSLVSFLADPNITFVGVGIQEDVEKLLEDYNLNVANVRDLRSFAAERLGDLELKRAGLKSLGLRVLGLEVAKPKRVTRSRWDNPWLTAQQVQYAAVDAFLSYEIDRRLSSYN

SEQ ID NO: 71143 - protein, 411 aa, Capsicum annuum
MGTLRAILKNPDDLYPLIKLKLAARHAEKQIPPEPHWGFCYLMLQKVSRSFALVIQQLPVELRDAVCIFYLVLRALDTVEDDTSIPTDVKVPILISFHQHIYDREWHFSCGTKEYKVLMDQFHHVSTAFLELGKNYQQAIEDITMRMGAGMAKFICKEVETTDDYDEYCHYVAGLVGLGLSKLFHASGKEDLASDSLSNSMGLFLQKTNIIRDYLEDINEVPKCRMFWPREIWSKYVNKLEELKYEENSVKAVQCLNDMVTNALSHVEDCLIYMSNLRDPAIFRFCAIPQVMAIGTLAMCYDNIEVFRGVVKMRRGLTAKAIDRTRTMADVYGAFFDFSCMLKSKVNNNDPNATKTLKRLEAILKTCRDSGTLNKRKSYVIKSEPTYSPVLIFVIFIILAIILAHLSGNRS

SEQ ID NO: 71144 - protein, 691 aa, Arabidopsis thaliana
MGGSSETKILQELILYAASAAFSCLVLFAGLRHLDPNREASKKALEHKKEISKRLGRPLVQTNPYEDVIACDVINPDHIDVEFGSIGGLETIKQALYELVILPLKRPELFAYGKLLGPQKGVLLYGPPGTGKTMLAKAIAKESGAVFINVRVSNLMSKWFGDAQKLVSAVFSLAYKLQPAIIFIDEVESFLGQRRSTDHEAMANMKTEFMALWDGFSTDPHARVMVLAATNRPSELDEAILRRLPQAFEIGIPDRRERAEILKVTLKGERVEPDIDFDHIARLCEGYTGSDIFELCKKAAYFPIREILDAERKGKPCLDPRPLSQLDLEKVLATSKKTQVAAGEYSLSSQSSAWRGSREPDEVQAAISGISKLLVSQIINLHFLSSISQNYLLGAFKPACNISITFSDGKNRKQVPMKKENGQTALVPLFHSQDTISGKVCIEPYQGKKVEHNGVKVELLGQIEMYFDRGNFYDFTSLVRELDVPGEIYERKTYPFEFPTVEMPYETYNGVNVRLRYVLKVTVTRGYAGSILEYQELVVRNYAPLPDINNSIKMEVGIEDCLHIEFEYNKSKYHLKDVILGKIYFLLVRIKMKNMDLEIRRRESTGAGANTHVETETLAKFELMDGTPVRGESIPVRLFLAPYDLTPTHRNINNKFSVKYYLNLVLVDEEDRRYFKQQEITLYRLKEDASS

SEQ ID NO: 71145 - protein, 187 aa, Oryza sativa Japonica Group
MAGSEEKKEMQDPRTQAIASTIRVVPNFPKPGIMFQDITTLLLNPPVFKDTIDLFVERYTGKGISVVAGVEARGFIFGPPIALAIGAKFIPLRKPNKLPGEVMSKEYELEYGADCLEMHVGAVQPGERALVVDDLVATGGTLCAAIVLLERAGAEVVECACVIELPELKGRERLNGKPLYVLVESHS

SEQ ID NO: 71146 - protein, 363 aa, Idiomarina baltica OS145
MGFRCGIVGLPNVGKSTLFNALTKAGIEAANFPFCTIEPNTGVVAVPDPRLDVLESIVNPQKVIPTTMEFVDIAGLVKGASKGEGLGNQFLANIRETDAIGHVVRCFEDDNIVHVSGGINPADDIDTINTELALADLDSVDKSLHRLGKKAKGGDAQAKAEIAVLEKLKPALDEGEMARSVHLTDDEKAVIRSYNLLTLKPTMYIANVNEDGFENNPHLETVRQIAAKENAVVVPVCAAIESEIAELDDDDKAAFLEELGQAEPGLNRVIRGGYQLLNLQTYFTAGVKEVRAWTVKIGASAPQAAGRIHTDFEKGFIRAEVVGYDDYVEYNGEQGAKDAGKWRLEGKEYIVKDGDVIHFRFNV

SEQ ID NO: 71147 - protein, 312 aa, Idiomarina baltica OS145
MKLFAGNATPELAQKIADRLYIKLGDASVGRFSDGEISVAINENVRGADVFLLQSTCAPTNDNLMELIVMVDALRRASAGRITAVMPYFGYARQDRRVRSARVPITAKVVADFLSSVGVDRVLTVDLHAEQIQGFFDVPVDNVFGTPVLLEHMRNQKFDNPVVVSPDIGGVVRARAFAKLMDDTDLAIIDKRRPSANVSQVMHIIGDIKDRDCIIVDDMIDTGGTLCKAAEALKQHGAKRVFAYATHPVFSGNAVSNIKESAIDELVVTDSIPLSEEMKATGKVHQLTLSGMLSEALRRVSNEESISAMFDY

SEQ ID NO: 71148 - protein, 521 aa, Zea mays
  misc_feature (85)..(85): Xaa can be any naturally occurring amino acid
MDHLPLTSPAAPAVAASLLPSQGGGRVLDAYKTALATAASAAAYAVMARSMARELLPDELRAAARWCAVFARARFGRGEKERHTXVIRHQFDTGYSENHLFDAARAYVATRIDPRAMRRLCLARSRTKEPDGSGRWNTLLCMEPGGSTVDVFGGVEFTWNCVETGGDDKKGKGGGGRPRESLEVSFDAEHTETALERYIPFVMSTAEQLQLRDRALRIFMNEGRSWHGINHHHPATFDTLAMDPVLKQSVVDDLDRFLKRRDYYRRIGKAWKRGYLLYGPPGTGKSSLVAAMANYLRFNLYDLDLSEVRLNSALQKLLIHMPNKSVLVIEDIDCCFDNAAASRNGLDMDPNYSSGSGSGSDSSDENWAQPRVAPPKARGITLSGLLNFIDGLWSTCGEERIIVFTTNYKDRLDSALLRPGRMDMHVYMGYCGWEAFKTLARNYFLVDDHKMFPEIQELLSAVEVTPAEVSEMLLRSENGDVALGILAEFLREKRRRGRKETKEEKDATEDKDEEEVAEKAA

SEQ ID NO: 71149 - protein, 391 aa, Nitrosomonas europaea ATCC 19718
MPTTRHYDIVIIGGGIQGAAVAQAAAALGYNVLVLEKTALAAGTSSRSSKLIHGGLRYLESGQFGLVWESLKERAALLRLAPSLVRLQPFHIPIYDQTSRDTLTIRAGLSLYALLAGLSKGAGFHSIPRRRWGELDGLSTRGLRHVFQYWDAQTDDQALTRAIMHSASSLGVELHCPAEFIHARISGEICEIEFLENNQAYQCTASSLVNAAGPWVSQVAERISPAPPAYPVELVQGTHLILEGSLDKGCYYLESPQDRRAIFALPWKQHILLGTTETVFEGAPDKALPLVSEENYLLGCFRYYFPDHGATVRERFTGLRVLPVSRNNPFGRSRETHLQCDSPESPRIVGIYGGKLTVCRATARKVLHTLRPSLPVRIPKADISQLTLKLP

SEQ ID NO: 71150 - protein, 480 aa, Corynebacterium efficiens YS-314
MFGGRTHPGPTRTPSRTGVVLCAGMLIDAGYPRPTGVVFPHMNLTRNDRLDRLPVTSKHRKLLGGSGIGWALDAMDVGLISFIMAALVTHWDLSPTEASLLGSIGFVGMALGATFGGLLADKVGRRQVFALSLLVYGLATGASALSVSLVMLMALRFVVGLGLGAELPVASTLISEFSPRRIRGRMVVILEAFWALGWIMAAIIGTFVVTIGENGWRWALALGCVPAAYAIYVRLGLPESVRFLESKGRHEEAEAIVVSFEEQAVREGKPLTDSLPESRDVEVEGSESIWAKNLRRRTAALWVVWFCINLSYYGAFIWIPSLLVADGFTLVRSFQFTLIITLAQLPGYAAAAWLIEKWGRRATLSTFLAGSAVSAAMYGMADAEWQILVAGCLLSFFNLGAWGALYAIGPELYPTDVRGTGTGAAAGFGRIASIIAPLIVPPVISLGGPVLLFALFASAFALAAVAAFTLPEQKGKALAD

SEQ ID NO: 71151 - protein, 313 aa, Streptococcus suis 89/1591
MKEIYLAGGCFWGMEGYFSQIDGILDTSVGYANGQVETTNYQLLKQTDHAETLYLAYDETRINLREILLYYFRVIDPFSVNQQGPDKGRQYRTGIYYTDKADLPTIEQVMMEQSQLFGGRPLAVEVEPLAHYIPAEDYHQDYLKKNPQGYCHIDLGQAKIPLIDVADYQKPDQQVLKDSLTDLQYQVTQEAATERPFENEFWNSDQAGIYVDITTGEPLFLSTDKFDSGCGWPSFTKPISKEVATYFQDKSHGMNRIEVRSRAGHAHLGHVFDDGPRDKGGLRYCINSAALRFIPREEMEAAGYGLFLDLLSE

SEQ ID NO: 71152 - protein, 753 aa, Arabidopsis thaliana
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTECVRRIASATSFPLERLKLISAAMEEKDWEGSPLSENEAGLLCYDDEEYQFGGPAPKLQFRWRDLIQDMIDLGMAEVEVKRGKLWTTTGIIRTGKTYCFIEEALYLSEIGELQLLGDEDDVVISLKDLYGEIAEGKYGCCWENYEVYRYLKGLGYILGRHGVPWTTKYAVNTTPSDEDESLCAAEFFQDRDSVTKLLSDMHICDARPVFDVYLPNSQFKKSSPGEPSFVTCFSGDSPPSKEEIKVLQKCIVSPLMFCHIAQGRATFFSFNSIDLLVLP

SEQ ID NO: 71153 - protein, 436 aa, Erythrobacter sp. SD-21
MKIAMVGSGYVGLVSGACFADFGHDVVCIDKDQSKIDRLHDGIMPIYEPGLAELVGSNVAAGRLTFTTSLAEGIKGADAIFIAVGTPSRRGDGHADLSFVYAVAEEIGANLANDAVVVTKSTVPVGTGDEVERILKDSGTTHKFSVVSNPEFLREGAAIGDFKRPDRIVIGAEDEFGREVMSAVYRPLFLNESPILFTGRRTSELIKYAANAFLATKITFINEIADLCEKVGANVQDVSRGIGMDNRIGSKFLHAGPGYGGSCFPKDTLALLKTAEDYDSPTRIVEAVVKVNESRKRAMGRKVLDALGGADKARGKKVALLGLTFKPNTDDMRDSPAIAVAQTLTDAGAEVAAYDPEGMELARPLMPDVAMVDDPYAAIEGADVVAIVTEWDVFRALDLKRVKDLAKAPVLVDLRNIYRPDDMRAAGFEYTSIGRG

SEQ ID NO: 71154 - protein, 104 aa, Streptococcus suis 89/1591
MVQVITDANFEVETQEGVVLVDFWAPWCGPCRMQAPILEQLADEVDEDELRIYKMDVDENPNTARQFGIMSIPTLLFKKDGQVVKQVAGVHTKNQIKAILAEIG

SEQ ID NO: 71155 - protein, 516 aa, Geobacillus kaustophilus HTA426
MSDMYDKINELYDRRREIELGGGDEKIEQQHAKGKLTARERIDLLLDEGTFVELNPFIEHRCTDFGLGEKKGPGDGVVTGYGKINGRTVFVFSQDFTVFGGALGEMHAKKIANIMDLAAKTGAPVIGLNDSGGARIQEGVLSLDGYGHIFYRNAIYSGVIPQISVIMGPCAGGAVYSPAITDFVFMVEKTSQMFITGPKVIEAVTGEKISAEDLGGARVHNTISGNAHFAAANEEEALAEVRRLLGYLPSNNNEKPPFGPIPDGDDYRPDLADVVPIDAVRPYDVRHVIAQVVDDGSFFEVQKDFAKNIVIGFARIKGEVVGLVCNQPKFMAGGLDIDSSDKAARFIRFCDSFNIPIITFEDVTGFFPGVKQEHGGIIRHGAKILYAYSEATVPKITVILRKAYGGAYVALNSKSIGADVVYAWPNAEVAVMGPQGAANIIFAGEIEKSPNPEETRAQKIAEYREKFANPYVAAKYGMIDDVIDPRDTRIKLIQALEMLRNKHEERPKKKHGNIPL

SEQ ID NO: 71156 - protein, 446 aa, Escherichia coli
MSKQQIGVVGMAVMGRNLALNIESRGYTVSIFNRSREKTEEVVAENPGKKLVPHYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFTKKDEDGKYLVDVILDEAANKGTGKWTSQSSLDLGEPLSLITESVFARYISSLKDQRVAASKVLTGPQAKLAGDKAEFVEKVRRALYLGKIVSYAQGFSQLRAASDEYNWDLNYGEIAKIFRAGCIIRAQFLQKITDAYAENASIANLLLAPYFKNIADEYQQALRDVVAYAVQNGIPVPTFSAAVAYYDSYRAAVLPANLIQAQRD

SEQ ID NO: 71157 - protein, 381 aa, Picrophilus torridus DSM 9790
MSRRLLMHVGPVTIDNDVLSAGLVNNAGFASPEFVEAMKYALNGFLYTVKSGKYMPFILPGSGTLAMESMTSFLKPNDSVLIISNGVFGDRWKNIFSRYNLNIDYLKAPPGKAVSLNEIENIKKHYRLAVMTHVETSTGVRFDVKSAAGILRNISDIIVADGVASISGENMEADKWDVDVVFTASQKALGAPPGAALLAISPEAVSELNDVSLSGFYNNLYAWKDVMTSILDNKSAYYTTPPVHIVFSLARAFELIKKEGIDERIKRHYIVAESIRSGIDGLGLGIVAGDDYKSNTVTAVMIDNPSEFISGLYSKNIEIASGVVPELKDRYVRIGHMGWLNINDAAATVSAMERVLHEMKYNISPGQGLKRMQEFLFNNNY

SEQ ID NO: 71158 - protein, 356 aa, Arabidopsis thaliana
MELDLSPRLPKKVYGGDGGSYFAWCPEELPMLRDGNIGASKLALEKYGLALPRYSDSPKVAYVLQGAGTAGIVLPEKEEKVIAIKKGDSIALPFGVVTWWFNNEDTELVVLFLGETHKGHKAGQFTDFYLTGSNGIFTGFSTEFVGRAWDLDETTVKKLVGSQTGNGIVKVDASLKMPEPKKGDRKGFVLNCLEAPLDVDIKDGGRVVVLNTKNLPLVGEVGFGADLVRIDGHSMCSPGFSCDSALQVTYIVGGSGRVQIVGADGKRVLETHVKAGVLFIVPRFFVVSKIADSDGLSWFSIVTTPDPIFTHLAGRTSVWKALSPEVLQAAFKVDPEVEKAFRSKRTSDAIFFSPSN

SEQ ID NO: 71159 - protein, 450 aa, Chlamydomonas reinhardtii
MASALLACGRQLSCALGGLSLGHQALGAIGGAFRRHASSHAENTNTFLREALVKLDYPEKLQNLLLTPRREMSVELVVQMDDGQIEVFNAYRVQHNNARGPYKGGLRYHPQVDLDDVRSLASLMTWKTAVMDIPYGGAKGGVTVDPRKLSERELEKMTRKLVVAIKEIIGTYEDIPAPDMNTDAKVMAWFFDEYSKYKGFSPGVVTGKPVYLHGSLGREAATGRGTTFAIRELLKALHMGKIADQKYVIQGFGNVGAWAAQLLWEAGGKVVAISDVAGAVHNEQVRGLDIGALRKHVASGKPLAEFTGGAAVPKQDILLHPCDVLIPAAIGGVIGPEEAKKLQCKVVVEAANGPTTPEGDMVLRDRGITVLPDIYTNGGGVTVSFFEWVQNLQNFKWEEDDVNRKLDRKMADAFAALWAVHKEMNVPLRTAAFVVALQRVTRAEVHRGFD

SEQ ID NO: 71160 - protein, 159 aa, Candidatus Kuenenia stuttgartiensis
MRHVISVLVENKVGVLARITGLISGRGFNIDSLAVGETENPDLSRITIVVRGDDAILEQVRKQINKLIDVIKITDFTNEEFVERDLMLLKINCPIGKRGEIIEIVNIFRGKIVDVGLRDLVIEIAGIEDKIEAMLALLRPYGIKELVRTGSIAITRGAR

SEQ ID NO: 71161 - protein, 478 aa, Pseudomonas fluorescens Pf-5
MSLQEQQTDLRGGFKQEMQTRHIVMLALGGVIGTGLFLTSGYTVNQAGPLGAVIAYIIGALMVYLVMMCLGELAVQMPETGSFSTYATRFLGPGTGYTVAWLYWLTWTVAIGSEFTAAGILMARWFPETPVWIWSALFAMVVFLSNVVSVRLFAETEFWLSLVKVITVLAFLVVGGGAILGLLHIDQAHSIGLSNFTREGLFPTGFMPIAMTLLAVAFAFSGTELIGIAAGETRDPQRNVPRAIRTTVLRLAIFFVGTIFVLATLLPREQAGLVESPFVTVFTYIGIPYSADIMNFVIISALLSAANSGLYAASRMLWTLSDQGHLPKQFSALTRMGTPLNAIIVSMAGGAASLLSSVFAPDTIYLALVSISGLAVVVVWMSIAASQIAFRRHFVANGGDVRDLKFRVRGYPWVPLGALLCCALACVGIGFDPEQRVALYFGLPFIAWCYLVYYITRSSRQRRLSLAALARPSDALQG

SEQ ID NO: 71162 - protein, 510 aa, Francisella tularensis subsp. holarctica
MKKEYDIIIIGGGATGFGCAIEAVSRGYKTLLLEASDFGKGTSSKSTKLIHGGLRYLENFDFALVKEGLEERFSFLHNAPHLTHKQSYLIPTCSYFETIKYTIGVKLYEFLSGKYKIGKSYNLNKHQTLAELPNIEASKLKKSLVYYDGQFDDTRLLISLMKTFEAKGGVALNYHKVEKIFSSTDSKLDTVKVVDTLSGEQKEFTAKHIINATGTFSDKTISLANQQDAHKYVSVVQGTHIVFDREKFPTEHAILIPETEDGRVLFILPWHDHLIVGTTDIKKEVPSLEPRADKSEIDFILETFNQYAKDKATIVDIKSVYCGQRPLVTPKKAKNSAKISRKHEIVESKDGLITVVGGKWTIFRRMGQDTLDYIETKKIAQKISKTSDQLLIDAIEPKDTYPLKVYGKNAEDIKTIQNELDNFELLARGLPYYQAEVVYHVRHEKAKTIEDVLARRTRAAFLDIKASIDAAPKVAELMAKELGKDEVWQNQQIDSFIEFSKNFNVEELYK

SEQ ID NO: 71163 - protein, 480 aa, Rickettsia akari str. Hartford
MHNYELGKFIPMSALMFCILFNQNVLRILKDSILISEISAEIAGFAKVYCVTPAAALFVIIYAKMINHLTFDKIFYYLSAFFIGFFVLFAFVIYPNIHIFHVHPDNLADWMERYPHFKWYISLVGNWGYIVYYSLAELWPNIFYVLLFWQFANELTTTEEAKRFYTLFSLFGNSSLILVGFLMMNLSSEDTIIKKFMSISDSKITLVQVSTTMVAIVSIVYCLLVRFISKNVFTNPLFYAKVKSGRSTSARIGLIKSFKYIAKSKYLWLLLICSAAFGFAINLVEAVWKAKIKELYPTVNTYAEFNSLYILWTGVAIMVMTIIGNNVMRMHNWFAAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTSISPILMVVFTFVCLAWIYAVRKIYFEYQKIA

SEQ ID NO: 71164 - protein, 416 aa, Polaromonas sp. JS666
MDRRARLLGPAYRLFYETPLHPVRGEGVWLYDADGTRYLDAYNNVASVGHCHPHVVEAIARQASVLNTHTRYLHEGVLDYAERLLGTMPSGLAHAMFTCTGSEANDLAMRIARSHTKAEGLIVTRFAYHGVTAAIAEASPSLGKFVQLGEAVRTEPAPDSYRIAPEAMGATFAAGVREAIADLRAHGMRPAALMVDTVFSSDGIFTDPPGFLAEAVDAIREAGGVFIADEVQPGLGRTGDAFWGFLRHGVLPDIVTMGKPLGAGHPLAGLAIRPDVLAAFGRECRYFNTFGGNPVSMAAGMAVLDVIEQEGLMDNAQRVGRYLRIRLSELGRRHALIGDVRGAGLFVGVEMVTDRGTRAPATAQTARIVNALRERGVLLSGTGEHANTLKIRPPLVFSEANADMLVETLDSVLTTL

SEQ ID NO: 71165 - protein, 392 aa, Sulfolobus tokodaii
MSDELDSYRAKHYNSDDPIVRLLEEKIESLTKELEKLRQDLNWYKGELEKLLAPPYIEAIVLDILPDGKVIVRSSSGPNLIVNVSSNIDIKKLKPGSLVALTQRGSTIVEVLPEREDAYVKSFEVIEKPNVHYSDIGGLNEQINEIREVIELPLKNPELFKEIGIDPPKGVLLYGPPGTGKTLLAKAVATESNATFIQVVASEFAQKFVGEGARIVREVFELARRKAPSIVFIDEIDAIGAKRVDMGTSGEREIQRTLMQLLAEIDGFKPLDNVKIIAATNRLDILDPALLRPGRFDRLIEVPLPNFEGRKEIFRIYLQKMKTDGNIRYDILASMTEGFSGAEIKNVCTEAGYIAIRNGRKYVNMTDLITAIEKIKAKNNKAKNTDRTEKYV

SEQ ID NO: 71166 - protein, 128 aa, Yersinia pseudotuberculosis IP 32953
MAYSEKVIDHYENPRNVGSFDSQDPTIGSGMVGAPACGDVMKLQIKVNEAGIIEDARFKTYGCGSAIASSSLVTEWMKGKSLEQAEAIKNTQIAEELELPPVKIHCSILAEDAIKAAIADYKSKHTAK

SEQ ID NO: 71167 - protein, 186 aa, Oryza sativa Indica Group
MAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNDRAVVVDDLIATGGTLSAAVKLIERAGAEVVECACVIELPELKGRDKLGNKPVFVLVKAD

SEQ ID NO: 71168 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPAGNGQRACIGQQFALHEATLVLGMMLKHFDFEDHTNYELDIKETLTLKPEGFVVKAKSKKIPL

SEQ ID NO: 71169 - protein, 393 aa, Staphylococcus aureus subsp. aureus MW2
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 71170 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPWGNGQRACIGQQFALHEATLVLGMMLKHFDFEDHTNYELDIKETLTLKPEGFVVKAKSKKIPL

SEQ ID NO: 71171 - protein, 175 aa, Triticum aestivum
  misc_feature (88)..(88): Xaa can be any naturally occurring amino acid
MAPTGMASSATSVAPIQGLKSTVGLPVRRRSNGARLGSVTNGGRIRCMQVWPINGVKKFDILSYLAPCIMDALLRHVYYLIRSKWVPXLELSKVGYSSRDHKSSPGYCNGRVWTTCRRSMSGCTYATQASRHAQEVHKDVPYAFSRDVGIHEYRQVTCRQLIKLKTPGLEGCSQA

SEQ ID NO: 71172 - protein, 275 aa, Mycobacterium avium 104
MKSMQELFEIAWQATQIGATTLKKTQPSSVQHKGDRDLVSDVDLTIQRDIANYLSQTTPDVALLAEESDHQPDIETAEWLWVLDPVDGTSNFVHGLPLCAVSLALLHAGRTVVAVTHAPLLGKTYHAIESKGAFVNGERITASATDSLSGAIVSLGDYAVGHDAGRLNAHRLALTAELVPRAERIRMIGAATLDLAFVAEGALDACVMMSNKPWDTAAGTLVAREAGARLTDAQGNPHTHKSASTVVAAPGIAEQLATVIRNTEVPSDRYAAAVG

SEQ ID NO: 71173 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPYGNGQRACIGQQFALHEATLVLGMMLKHFDFEDHTNYELDIKETLTLKPEGFVVKAKSKKIPL

SEQ ID NO: 71174 - protein, 236 aa, Haloarcula marismortui ATCC 43049
MNQTIAIVDASVGETPAERNLTRSLDAETTVYKVSDGHLPPVPAGGDWRYDGVVISGSQTSVYDDHGWIHDLTSWVRDVHRADVPTLGICWGHQFLAQSLGGRVVDMGEHELGYRTVHRRGEDPLFADMSPSFTAFQTHSDRVAELPAGAVELARNQYGIQAFRLGTRYGVQFHPEYDRETAEWVIGNKDLTDERRETVTATITDESVAAAREATTVFENFLGLVATHQRRPGRLD

SEQ ID NO: 71175 - protein, 248 aa, Zea mays
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGLAGLVYGDVFIASYQPVGQQEYP

SEQ ID NO: 71176 - protein, 387 aa, Zea mays
  misc_feature (104)..(104): Xaa can be any naturally occurring amino acid
MAKHLAAMCRCSLLVLVLLCLGSQLAQSQVLFQGFNWESWKKQGGWYNYLLGRVDDIAATGATHVWLPPPSHSVAPHGYMPGRLYDLYAYKYGTHAELKSLTTXYSDGTGNPDTGADFGGAPDIDHLNPRVQQELTGWLNWLKTDVGFDAWRLDFAKGYSADVAKVYIDGTQPCFAVAEIWTSLAYGGDGKPFYDQNAHRQELLVNWAQTVGGPAAAFDFTTKGVLQAAVQGELWRMKDGNGKAPGMIGWLPEKAVTFVDNHDTGSTQNSWPFPSDKVMQGYAYILTHPGTPCIFYDHVFDWNLKQEISALSAVRSRNGIHPGSELNILAADGDLYVAKIDDKVIVKIGSRYDVGNLIPSDFHAVAHGNNYCVWEKHGLRVPAGRHP

SEQ ID NO: 71177 - protein, 566 aa, Oryza sativa Japonica Group
MEAGAADEETPLIQQLPPEEQCSQYTCDGTVNSDKKPALKQSTGHWRACFFILGAQFAETLCFFMVSKNLVMYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLAKGSFFNWYYFSMNVGSLLSTTLLVWVVANIGWSVGFAIPMLLSGFGLALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKILLRMFPVWVSMVVFFVVTAQITSTLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNNTLSS

SEQ ID NO: 71178 - protein, 670 aa, Shewanella sp. MR-4
MVEKITGMLALIGVLSLFCQWVGWKLRLPAILPLLLCGLLLGPAFGVLNPDAIFGDLLFPIISLGVAVILFEGALTLNFKEIKDHGRMVTHLVSIGMVITWGCISVATFYLLNFSWEVALLFGALVVVTGPTVIVPMLRSVRPKSQLASILRWEGIVIDPIGALLAVLVFEYITVSGDPTSHVLFALGSMLTLGLGLGAVSGYLIGQVIRRNLLPHYLRNTAVLTLMLGIFVGSNLLQEESGLLTVTVMGIWLANMRGVDIAEILEFKETLTVLLISALFILLAARLDSNAMMDLGWGGVGVLAVTMLIARPLSIWVSGIGTSLSRADKWFLCWIAPRGIVAAAVSSLFAIKLEATNVQGADAIVPLVFLIIIGTVVIQSLTAGRWAKYLGVTSGSAQGLLIFGASKFSRELAKILKAKDVKVLLADSNWDNIRLARMDNIPVYFGNPASEHAETYMDLTGIGRVLIMSPYKQLNPLVTFYFQDVLGSKKVFGLNNTEQGSARHQLSESYKQRLCLFGDAVSYAKIASQMAKGAQLKVTNLTENFTFEHFRKRYGETALPLVYLTKEGKVVIVSGNETQFPNGIELISLLPVEALEEAKIQQAIAEQEAIAAQAKAAEEAALAKAKAEAEAEAERQRLEQEEQMKASEQSQPETGSQEAIATSDESLAKG

SEQ ID NO: 71179 - protein, 578 aa, Oryza sativa Japonica Group
MEAADEERAPLLQPQPQPSRGDADSEYTGDGSVDVNNQPALKRSTGNWRACFMILGVEFSENLAYYGISKNLVTYLTKILHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLSGEKGNVAAAAAPVSRWRQCTVTQVEEVKMLVRMCPIWACLVLFFSVSSQMSSTLVEQGTAMDNRVGPFTIPPASLATFHSIGVLLWIPVYDVALVPLARRATGKPKGITQLQRIGVGLAVAALIMAYSALVEERRLAAARAGAARTSILWQVPAQLMHGMAVVFTSIGKSEFFYDQAPRSMRSMCTALGQLAIAAGNYLSAFLLAVVASATTRGGDPGWIPDDLNKGHLDYFFWLMAALLLLDLLLFVFCAMRYKGSTAAS

SEQ ID NO: 71180 - protein, 447 aa, Oryza sativa Japonica Group
MNGAGGNHQQQQQQQQRLRQQQQQQALLMQQALQQQQQYQSGVLAAAAAAAMTQMEPISNGNLPPGFDPSTCRSVYVGNVHPNVTESLLIEVFQSSGLVERCKLIRKEKSSFGFVDYYDRRSAALAIMTLHGRHICGQAIKVNWAYASTQREDTSGHFHIFVGDLSSEVNDATLYACFSAYPSCSDARVMWDNKTGRSRGYGFVSFRNQQEAETAITEMTGKWLGSRQIRCNWATKNNAEEKQETDNHNAVVLTNGSSSNPGMEASQDTGSKENPENNPDCTTVYVGNLGHEVNRDELHRHFYNLGVGAIEEVRVQQDKGFGFVRYSNHGEAALAIQMANGLVVRGKPIKCSWGNKPTPPGTSSKPLPPPLPSYQPVPMAGVPQGFSAADIVAYQRQLTLSQVAAGQIAGQHGLAGQVSAGLLAAGSQALYDGYPNQSSAQQLMYYN

SEQ ID NO: 71181 - protein, 271 aa, marine gamma proteobacterium HTCC2143
MKVDSFFDMLWKDYVQIAPQAQKIQDIFTGLGETVFNDHVAFRTFSDSPVDLDHLEPVILKMGYRRQNTYHFEEKKLIARSYSHSEADLPRIFLSELRRDLLSKKAQEILSSLVEQISADVIEGPEIFAEGLLWKPIPYTDYSRLLQESEYAAWLVSMGLRVNHFTVSVNHLKQLVELEQVIALLKENGYLINQAGGEIKGVPSDLLIQASTLADRINVTYGCGHVQNIPSCFYEFAKRFEDAQGRLFDGFIEGNADKIFESTNMDRESSD

SEQ ID NO: 71182 - protein, 651 aa, Yersinia pestis KIM
MLAGHPQPRGKVKTMSLISMSGAWLSFSDAPLLDNTELHIEANERVCLVGRNGAGKSTLLKILSKEVALDDGRIIYEQDLIVARLQQDPPRNVAGTVFDFVAEGVQEQAEHLKAYHATLHQVELDPSEKNLNRLAALQEILDHQGLWQLDSRIQEVLVQLGLSADAELSSLSGGWLRKAALGRALVSSPKVLLLDEPTNHLDIETINWLEGFLKEFQGSIVFISHDRSFIRAMATRIVDLDRGKLVSWPGNYELYLASKEEALRVEELQNAEFDRKLAQEEVWIRQGIKARRTRNEGRVRALKALRMERSQRREVMGTAKMQVEETVRSGKIVFDLENVNYQIDGKVLVKDFTAQVQRGDKIALVGPNGCGKTTLLKLMLGQLNADSGKVHCGTKLEVAYFDQHRAELDPERTVMDNLAEGKQEVMVNGRSRHVLGYLQDFLFHPKRAMTPVKALSGGERNRLLLAKLFLKPSNLLILDEPTNDLDVETLELLEEMVDSYQGTVLLVSHDRQFVDNSVTECWIFEGNGQINSFVGGYYDAHQQRAEAKPIRQAALKIEETKASTSVKSPAPAAKKPGKLSYNLQRELDQLPQQLEKLENDISKLQAEVSDTDFFSRPHEETQQVLKTLADTEQALEVAFSRWEELEAQKNG

SEQ ID NO: 71183 - protein, 456 aa, Polaromonas sp. JS666
MNAFTHAENAAHDIAAHLHPFTNLATHPQVGPLVIQRGDGIFVEDDQGRRYLEAMSGLWCASLGFSNARLAKAGCDALHALPYYHTFNHRSNPAAIELAQRLLDIAPVPMSKVFFANSGSEANDTAVKLVWYYHNAIGKPDKKKIIARKNAYHGVTVAAASLSGLAPNHRDFDLPIARILHVDCPHHYRYGLPGETEEAFATRLAEALEQRILAEGPDTVAAFFAEPVMGAGGVIVPPASYFEKIQAVLRKYEVLLVADEVICGFCRTGEMFGSTTFGMQPDILTSAKALSSGYMPISAVMVSGKVHAAVAANSGKIGTFGHGFTYSGHPVAAAVALETLKVYEDEQLLAHVQSLAPQFQRGLQRHASRPLVGEVRGVGLIGAIELVADPASRTPFDPAKKVGARLAELALEQGLIVRAMGDAVAFCPPLIITAAQVDEMFARFDRAMVRLEQEQP

SEQ ID NO: 71184 - protein, 329 aa, Mesorhizobium sp. BNC1
MGLLVEGAWQDKWYDTSKTGGRFERSKSQFRDWVTRDGRPAEGRTRSFKAEPGRYHLYVSYACPWAHRTLIFRKLKKLEDAISFSVVHHFMGENGWTFKNEDGATGDDLYGLDYLHQIYTKADPHYSGRVTVPVLWDRKTETIVSNESAEIIRMLNSAFDEWGDASLDFYPESLRSEIDTVNELVYANINNGVYRAGFATTQEAYEEAFRQLFETLDVMEGRLSRHRYLLRDRLTEADWRLFTTLVRFDPVYHGHFKCNLRRIADYPNLSNYLRELYQMPGVAETVNMLHIKAHYYGSHRTINPTGVVPLGPELDFAVPHDRERFAKAA

SEQ ID NO: 71185 - protein, 219 aa, Sulfolobus tokodaii str. 7
MDPKEVVARFIVDKLKEHKLIGLGTGKTVKKLIEVLSEEGLLKEKIFVASSIDTELEISKREGIVITLYSGLRPQVYIDSFDFVTSDKIMIKGGGAALLREKMLYTFSKEKVFIGEELKLKDLKEYSVPVEVVPVGVAYVISALKERGYEAKIREGNGKIGPIISDNGNIILDVIVKRENLCDFERLVKEIPAIIESGIFCKKDYEIYLANENGRISIL

SEQ ID NO: 71186 - protein, 376 aa, Chlamydomonas reinhardtii
MYNGDHQEEARVLGVSCGSSHSIALLDCGVVASWGRGEDGQLGHGQADQCTSPTCIAALTDAGVDAVVCGAEYTVAVASSRGQIYSWGWGDFGRLGHGECGDVFVPRPIAFFSGRPVARVACGDTHTLVVTQGDGALYTFGRNQNGQLGLGHTNDCLSPQLVTALQGERVSSVACGSEHSLAATEAGTVFSWGWGRYGNLGDGDSQDRYTPTRVVGLDGVTVTSVVCGWRHSAVVTDEGRVFTFGWSKYGQLGHGDHVDHTRPCLVAGLQHCRVSTVAGGWRHTMAADSEGNLYAWGWNKFGQLGLGDSEDRAAPTPVAGFGLAGGGVEAGAATPRRVALLACGWRHTVAVTEAGEVYSWGRGVNGQLGHGAEQDL

SEQ ID NO: 71187 - protein, 426 aa, Vibrio sp. Ex25
MKLYNIKENDEQVSFGQAVRQGLGRNQGLFFPSELPKFEDVDALLAEDFVSRSTKILSAFIGDELAEEQVNALVDAAFQFPAPINQVKDGVYALELFHGPTLAFKDFGGRFMAQSLAAVSDGGKITILTATSGDTGAAVAHAFYGMEDINVVILYPKGKISPLQEKLFCTLGKNIHTVAIDGDFDACQALVKQAFDDSALREEIGLNSANSINISRLMAQICYYFEAAAQMSKQERENLVVSVPSGNFGNLTAGLLAKALGLPIKRFIAATNANDTVPRYLETGKWEPKPTVATTSNAMDVSQPNNWPRIEELCRVKEWGLETLGKGAVSDEQSAQSVKDLYSLGYLCEPHGAIAYRVLEEQLQDGETGLFLCTAHPAKFKEVVDDILQSDIELPAPLAKHAAMELLSEELDADFDALKQVLRRVQ

SEQ ID NO: 71188 - protein, 148 aa, Capsicum annuum
MASKRILKELKDLQKDPPTSCSAGPVAEDMFHWQATLMGPSDSPYAGGVFLVTIHFPPDYPFKPPKVAFRTKVFHPNINSNGSICLDILKEQWSPALTISKVLLSICSLLTDPNPDDPLVPEIAHMYKTDKSKYEATARSWTQKYAMG

SEQ ID NO: 71189 - protein, 329 aa, Triticum aestivum
  misc_feature (268)..(268): Xaa can be any naturally occurring amino acid
MLRAVLLRSASGLRRSPMAAPLSTAAASWLAEGTSSPPRVRLLIGGDFVESKATEHVDVTNPATQEVVSRIPLTTADEFRAAVDAARTAFPGWRSTPVTARQRIMFKYQELIRANMDKLAENITTEQGKTLKDACRGLEVVEHACGMGSLQMGEYVSNVSHGIDTFSIREPLGVCAGICPFNFPAMIPLWMFPIAVTCGNTFVLKPSEKDPGAAMMLAELAMEAGLPKGVLNIVHGTHDVVNNICDDEAIKAVSFVGSNTAGMHIYSXRASASGKRVQCNMGAKNHAIILPDADRDATLNALIAAGFGAAGQRCMALSTAVFVGGSEPW

SEQ ID NO: 71190 - protein, 589 aa, Neisseria meningitidis FAM18
MTVQTKTKGLAWQEKPLSDNERLKTESNFLRGTILDDLKDPLTGGFKGDNFQLIRFHGMYEQDDRDIRAERAEAKLEPLKFMLLRCRLPGGIIKPSQWIELDKFARENSHYRSIRLTNRQTFQFHGVPKAKLQTMHRLLHKLGLDSIATAADMNRNVLCTSNPIESELHRQAYEYAKKISEHLLPRTRGYLDVWVDGKKVQSSDDFLQEDEPILGKTYLPRKFKTAVVIPPLNDVDCYGNDLDFVAVSDGNGQLAGFNVLAGGGLSMEHGNTKTYPNISLELGFVPPEHALKAAEAVVTTQRDFGNRSDRKNARTRYTIQNMGLDNFRAEVERRMGMPFEPIRPFKFTGRGDRIGWVKGIDGNWHLTLFIESGRLVDEGGKQLLTGVLEIAKIHKGDFRITANQNLIVANVAEADKAKIEELARTYGLIRNDVSKLRENAMSCVSFPTCPLAMAEAERVLPDFIGELDKIMAKHGTSDDYIVTRITGCPNGCGRAMLAEIGLVGKAVGRYNLHIGGDREGVRIPRLYKENITLPEILSELDDLIGKWAAGRDTDEGFGDFAIRTGIVKPVLDAPVDFWDASKAVPIARA

SEQ ID NO: 71191 - protein, 604 aa, Ralstonia metallidurans CH34
MNQHDFMIALVVFLVAAVVAVPLARRFGLGAVLGYLLAGAAIGPYALRLVTNVESILHFSEFGVVLMMFVIGLELEPRKLKNLRKTIFGYGTAQLAACALVVGGAAALLGASWQVAIVIGLGLALSSTAIAFATLAERNLMGTPAGAASFGILLFQDIAAIPMIALLPLLAIDAADIAPHGPPHWQTVARAVAVLGIVVVGGRYLVRPALRFIARTDMREMFTAFALLLVVGIALMMEAVGVSMALGTFVAGVLLADSEYKHALEADIEPFKGLLLGLFFMAVGMSIDFGVLAQAPWKVLGLVAGFVLVKTLVLAVLAPRFGIARGQWLLFGLLISQGGEFAFVVFSVADNVGLLTEHMHALLVLIVALSMVATPLLLLVFDQLIAPRLHILMRKPDDVIPPQHNPVIIAGFGRYGQIIGRLLYAQGIGVTVLDHDPDQIEFLRQYGFKIFYGDATRVDLLEAAGVAEAKILVVAIDGMEDSLALIDRVRERWPELTICARARHVSHVYQLKDRGVGIYEREMFEGSLMMGRRVLEGLGFDPAEARNVALRFRRHNIQGIDRFYPYYTDQKKLTSLTKQARDELEEMFRQDREQRRKREEAEWS

SEQ ID NO: 71192 - protein, 492 aa, Mycobacterium avium 104
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATDIVADWPTNDARFLFHPAMKELTLDIASLVFMGHEPGTDHDLVTKVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESTRLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 71193 - protein, 249 aa, Triticum aestivum
  misc_feature (162)..(162): Xaa can be any naturally occurring amino acid
  misc_feature (240)..(240): Xaa can be any naturally occurring amino acid
HRHLNSGLSVARLNKFVQKSRLVPLRNPWDIVDPRVRENNGGTCVAIAGADYCVVAADTRLSVGYNILTREHSKICELADKCVIASSGFQGDIKALQKNLAARELLYQHQHNKRMSCPAMAQLLSNTLYYKRFFPYYAFNVLGGLDSEGKGCVYSYDAVGSXARAGYSAQGSGSTLIMPVLDNQLKSPSPLLVPARDAVTPLSESEAVDLVKDVFASATERDIYTGDKVEIVVINKAGTXREYIELRKD

SEQ ID NO: 71194 - protein, 286 aa, Oryza sativa Japonica Group
MKAAASPLRAALLLFLSSSPSPRLALPMNPSSSSSSRGAASYHSKAAAFASPQPRGGGGGRGGRRGGGRGRGGDGSDRIDALGRLLTRILRHMASELNLEMRTDGYVRVRDLLKLNLQTFAKIPLKSHTVDEIKEAVRRDNKQRFGLLEEDGELLIRANQGHTVTTVTSESLLKPILSADEVSVCVHGTYRKNLDSILHQGLKRMARLHVHFSSGLPTDGGVISGMRQSVNILIYLDVSMALQDGMKLYISDNKVILTEGFDGVVPVKYFEKIETWPGRAPIPFEK

SEQ ID NO: 71195 - protein, 110 aa, Tragopogon miscellus
AMDESNATCGKRLASIGLENTEADRQAYRTLLVTPPGLGNYVSGAILFEETLYQSTVDGKKIVDILVEQGVVPGIKVDKGLVPLAGSNDESWCQGLDGLASRSAAYYQQG

SEQ ID NO: 71196 - protein, 191 aa, Fagus sylvatica
SQLIGKTPLVYLNKVTEGCGGYIAVKQEMMQPTASIKDRPAYAMIMDAEKKNLISPGKTTLIEPTSGNMGISMAFMAAMRGYKMVLTMPSYTSLERRVCMRAFGADLIVTDPTKGMGGTVKKAYDLLESTPNAFMLQQFSNPANTQVHFETTGPEIWEDTNGQVDIFVMGIGSGGTVSGVGQYLKSQNPNE

SEQ ID NO: 71197 - protein, 705 aa, Dechloromonas aromatica RCB
MAVHRLDNDVAHLVFDRQESVINKLDRATLEEIEIAVKLVAADTSLRGLLVSSAKDNFIVGADIKEFGELFGRDEAALDAHMRWANQIFCAFEDLPIPSVVAINGMALGGGLEFALGATLRVMAENAQIGLPEVTLGIFPGYGGTVRLGRLAGAQVAVDWVASGKPRRAAEALVAGVVDAVSPAEQLQEQALSLLGRAMAGEIDVAAIRRKKQGAIPGHHDAVFADALTRQAKALAVHLPAAAMAIASMARGAGKGRDLALDEERHALLKVVKTQAAGAMIQGFHNQQALKKLFGRHRANARRVRSAAVLGAGIMGGGIAFTSALKGVPVRLKDISRQQLDLGMAEAKKQIGRQIKSGRVSEAKGQQVLTSIQPQLDYAGFSDCDLVVEAIIENLKVKHAVLSELEQAVAPDTVIASNTSSLRIDEIAMPLQRPENFVGMHFFNPVPVMALVEVIKGSRTSDVAVSTAVDYAVTMGKTPIVVQDCPGFLVNRILTPYVRAFLDLVADGVDFVRIDRVMEVFGWPMGPAYLMDVVGIDTGCHVFDVISAGYPAVMPIQENNALAVMVANQRYGQKNGIGFYRYENDPTGKPKKTVAEDSYPLLKPIQLSPPREVSDEEIVERMMLSSILEAARALEDGVVATAGELDVAMLLGIGYPQYLGGPLKYADWLGLPKVVALGEKHGHLGPQYRVTDKIRSMAASGAQFY

SEQ ID NO: 71198 - protein, 188 aa, Vitis vinifera
MADFEDAQKPNGGFLEVDGGDDLTLYHVLHRLMAAIFFPDPTSSASLLRRVKISVADNVPLLRQASKNTARNVMHWTRRGSALRALLVISVGTITLLALTGLLVFMLFFLAATFNAIVISLLMSLAAAGGFLALFFACITAIYIGALSVAVVVISTATISAIIAVLITTGWIGFFWTVVGDKEKCRIC

SEQ ID NO: 71199 - protein, 449 aa, Staphylococcus epidermidis ATCC 12228
MLMKQYDVVFLGSGHAAWHAALTLKQSGKQVAIVEKDTIAGTCTNYGCNAKIFLEGPYEVLEEAKQYPNIIDSHNLEVNWKNLMHYKEQVINPMSETLTSMFEQQGIDVIMGKGKLVDAHTIEVNNTTLQSDYIVIATGQHSHQLDIEGKEYTHDSREFLSMQSLPDSITFIGAGIISIEFASIMIKSGVEVNVVHHTNQALEGFNESHVNKLIQKLKDEGVKFYFSENTKSVKPNAQRFIVETESGKMIETDYVLDATGRKPNVQQIGLEKVGILFSDRGIEVDDYLRTNVKNIYASGDVINKMIPKLTPTATFESNYIAAHILGLNTDAIQYPPIPSVLYSLPRLSQIGVTVSEAKKDDTYMIKDIPFGRQMVFEYQNETEAEMSIVLDSHKRLVGAEIYGNDAGDLVNLLVFIINQKLTAQDLNKNIFAFPGASSGVIDLLKLAMM

SEQ ID NO: 71200 - protein, 362 aa, Mycobacterium sp. MCS
MATPKVPPVRLARAVERLRHVLDRAHQRSAPPSAVMLEKILGAWISQGITVAADLRVADALADGPLPIGELARRVGANPDALARLMRALIGEGVFTQRRDGRYALNALGRTLCTDATMSVAGMARMIGHPAHREHWSQLLDAIRTGEATVPKLRGMPGFEYLSENRELGEIFNDAMTNLSETAVAPLTAAYDFRGFGTIVDVGGGHGRFLSAILAATPSARGVLYDLPQVVEGATELLGSHGVADRVEIVGGSFFDSIPAGADAYVAKNVIHDWPDADALTILRNIRSAAGTGATLLLAEFVIPDHHRAFIGNWTDMEMLMATAARERTEAEYRKLYQQAGFRLTRVVPTVAPISLIEGKAV

SEQ ID NO: 71201 - protein, 395 aa, Corynebacterium efficiens YS-314
MNPMTPSTPGNPLQLNREEIFAAHEGGKLSITSARPLADMHDLSLAYTPGVATVCEAIAADPAVARTHTGRGRTVAIISDGTAVLGLGDIGPEAALPVMEGKAQLFSSFAGLNAIPIVLDVHGVDELVDTIAAMAPSFGAINLEDISAPRCFEVERQLIERLDIPVMHDDQHGTAVVILAALRNALRLLDRQIGEARIVVSGAGAAGVAAVEMLRGAGARDVVVLDSRGIIHAGREDLNPVKQALAATTNPRGVTGGMAEALTGADVYIGVSGGHVAEEALQLMADQPILFSLANPSPEIDPELAGRYGAIVATGRSDLPNQINNVLAFPGIFHGALAARARSITPGMKLAASQAIADIAAETLDVGHVVPSPLDPRVAPAVSAAVQAAAEAEGA

SEQ ID NO: 71202 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 71203 - protein, 1027 aa, Saccharum hybrid cultivar
  misc_feature (168)..(168): Xaa can be any naturally occurring amino acid
  misc_feature (432)..(432): Xaa can be any naturally occurring amino acid
TRPASRCSTGGSHGRLLCWLLLACSWVAATTGQQTARTDPAEVAALNTILGRWGLKASAAWNISGEPCSGVAVDTTNVDDNPNINPAIKCDCTYNNATVCHITKLKVYALNVVGQIPAELQNLTYLNNLNLMQNYLTGPVPSFIGKFPMQYLSLAINPLSGTLPKELXNLTNLISWGISLNNFTGELLLELGNLTKLEQIYFAGSGFSGHFPTFSRLKNLKILWASDNDFTGKMPDFIGSLTQLEDLRFQGNSFEGPIPKSLSNLTKLTSLRIGDIVNGSSSLSFISNLTSLNVLILRNCRISDTLATVNFSNLAGLTLLDLSFNNLTGQIPQSILNLEKLGFLFLGNNSLSGSLPDVKSPSLNDLDFSYNQLSGSFPSWATQNNLELNLVANNFILGSSNNSILPSGLNCLQQDIPCFRGSPEYSSFAVDXGSTRSMEGLRYTFYEIDPTNIGAASYYVTGQTRWGVSNVGKFNEAPNGSYIIYSSQQFQNALDSELFQTARMSPSSLRYYGIGLENGNYTVELQFAEFAYPESPTWQSTGRRVFDIYIQGGLKEKNFNIRKTAGGKSYVAVYKKYNATVSKNFLEIHLFWAGKGTCCIPTQGYYGPMISALSVTPSFTPTVRNGVPKKKSKAGAIAGIVIGAAVLGLAALAGTFMLVQKRRRVAQQQEELYNMVGRPNIFSNAELKLATDNFSSKNILGEGGYGPVYKGKLPDGRIIAVKQLSQTSHQGKSQFVTEVATISAVQHRNLVKLYGCCIDSNTPLLVYEYHENGSLDRALFGNSGLSLDWPTRFEIILGIARGLTYLHEESSVRIVHRDIKASNVLLDTDLTPKISDFGLAKLFDEKKTHVSTKIAGTFGYLAPEYAMRGHLTEKADVFAFGVVALETVAGRSNTDSSLEENRVYLFEWAWELYERDKALDILDARIEEFDSEEALRVISVALLCTQGSPHQRPPMSRVVKMLTGDVEVTEVVTKPSYITEWQRRGGNTSYVTSDYSGDTTGEFSMQRETIAPLTPSPAMTGVIDDGR

SEQ ID NO: 71204 - protein, 338 aa, Glycine max
  misc_feature (238)..(238): Xaa can be any naturally occurring amino acid
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEKEYNSDIDIVSNASCTTNCLAPLAKVINDRFGIVEGLMTTVHAMTATQKTVDGPSSKDWRGGRAASFNIIPSSTGAAKAVGKVLPELNGKLTGMSFRVXPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 71205 - protein, 332 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKFFDCRKAQKFKGRVPGYAVKAVDTTGAGDSFVGAFLVSLGKDGSILDDEGKLKEALAFANACGAVCTTQKGAIPALPTPADAQKLMKSKSK

SEQ ID NO: 71206 - protein, 533 aa, marine gamma proteobacterium HTCC2143
MDFIWILFAFACGLSTKLISLPPSTGYLLAGFLLHFLGFEADALIDSLANLGITLMLFTIGLKLNVRDLIKNEVWLGSITHGLLWFVLAMLFIKAFVAFSLSYFAQIDTYTIALIVFALSFSSTVCVVKLMEDHGEMRTRHGKLAIGILVMQDIAAVLFLVIATGKIPSLWALLLLSAVVLKPLVNKLVDHIGHGELIPLAGFFLALGAYELFEFVNIKGDLGALLAGMYLASHKKSSEINKSLMGFKDLFLIGFFLSIGFAALPTWEMLAIAAVLTLLIPVKFLLFFYLFTQLRLRVRTAFLAALALSNFSEFGLIVATLSTQLGWLSSEWLVILSLAVSISFVITNFIYNYAHQFFSENREAIKKYETSEKLPEDNFLQPHGAPIVVIGMGRVGMGAYQALNSRVPGQAWGLDTDKEKVEWLNQEQIQAFCGDAEDINFWESIDLDKLQLVLLALPSVQDITSITQQLRYARYQGKIAAIARFDDERKSIEALGVDKVFNFYNEAGVGFAEESISLIDTSKMAIVDGRSID

SEQ ID NO: 71207 - protein, 610 aa, Xylella fastidiosa Temecula1
MGVSMNTVTFPSQGGIDRRRFLKGLALGGVVAGTGLWRLPVHAANPELPPLQRRTTPLELRIGQSSVNFTGRMRPAITVNNSLPGPVLRWRQGDTVQIHVTNTLPDVMTSIHWHGIVLPSNMDGVPGMSFDGIAPGEHYLYRFQLHQSGTYWYHSHAMFQEQAGLYGALIIDPLEPPPYRADREHILLFSDWTDLDPAALFRRLKKMSSYDNTYQRTVRDFFHDIHRDGLRTTLADRRMWGRMRMTPTDLSDVNAHTYTYLLNGTTPAGHWTGLFRPGEKVLLRLINGSAMTYFDVRIPGLKLTVVAVDGQYVHPVTVDELRIALAETYDVLIQPHGQDAFAIFAQDMGRTGYACGTLAVRPGLHAPLPALDPRPRLTMQDMGHGMTHDQHGSRVSEMADIPGMTHPGRLGDHASHANQPPAQPPHGLHSLPADRTAPQHPASEQNNPLVDMHVDAPQPRLNDPGIGLRDNGRHVLTYADLHSLFDDPDGREPGREIELHLTGNMEKFAWSFDGIPFASAQPLRLNYGERVRIVLVNDTMMAHPIHLHGLWSDLEDANAAFQVRKHTIDMPPGTRRSYRVRADALGRWAYHCHMLYHMESGMMREVQVRP

SEQ ID NO: 71208 - protein, 253 aa, Francisella tularensis subsp. holarctica
MQKLIMGNWKMNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICTE

SEQ ID NO: 71209 - protein, 150 aa, Listonella anguillarum
MNLICFYRISHWAYVNRIPLIPNVIKIISFLLFNSVVPASVKIGKNSRFMYGGIGCVIHKKSIIGNNVCLGQGITIGRKLKESCPEIGNDVYIGAGARILGDIKVGNNIIIGANAVVINSISDNSIVAGSPAKVVKMIEHSIWQELGDLL

SEQ ID NO: 71210 - protein, 371 aa, Triticum aestivum
  misc_feature (15)..(15): Xaa can be any naturally occurring amino acid
  misc_feature (20)..(20): Xaa can be any naturally occurring amino acid
RFFFLFLLPPIIFPXDLSEXQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGGENIFMMILQFLEIFVGSMSSGVGVGFISALLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALQSVHELPEGHGKTILTATTAIVVLTVLLIGGSTGTMLEALDVIGDEKYINR

SEQ ID NO: 71211 - protein, 320 aa, Anabaena variabilis ATCC 29413
MRVARNITELVGRTPLVQLNRIPQEEGCVAQILVKMESMNPSSSVKDRIGVSMINAAEQEGLIAPGKTVLVEPTSGNTGIALAMAAAAKGYRLILTMPETMSGERRAMLRAYGAELELTPGMEGMSGAIRRAQEIVNTTPHAYMLQQFRNPANVKIHRETTAEEIWEDTDGQVDMIVAGVGTGGTITGVAEVLKARKPSFQAIAVEPANSPVLSGGKPGPHKIQGIGAGFVPQVLKTQLIDEVITVTDEEAIAYGRRLAREEGLLSGISSGAALCAAIRVAQRPENAGRLIVLIQPSFGERYLSTPLFQDLETKVTASIS

SEQ ID NO: 71212 - protein, 175 aa, Francisella tularensis subsp. holarctica
MNLDFIKSKIAAVPDFPKPGIMFRDITPLLADPQGLRKTAEAMAQELKNKGIQPTIIAGTESRGFIFGVALAEVLGLGFVPVRKPGKLPRATYSVKYDLEYGSDSLEIHQDAFKVTDEVLVVDDLLATGGTAKATVDLIEKTQAKVAGLIFVMELDSLGGREVLAGYNVSALIKF

SEQ ID NO: 71213 - protein, 78 aa, Capsicum annuum
MKAWAKTFPENKHVKFLADGAGKYTHALGLELDLSEKGLGVRSRRYALLVDDLKVKVANVESGGEFTVSGADEILKAL

SEQ ID NO: 71214 - protein, 503 aa, Candidatus Kuenenia stuttgartiensis
MTSKKWDCLEMTLTTENLLLIGSILLLLSILASKTTGKLGVPALIIFLAVGMFAGSDGIGGIHFDNPNLAQSLGAIALTFILFSGGLETKWESVKPVLWQGVTLSTLGVLLTAVSLGFFISYISGFTLTEGLLIGAIVSSTDAAAVFSILRSKSIGLKGNLRPLLELESGSNDPMAYFLTIGITSLLVHKGTSFALLIPMFFQQMIIGAIAGYLLGKAMIWMLNKINLDHDGLYPVLTLALIFFTYGITTFFNGNGFLAVYLSAIILGNENFIHKKSIIRFYDGQAWMMQIVMFLALGLLVFPKQMLPFIGTGSVIALFLMFVARPLAVFLCLLFFKMRNRERLLISWVGLRGAVPIVFATYPLIQGVEKSEMIFNIVFFIVLSSVMLQGTTIPIVAKWLYLFKPVKFKTRYPLELELSDNFKNELFEVEIKENSNAIGRQIFQLKFPKTSLIVLINRSDKYITPSGTTTIVQGDKLLIMSDNKKDKDEIEQVILNYTETPSN

SEQ ID NO: 71215 - protein, 348 aa, Zea mays
MENGGAKGDVPNDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGETDATEWALNYIKEKAPELLSVMACSEVFDSSKGGAEKMCHEMGVPFLGKVPMDPQLCKAAEEGRSCFADQKCSASAPALRNIVKKLIKAE

SEQ ID NO: 71216 - protein, 489 aa, Francisella tularensis subsp. holarctica
MVELKVPMFPESVADGTLAQWNKNEGDFVNEGDILAEIETDKVVLEVPATSSGVLKGIKKHAGDTVLSEESLAIIDTAVSTSEPNQQTTNQGNASEATATGQEIDIKAPVFPESVADGTISEWHKKEGEAVSEGDILAEIETDKVVLEVPATSNGVLTKILKTAGETVLSAELIAKITAGGATATAKSEASVGVSQANNDPHLVPSARKAFNASGLDTAANIEGTGKKGRITSEDVKKAVASVNKPQQQTVVINQGARYEKRVKMTRLRQTIANRLVEVQHTNAILTTFNEVDMSAVMELRNKYKDMFVKEHDTKLGFMSFFIKAATEALKKFPDVNASIDGDEIVYHNYFDIGIAVGTDRGLVVPVLRDTDTKSLAELEADVLDKAIKGRDGKLSLEDMQGGTFTITNGGTYGSMLSTPIINSPQSAILGMHNIVERPVVVKGEIKIRPIMYLALSYDHRIIDGGTSVRFLKMIKELIEDPNRILLQV

SEQ ID NO: 71217 - protein, 380 aa, Oryza sativa Japonica Group
MARDVVEAAAAADGRHHHKAVVAADGGGGGGAGTAALVWDCGSALYDSYELTSFRRQLDAAVLSCGGRSLSMPHLLSSSSTQQQQMPAGPEEEEEAAAAGDAPEAVREGAAPAEVPRGVEGGEGWLGRWPQRHQAHGGSIEGDNGEARIRPHHRGVAIEDQQQGCRCSEKMDMSRDKAIMGALYVEISPAPPHQPSRLMDGVGTRQQASTSMAESTEAIPNLDQGFKALRWYGEPGEAHAASASASAPTGAGGRASCARVRTGPPGDGGGGYPNPPDAAIPDAATLREQWLFAVRQYSRWYSHAWGTAILAGAAFFGLGWLVKGSNPLPSRAEPHASNAKEEGLPVCNVNSLNLVVSFQKFHIGNANIEFGELSDKRDEL

SEQ ID NO: 71218 - protein, 277 aa, Staphylococcus aureus subsp. aureus MW2
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKVKNIGVSNFEPEHLEALLAQVSIKPVINQVEYHPYLTQHKLKLYLAAQHIVMESWSPLMNAQILNDETIKDIAQELGKSPAQVVLRWNVQHGVVTIPKSVTPNRISENFQIFDFELSDEQMTRIDGLNQDKRIGPDPKTFEG

SEQ ID NO: 71219 - protein, 221 aa, Picea sitchensis
MFLQRIAYLYDCMFYAGISVLVVLYAILHAACLLSAKSLTPKISDPESIWFLSAMCFQHGMSFLEFWWASHGSFQQWWNDERFWWISNASCFLLGTLEAFFISIGLLETGFSVTPKSSETDNASPYEITASPLFISLVMLVMMFSVATVTAAALVINGGTESFNYMCGELLCGMWSLVILYPILSQLLKVRKGIDKVPLSVMLPSVIGTIVFCVMVNTYIF

SEQ ID NO: 71220 - protein, 119 aa, Capsicum annuum
MFHWQATIMGPTDSPYAGGVFLVSIHFPPDYPFKPPKVAFRTKVFHPNINSNGSICLDILKEQWSPALTISKVLLSICSLLTDPNPDDPLVPEIAHMYKTDRAKYETTARSWTQKYAMG

SEQ ID NO: 71221 - protein, 125 aa, Triticum aestivum
  misc_feature (18)..(18): Xaa can be any naturally occurring amino acid
  misc_feature (29)..(29): Xaa can be any naturally occurring amino acid
  misc_feature (66)..(66): Xaa can be any naturally occurring amino acid
WIPRAAGEPVPINLFKPXILLHGCPPYIXDLRNTIPINHLTFDGVKICYRCQVPTVTHYNRMLGPXPTETMLTFRSGEVLHPNHENKHKDYFGQNLLCKETVSTQGKGRVEKGAHPVYHLQTYPS

SEQ ID NO: 71222 - protein, 480 aa, Streptomyces coelicolor A3(2)
MASAPAFDYAPAPESRAVVDIAPSYGVFIDGEFTEAADGKVFKTVSPATEEVLSEVAEAGEADVDRAVKAARKAFEKWSALPGAERAKYLFRIARIIQERSRELAVLETLDNGKPIRETRDADLPLVAAHFFYYAGWADKLDHAGYGADPRPLGVAGQVIPWNFPLLMLAWKIAPALATGNTVVLKPAETTPLSALFFADICRQAGLPKGVVNIITGDGRAGAALTAHPDVNKVAFTGSTAVGKQIARTVAGTRKKLTLELGGKGANIVFDDAPIDQAVEGIVNGIFFNQGQVCCAGSRLLVQESIHDELLDSLKRRLTTLRLGDPLDKNTDIGAINSAEQLARITALADQGEAEGAERWSPACELPSAGYWFAPTLFTNVTQAHTVARDEIFGPVLSVLTFRTPDEAVAKANNTPYGLSAGIWTEKGSRILAVANKLRAGVIWSNTFNKFDPTSPFGGYKESGFGREGGRHGLEAYLDV

SEQ ID NO: 71223 - protein, 261 aa, Idiomarina baltica OS145
MQLSLYQVDAFTDRTFGGNPAAVVPLLDHTLSDDMLQYIAEENNLSETAFLSSTRSPSVFDLRWFTPAAEVDLCGHATLAAAFVVFNHLRPDIEQVHFNTRSGSLIVTRTSSGMMMDFPATEPQAIAPNAVVSHGLGCDPVEVLRGFDHIAILENAAQVRALSPDFNELKKLDSRGVVATAVEGDGFVSRCFFPKLNVNEDPVTGSAHCQLAPLWSKRLNKTRVIGEQLSSRGGRVICEVEQDRVKLFGQAVEYLRGTITI

SEQ ID NO: 71224 - protein, 252 aa, Lactuca sativa
NIPYGGAKGGIGCNPAELSISELERLTRVFTQKIHDLIGIHTDVPAPDMGTNPQTMAWILDEYSKFHGYSPAVVTGKPIDLGGSLGRDAATGRGVLFATEALLNDHGMSVSGQRFVIQGFGNVGSWAAQLIHEAGGKVVAVSDISGAIHNKNGIDIPTLMKHVKEHKGVKGFGGANAIDSNSILVEDCDILIPAALGGVINRENANEIKAKFIIEAANHPTDPEADEILSKKGVVILPDIFANSGGVTVSYF

SEQ ID NO: 71225 - protein, 271 aa, Glycine max
MERAMAIQLFAYSFFIVIVLLFPPAMCAEFNYDLSSPNGPLNWGNNPQWQLCKNGKNQSPINLQKLSADVEFISGIQRNYQPANATLISSEHDIMVNWTENAGHITINGTQYQLAQGHWHSPSEHRINGIRYDLELHMVHISSAGRLAVTGVLYKFGRPDDEFISKIEDDLQLMAENQTRTRALGIVDPEDVAGITGQKYFRYNGSLTVPPCSEDVLWTVFIKEGRTASREQIKLLRAAVNGAGDETFENARPIQPRNGRPVKLYKDREGN

SEQ ID NO: 71226 - protein, 232 aa, Picea abies
MGARDEARPPGKRRQNPFPRANLSLLVGREGAPDRGGHARSPLKDEVMKIMPVQKQTRAGQRTRFKAFVVVGDGNGHVGLGVKCSKEVATAIRGAIILAKLSVIPVRRGYWGNKIGKPHTVPVKVTGKCGSVTVRMVPAPRGAGIVAARVPKKVLQFAGIEDVFTSSRGSTKTLGNFVKATFECLLKTYGFLTPDLWRETRFSKSPFQEYTDLLAKPAKALILEDVDKEALV

SEQ ID NO: 71227 - protein, 208 aa, Cicer arietinum
EVSARDLTEISSNTEKDVAEKKNEVTDANYDGFNGGGNYGNGGGYPSNGGGNYGHGGGNYGNGGGNYGHGGNGGGNYGNGGGNYGHGGGNYGHGSNGGGNYGNGGGNYGHGGGNYGHGGNGGGNYGNGGGSYGNGGGNYGHGGGNYGNGGGNYGHGGGNYGHGGGYPGNGGHGGGYPGNGGHGGGHGGHGGGYVGEATDVQREDKTLN

SEQ ID NO: 71228 - protein, 120 aa, Methanocaldococcus jannaschii
MKDMAVYVKFKVPEEIQKELLDAVAKAQKIKKGANEVTKAVERGIAKLVIIAEDVKPEEVVAHLPYLCEEKGIPYAYVASKQDLGKAAGLEVAASSVAIINEGDAEELKVLIEKVNVLKQ

SEQ ID NO: 71229 - protein, 296 aa, Zea mays
MAGGTLQDRSEEEDVRVGVDRFPERQPIGTAADDLGRDYSEPPAAPLFEASELSSWSFYRAGIAEFVATFLFLYVTVLTVMGVSKSPSKCGTVGIQGIAWAFGGMIFALVYCTAGVSGGHINPAVTFGLLLARKLSLTRAVYYVVMQCLGAVCGAGVVKAFGSALYESAGGGANAVSPGYTKGDGLGAEVVGTFVLVYTVFSATDAKRTARDSHVPALAPLPIGFAVFLVHLATIPITGTGINPARSLGAAIIYDNPHGWHGHWIFWVGPFAGAALAAVYHQVVLRAIPFKSSAHY

SEQ ID NO: 71230 - protein, 751 aa, Anaplasma phagocytophilum HZ
MSDFSEKDMEALEFHSRGRPGKVALLPTKPLLTQGDLSLAYSPGVAVPCIKIASDPDLVYEYTARGNYVAVISNGTAVLGLGNIGTLAAKPVMEGKAVLFKRFADIDAVDIEVNTEDVDEFINAVKYLGHSWGGINLEDIRAPECFVIERRLSELMDIPVFHDDQHGTAIIVLAGIINALDITGKVLKNVKIVVNGAGAAGIACVEMLKFVGIPNDNIILCDQNGVIYKGRQLGVNEWKLKHAVETDARDLKDAIKGADIFIGLSVRDVLSREMLLSMNKDPVIFALANPYPEVNPEFAREVRGDAIIATGRSDYSNQINNVMGFPYIFRGALDVRAKRVNNEMKLAVAQAIAMLAREVVSDEVLEAYGGRGMRYGRDYIIPTPFDPRLISVVSPAVARAAIETGVAQKGIDDWDKYARALGSRISPTSNVLNLIYGSVKQTPKRVIFSEGEEIKVIKAALQWRSQGYGVPILVGRADKIKEGLERIGVDSLDGIEIANAAVSTRNDVYIDYLYSKLQRKGYLHRRCVRDVKTDRNVFAACMLACGDGDILVTGVTRGYRESLSDVSKVIGARSEIMGLSVIVMEDRTLFIADTAINEFPTSKQMADIAVTAAAAAKKMGHEPRVAFVSCSNFGSHAQEGTERIRESIEILDRLGVGFEYDGEMSIDVALRKESLALYPFNRIKGGPANVLIMPSLYSASISSKLLQEVGGVAVVGPILMGMEKPVQIVQMTASVSEILNLAVLSTLYNAL

SEQ ID NO: 71231 - protein, 289 aa, Burkholderia mallei ATCC 23344
MPVISELFVYPIKSCAGIATVRAQLLVTGLEYDRNWMVTDPTGAMLTQRTHPRLALVRTAIGERELVVTAAGMPELRTPLAASALAGAERLAATVWRDTVSALDTGAHAARWFSEFLGAPARLARFAPDARRVVGAKWTGPFTSYAQFADGFPLLVVGQSSLDDLNVRLRRKGASAVPMNRFRPNVVLVGLDAYEEDYVDYLDVQTGGGGVRLSLVKLCTRCPVPTIDQRTGAPDPAWPNEPTDTMSLYRGSKQFGGALTFGKNAIVLNGDGAFLEVGQSVDAEIAFGE

SEQ ID NO: 71232 - protein, 192 aa, Vibrio sp. Ex25
MFVSKEGQQVPQVTFPVRQGDSWMNVTTDELFKGKTVIVFSLPGAFTPTCSSSHLPRYNELFPVFKEHGVDEIICVSVNDTFVMNAWKQDQEAENITFIPDGNGEFTDGMGMLVDKNDIGFGKRSWRYSMLVKDGVVEKMFIEPNEPGDPFKVSDADTMLNYIAPDYKTQESITVFTKARLPFLYESETKPD

SEQ ID NO: 71233 - protein, 505 aa, Zea mays
MASQAMVPLRQLFVDGEWRPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 71234 - protein, 263 aa, Vibrio sp. Ex25
MTQTNQAPLVIKLGGAALSCTQTLSQLFGAIAAYQKSAQRQIAIVHGGGYLVDELMAKLQLETVKKNGLRVTPYDQIPVIAGALAGTANKLLQGQAIADGLNAVGLSLADGGLCLVEELDPELGAVGKASPGDSTLLQEVLNTGALPIISSIGLTTDGQMMNVNADQAAVAVAGALDAELVLLSDVSGVLDGKGHLIKTLSEQEADALIKGQVITDGMIVKVKAALEAANDLGRPIEVATWRYPEKLVQLFAGESIGTQFLPQ

SEQ ID NO: 71235 - protein, 555 aa, Triticum aestivum
  misc_feature (324)..(324): Xaa can be any naturally occurring amino acid
  misc_feature (445)..(445): Xaa can be any naturally occurring amino acid
FSGNPVVKEKTGRWKACPFILGNECCERLAYYGISTNLVTYLTKKLHDGNSSAARNVTTWQGTCYLTPLIGAILADAYWGRYWTIATFSTIYFIGMSVLTLSASVPMLMPPSCEGAICPEASPLQYTVFFLGLYLIALGTGGIKPCVSSFGADQFDDTDPAERIQKGSFFNWFYFSINIGALISSSFLVWVQDNLGWGLGFGIPTVFMGLAIISFFAGTSLYRFQKPGGSPITRVCQVVAATLRKWNAHVPEDSSLLYELPDGVSAIEGSRQLEHTDELRCLDKAATITDLDVKEDSFNNPWRVCTVTQVEELKILVRMFPVWXATTIVFSAVYAQMSTMFVEQGMVLDPTIGSFKIPPASLSTFDVVSVIIWVPIYDSILVPIARRFTGKERGFSELQRMGIGLVISILAMSAAAVLEIKRLAIAREAHLVDQNVPVPLSILWXQIPQYFLVGASEVFTFIGALEFFYDQSPDAMRSLCSALQLITTALGNYLSAFILTMVAYFTTRGGRPGWIPDNLNEGRLDYFFWLLAGLSFLNFLVYVLCANRFKSKKAA

SEQ ID NO: 71236 - protein, 464 aa, Nostoc sp. PCC 7120
MSTPSTKESDMEALDLKWIRGQFPALTQKINGQPAIFFDGPGGTQVPGSVLDAISDYLVRSNANAHGAFATSARTDALIIAARTAIADFLGCHSDEVVFGANMTTLTFTLSRAIGRTLQPGDEIIVTRLDHSANVSSWEALAEQGAVIRYVDVKVDDCTLDINDLEQQINSRTKLVAVSYASNAVGTINDIATIVKLAHSVGALVFVDAVHYAPHGPINVHALGCDFLACSAYKFFAPHVGILYGKREHLANLQPYKVKPAPNEVPSRWETGTLNYEGLAGVVAAVNYLAKLGCHVSPTVDQELVSALIEADKEGLEHFHCPRFLTSAEQPSHEIASAYHSRRAAIVAAMSAIQQYERELSYKLISGLLEIPGLTLYGITDPERFAWRTPTVAIRLQGKSPESIARTLGDRGIFSWHGNFYALNLTEKLGVESNGGLLRLGLVHYNSVEEIIQLLQALKEIGLD

SEQ ID NO: 71237 - protein, 475 aa, Streptomyces coelicolor A3(2)
MIIGGGPGGYEAALVAAQLGAEVTVVDCDGLGGASVLTDCVPSKTLIATAEVMTTFDSSYEELGIIVADDTPPMEQAARVVGVDLGKVNRRVKRLALAQSHDITASVTRAGARVMRGRGRLEGMQGLDGSRKVVVRAADGSEETLTADAVLIATGGHPRELADARPDGERILNWTQVYDLEELPEELVVVGSGVTGAEFAGAYQALGSRVTLVSSRDRVLPGEDPDAAAVLEDVFRRRGMNVMSRSRAQSVKRVGDRVEVTLSDGRVIGGSHCLMAVGAIPNTEGMGLEEAGVRLKDSGHIKTDRVSRTSAPGVYAAGDVTGVFALASVAAMQGRIAMYHFLGDAVTPLNLKTVSANVFTDPEIATVGYSQADVDAGKIDARVVKLPLLRNPRAKMQGIRDGFVKIFCRPGTEIVVGGVVVAPRASELIHPISIAVDNNLTVEQIANAFTVYPSLSGSIAEVARQLHTRKAGGEQ

SEQ ID NO: 71238 - protein, 281 aa, Gluconobacter oxydans 621H
MKTVTLRNGVTVPALGMGTWNIGDSAARRSDEIESLRQGLEAGLRVVDTAEMYGNGRSEELVGEAIADVRDDVYLVSKVVPSNAPYDGVRKACRRSLKHLDTDWLDLYLLHWRGGTPLEETIRAFEDLKDDGLIRGWGVSNFDVDDMEEIESLSGNCLVNQVLYNLEHRGTEFDLLDHDLSTDTVTMAYSPLGQGGELLEHPALKDVASRHETSQGPADPAQIALAWVLRRPNVMAIPKAGSPKHVAGNLASLEISLTDADLKTLDSAFPPPKRKVSLAMI

SEQ ID NO: 71239 - protein, 474 aa, Escherichia coli K12
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 71240 - protein, 425 aa, Xylella fastidiosa 9a5c
MMSNSPQTPLATRQRLSEVRYEIRGELARRARELEAEGRKLIKLNIGNPGAFGFRAPEHLQRAIADDMGRTDPYTHQQGLPIAREAIAAAYVRRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQIDNLRNAMDLLGALRLCANVPGQYAIDAAVNGPDTITPLCSPGGPLYETRRAVIEACVVSEHLSLVVPAGALYAFPSVVGPAARHFDDYAFALELMNDEGVLVVPGSSFNVPYRDHFRVTLLPDAALIREVFSRIDRALSRRAEVAEKVVPLKSRSAAA

SEQ ID NO: 71241 - protein, 375 aa, Triticum aestivum
MHPTRWELSHMVDLQAAALVISVVAAEVGAAADASQPPPRRQSSRPEEAMDRYQRVEKPREEVPIKENEIRITTQGRMRNYITYATTLFQDKGCEEVGSRAMGRAINKTVMIAELIKRRIVGLHQNTATESTDITDTWEPLEEGLLPLETTRHVSMITLTLSKKELDTSSVGYQSPLPADKVKPFLEYENEEDAHSPPGRGRGRGRGRGRGMGRGRGARGNGYMEYADGGWENEHAPAYAGNGYADHGPAYEGNGYARGRGRGFRGRGRRGGYGGQPGGYGGQPDYQHDGGYYDEAPAPPRGGGRGFRGRGRRGGYGGGQPDYQQDGGYYEEAPFPAPAGGRGRGRGRGRGGPARGRGRGGNANGNMVYAAASGA

SEQ ID NO: 71242 - protein, 304 aa, Arabidopsis thaliana
  misc_feature (138)..(138): Xaa can be any naturally occurring amino acid
MEEPCETLDSGEAYQISRYHNYNQHSSRSSSPWLDLRVFYVRISNFVVEDSTPEVLTINHIPLDPDTLLEINGVRMGMYSEGGSSQLRRDRVDKKSEEATYVSTDNIRLTGSVKFEVYDKNELVLSGTLEMSGSNGFXTGESKNRWKMNCEAEVTAGSGFLKEKSINGQELSSPLPTIEVYVTGCFSGTPIILTKTLQLGLKKKQSRRMALDAIPEYETAEPQKDTSYALDLQATTEYGNYKEEYEGDMYWRSECIDGEMSWFNAGVRVGVGIGLGVCVGLGIGVGLLVRTYQSTTRTFRRRLL

SEQ ID NO: 71243 - protein, 240 aa, Idiomarina baltica OS145
MNARLLIVEDEVVTRQTLTRLFQQEGYEVFDAADGLQMENIMRQERIDVVIMDVNLPGKNGLELAESLRERDNIGLIFLTGRDSEDDRLLALELGADDYLIKPYNPKELTIRVRNLCRRIESSRSSSPVDNDSVQFNFHGWRLNSDSRCLYSPDNQMFRLPKSEYRALELFLTNPGRILDRETLVKRMLDRDLRPNDRTVDVAIRRIRRHFESHPDTPNLITTIHGEGYRFIGEVEQESQ

SEQ ID NO: 71244 - protein, 105 aa, Zea mays
TQPVSPPVLTGDLRGDMACVDDVRKLKVLVNADTNDDALTAPNTGAHGIALCLTEHMSYAIYYRINDIMQIIMATTLDLTHQALDRLLPHQMSDYKCIFRAMDGL

SEQ ID NO: 71245 - protein, 149 aa, Brassica napus
HYTLKITNGGRLNYFVNNVKIISRNICTLGSIKCHGIDGILPSPSAINDDSPRDNNHTSPFISCPSSHNNSEHDSPHDNSEHDSPHNNSSDHNSFRPGDHTHTHVAPSPTSSPTLVPKSDSSTIREGDTSGFVVLLGLLSCVMGIAMAM

SEQ ID NO: 71246 - protein, 501 aa, Erythrobacter sp. SD-21
MPNLGAIKRDWFSNIRADVLAGIVVALALIPEAIGFSIIAGVDPRVGLYASVAIAMVIAFTGGRPGMISAATAAVAVVVVPLVRDHGVEYLFAATILMGIFQGLAALLRLDLLMQFVSRSVITGFVNALAILIFMAQLPQLDPGNAGIGWMTYAMVIAGLAMIYIIPRFTTAIPSPLIAIIVLTALTIWLDAPVNTVSDMGELPEGLPYFMLPDVPLTWETLAIIAPYSATMAAVGLLESLLTAQIVDDMTHTGSNKRRESAGQGVANVVAAMFGGMGGCAMIGQSVINVTSGGRGRLSTFTAGLSLLILLAVLGDLVGQVPMPALVAIMIMVSIGTFSWNSIPNVTKHPWQSSVVMLATVVVVVATHNLALGVLAGVVLSGVFFTHKVMTMFEVVRERDGDTATYRAKGQIFYASVERFEAALGPESTQPDPADHVIIDVSKAHFWDISAIGALDKVVERMRRNGRSVQVVGLNRASSDLVDKFALTDKTGVEIGLAPHP

SEQ ID NO: 71247 - protein, 262 aa, Picea abies
RLAEPYKGIGDCFGRTIKDEGFIALWRGNTANVIRYFPTQALNFAFKDYFKRLFNFKKDRDGYWKWFAGNLASGGAAGASSLLFVYSLDYARTRLANDSKAAKKGGERQFNGLVDVYKKTLKSDGIAGLYRGFNISCVGIIVYRGLYFGMYDSLKPVVLTGDLQNNFLASFLLGWGITIGAGLASYPIDTVRRRMMMTSGEAVKYKSSLDAFNQIVKNEGTKSLFKGAGANILRAIAGAGVLAGYDQLQLILLGKKYGSGGG

SEQ ID NO: 71248 - protein, 272 aa, Glycine max
MADAAKGTYRASRWSLNGMTALVTGGTRGIGHAIVEDLCGFGATVHTCSRNQAELDKCLTEWRSKGFLVSGSVCDVSSQPHREKFIQEVTSIFNGKLNIYVNNVGVNYRKPTIEYTAEVYSQIMAVNLDSAYHLCQLAYPLLKASGMGSIVFISSIAGVVSLGTGSVYAACKAATNQLTKYLACEWAKDNIRSNCVVPATTNTPLVEHLLRNKKYVEEMLSRTPLGRIAEPEEVSALVAYLCLPAASYITGQVVLVDGGLSVNRFQTSMRIT

SEQ ID NO: 71249 - protein, 258 aa, marine gamma proteobacterium HTCC2143
MGRLDGKVAIITGGAGGIGKSAGQVFAAEGAAVLLVDMEETALQKVCETIASNQVSYFVADVTQSSDNRAMVACAEQRYGGVDIFIANAGIEGVICPLVDYDEAMFDKVIDVNVKGVFLGLQAAIPAMQSRGGGSIVITSSVAGVTAAPQLSPYAASKHAVIGIMRAAALEYAADNIRINTVNPSPVETRMMRTLESGIGGDDSPAGMAAAKEQMAATIPMQRYGNPDEIAKVMLFLASDDSSWVTGSVNMADGGMTA

SEQ ID NO: 71250 - protein, 549 aa, Staphylococcus epidermidis ATCC 12228
MKQRVGQYLMDAVYSAGADKVFGVPGDFNLAFLDDIIAHNDIKWIGNTNELNASYAADGYARINGIGAMVTTFGVGELSAVNGIAGSYAERVPVIAITGAPTRAVEQEGKYVHHSLGEGTFDDYRKMFEPITTAQAYITPDNATTEIPRVINTALQQRRPVHIHLPIDVALTEIEISNPFKPEVEPQKNVQSYINMVQDKLESASQPVIITGHEINSFHLHKELEQFVNQTQIPVVQLSLGKGAFNEENPYYMGIFDGSIAEQDIQDYVNQSDAILNIGAKLTDSATAGFSYQFDINEVIMLNHNEFKINDTCIEAFSLPNILNGLNKYIHYKNTNDFPQYERPQSHNYELSDQPLTQETYFNMMQDFLQQDDILIAEQGTSFFGAYDLALYKDNTFIGQPLWGSIGYTLPATLGTQIANPYRRNILLIGDGSLQLTVQSLSTMIRQNLNPVIFVINNDGYTVERMIHGMKEPYNDIRMWDYKSLPSVFGGDNVLVHDVNTSEELMLTFENIKSNSDRMHFVEVKMAVEDAPVKLSNIAKAFASQNKSS

SEQ ID NO: 71251 - protein, 540 aa, Zoysia japonica
MGPGVVAHLVRLGVLSSTSDHASVVSINLFVALLCACIVLGHLLEENRWVNESITALIIGLCTGVVILLTTKGKSSHILVFSEDLFFIYLLPPIIFNAGFQVKKKQFFRNFLTITLFGAVGTMISFITISAGAIAIFSRMNLGTLDVSDFLAIGAIFSATDSVCTLQVLHQDETPLLYSLVFGEGVVNDATSVVLFNALQNFDLNKIDAAVVLKFLGSFCYLFFSSTFLGVFSGLLSAYIIKKLYIGRHSTDREVALMMLMAYLSYMLAELSDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKESFEKITWRQQIIIWWAGLMRGAVSIALAYNKFTRSGHTQVHGNAIMITSTITVVLFSTMVFGMMTKPLIRFLLPPSSHTATSEPSSPKSLHSPLLTSLQGSDLEAGSHSHIVRPSGLRMLLSKPTHTVHYYWRKFDDALMRPMFGGRGFVPFSPGSPTEQSVHGGR

SEQ ID NO: 71252 - protein, 116 aa, Vibrio sp. Ex25
MAEVRARVDFKVGAKSNIDAEILSFRGLKTDKEHVAVIFRQADQTQETPLVRMHSECLTGDVFHSSRCDCGEQLEETIQRMGESGGIILYLRQEGRGIGLYNKIDAYRLQSQGMNT

SEQ ID NO: 71253 - protein, 252 aa, Picrophilus torridus DSM 9790
MQVIKIGGSLVSEILKNNDIINNFDLNGIIVHGGGNYINEFSKKFGMEQRFVTSPQGIRSRYTDKETLEFFIMVMAYINYKICHILENHGIKTVSISGINNRMAEASRKERLVIINERNRKMVIDGGYTGKINKINYDFLKNLVDSGYTPVVSPVAFSVESPLNVDADKMAANIAAALHAERLLIYTNVDGIYINGEKLSKTDIVSLKSMKIGNGMIQKVMAADIAVSSGVREVFIGNPGNIYQGTVVLNEL

SEQ ID NO: 71254 - protein, 717 aa, Acinetobacter sp. ADP1
MIHAGNAITVQMLSDGIAEFRFDLQGESVNKFNRATIEDFQAAIEAVKNHPEVKGLIVTSAKSTFIVGADITEFGQNFAQGEKAIVEWALPVHDIFNSFEDLDIPKVAAINGMALGGGFEMCLVCDYRVMSDQAQVGLPEIKLGIFPGFGGTVRLSRLIGIDNAVEWIAMAAPKKPAAALKDGAVDAVVSADKLQEAAIDLVKQALAGRVDWKAKRQEKLNPVKLNPLEQMMAFNTAKGAVLAKANPAQYPAPKLMLDSLQAGASLGRDEALKVETEGFAKAAITPQAEALIGLFLNDQIIKKTSKKHEKGAHPVNQAAVLGAGIMGGGIAYQAASKGTPIIMKDIGNPQLALGMQEANGLLTKQVERKKLTPAKMGETLARIRPTLSYDEFKEVDIVIEAVTENPKIKEAVLADTEAKVRDNTIIASNTSTISITRLAKALKRPENFVGMHFFNPVHMMPLVEVIRGEQTSEEAVATTVVLAQKMGKTPIVVNDCPGFLVNRVLFPYFGAFDLLLKDGADFQQIDKVMEKFGWPMGPAYLMDVVGIDTGVHGAEVMAEGFPDRMKPDYKGSIQTMYEAKRLGQKNDVGFYKYELDKKGKKAKTVDSTAYEVIAPVVTSEKREFDAQEIIDRMMLALCNETVRCLEDNIVATPAEADMAMIMGIGFPPFRGGPCRYIDQTGVAEYVALCNKYAHLGKAYEAPQLLRDMAENNKKFYG

SEQ ID NO: 71255 - protein, 476 aa, Anabaena variabilis ATCC 29413
MTLQSFGVIGLAVMGENIALNVERNGFPIAVYNRSREKTDAFMAQRAGGRNVKAAFTLEEFVAALERPRKILVMVQAGKPVDAVIQQLKPLLDEGDIIIDGGNSWFEDTQRRTQELEPAGLRFLGMGVSGGEEGALNGPSLMPGGTQSSYEYLSPIFNKIAAQVDDGPCVTYVGPGGSGHYVKMVHNGIEYGDMQLIAEAYDLLKTAGGLDAKQLHEVFAQWNTTDELNSFLIEITANIFPYVDPDTKLPLVDLIVDAAGQKGTGRWTVQTALELGVSIPTITAAVNARIISSIRDERIAASKQLTGPSGKYDGDTKEFINKVRDALYCSKICSYAQGMALLSTASTTFNWNLNLSELARIWKGGCIIRAGFLNKIKKAFNENPALPNLLLAPEFKQTILDRQAAWREVIITAAKLGIPVPAFSASLDYFDSYRRDRLPQNLTQAQRDYFGAHTYLRTDKAGAFHTEWVPIAEAKK

SEQ ID NO: 71256 - protein, 265 aa, Gluconobacter oxydans 621H
MTSASPITVPADDDRALLALAFRLASEASDIINAIRERGFRTDIKDDASPVTEADHASEHHILSGLRAACPSIPAIGEEEMSAGIRVNAEDAYWLVDPLDGTRGFASGGKDFTVNIGLVRHDRPVLGVVALPGYGLIYSGGQGLGAHRSDGTNSTPIHTATPPAEGLRVLASSHHGNPELLERWLAGRQVASVEKLSSSVKFMRVAEGAADFYPRFGPTMEWDTAAPQAILEAAGGALLDETGAPLRYGKPDRLNGSFYCTGGAS

SEQ ID NO: 71257 - protein, 215 aa, uncultured archaeon GZfos33E1
MSRESKRGSRKESWKTEEKWTPITRLGVLVQNGEIRSIEEALKSRYPLKEYQIVDALLPDLSEEVLDINLVQRMTDSGRRVKFRVCVIVGDKEGYLGIGLGKDALVRSGIEKAVRVAKTNITYIERGCGSWECDCKDKHSIPFKVIGKSGSVEITLKPAPKGIGLAAGDVPKRVSEFAGVNDIWAKTRGKTRTTFNLAMATYNALRSTALVKTMN

SEQ ID NO: 71258 - protein, 197 aa, Acinetobacter sp. ADP1
MSMTTGRILNIPNILTLARIALIPVFLIVAYWPPAIGVNFHEGSFLRHLVLTAIFILAAVTDWFDGYLARALNQTSAFGRFLDPVADKLMVASALIVLVQWQPTISMAFAAIVIISREITVSALREWMAELGARTNVAVSTVGKYKTAFQMIAISVFLLNWQPLDLLAYALLYTAVILTLWSMFIYLKAAWPYLKQP

SEQ ID NO: 71259 - protein, 339 aa, Anabaena variabilis ATCC 29413
MFGLIGHLTSLEHAQAVAQELGYPEYADQGLDFWCSAPPQIVDHIKVTSITGEIIEGRYVESCFLPEMLASRRIKAATRKVLNAMAHAQKHGIDITALGGFSSIIFENFKLEQFSQVRNVTLEFERFTTGNTHTAYIICRQVEQASQQLGIELSQATVAICGATGDIGSAVTRWLDAKTDVKELLLIARNQERLQELQSELGRGKIMSLDEALPQADIVVWVASMPKGVEINPQVLKQPCLLIDGGYPKNLGTKVQYPGVYVLNGGIVEHSLDIDWKIMKIVNMDVPARQLFACFAESMLLEFEKLYTNFSWGRNQITVDKMEQIGQASVKHGFRPLLV

SEQ ID NO: 71260 - protein, 1075 aa, Acacia mangium
MESEGEAGAKPKTALGAQVCQICGDSVGKTVDGEPFIACDVCAFPVCRPCYEYERKDGNQSCPQCKTRYKRHKGSPAILGDGEEDGVADDGTSDLNYDSENQNQKQKISERMLSWHMTYGRTEEIGAPNYDKEVSHNQIPLLTNGQEVSGELSAASPERLSMASPGGPGGKRVHSLPYSSDINQSPNIRAVDPGLGNVAWKERVDGWKMKQEKNVVPMSTGQAASERGAGDIDASTDVLVDDSLLNDEARQPLSRKVSIPSSRINPYRMVIILRLIILCFFLHYRITNPVRNAYPLWLVSVICEIWFALSWILDQFPKWLPVNRETYLDRLALRYDREGEPSQLAAVDIFVSTVDPLKEPPLVTANTALSILAVDYPVDKVSCYVSDDGAAMLTFEALSETAEFARKWVPFCKKYNIEPRAPEWYFTQKIDYLKDKVQTSFVKDRRAMKREYEEFKVRVNALVAKAQKIPEEGWVMQDGTPWPGNNTRDHPGMIQVFLGQSGGLDAEGNELPRLVYVSREKRPGFQHHKKAGAMNALVRVSAVLTNGPFLLNLDCDHYINNSKALREAMCFMMDPNLGKHVCYVQFPQRFDGIDRNDRYANRNTVFFDINLRGLDGIQGPVYVGTGCVFNRTALYGYEPPLKPKHKKPGLLSSLCGGSRKKSSKSSKKGSDKKKSSKHVDPTIPIYNLEDIEEGVEGAGFDDEKSLLMSQMSLEKRFGQSAVFVASALMENGGVPQSATPDTLLKEAIHVISCGYEDKSDWGSEIGWIYGSVTEDILTGFKMHARGWRSIYCMPKRPAFKGSAPINLSDRLNQVLRWALGSVEILFSRHCPIWYGYSGRLKWLERFAYVNTTIYPITAIPLVMYCTLPAVCLLTNRFIIPQISNIASIWFISLFISIFATGILEMRWSGVGIDEWWRNEQFWVIGGVSAHLFAVVQGLLKVLAGIDTNFTVTSKASDEDGDFAELYMFKWTTLLIPPTTLLIINMVGVVAGISYAINSGYQSWGPLFGKLFFAFWVIIHLYPFLRGLMGRQNRTPTIVVVWSILLASIFSLLWVRADPFITRVRGPDTEQCGINC

SEQ ID NO: 71261 - protein, 236 aa, Photobacterium sp. SKA34
MTSIKQNIAKVINQITLVTEKCGRAADSVQLLAVSKTKPVEAIEEAIAAGQYAFGENYVQEGVDKVNHFSGHPENNLLVWHFIGPIQSNKTRLVAEHFDWVHSIDRIKTAKRLNDQRPTSMAPLQVLLQVNSSAEATKSGITLAEVPALAAEIAAMPNIELRGLMSIPQPATDYDSQFATFKALADTLEQLKLTYPNVDTLSMGMSGDMEAAIAAGSTIVRIGTAIFGARDYGNKE

SEQ ID NO: 71262 - protein, 237 aa, Citrus jambhiri
MVLTMAAQSYTTAPLHSKITNKPLCPPPLSLKPRSLTAKHLRTTQSTSLPRISVSAAATSSIEVKESSASIQPSKSKSLPFRVGHGFDLHRLEPGYPLIIGGINVPHERGCEAHSDGDVLLHCVVDAILGALGLPDIGQIFPDSDPKWKGAPSSVFIKEAVRLMDEAGYEIGNLDATLILQRPKLSPYKETIRTSLSELLGADPAVVNLKAKTHEKVDSLGENRSIAAHTVILLMKK

SEQ ID NO: 71263 - protein, 318 aa, Synechococcus sp. RS9916
MGWSTADIPDQQGRIALITGASSGLGLETARALHQKGATVVMACRSPRKAEAARQELLEMQGEGALDLVALDLADLASVGRCSDAIHQRYGRLDLLINNAGVMAPPRLVSRQGYELQWATNHLGHMALTTALLPLMEGQADARVVTVTSGAQYFGRIAWGDPNGEQRYDRWQAYGQSKLANVMFALELDQKLRKQGSTVRSLAAHPGLARTNLQPASITANGSRIEAFAYRLMDPLFQSAAMGALPQLHAATAPSAQGGEHYGPDGFGGLRGWPKQQPVAPAARDAAQRQRLWALSEALLQEATAPDKPRRSTDRAAG

SEQ ID NO: 71264 - protein, 272 aa, Photobacterium sp. SKA34
MEQRSIAFIGAGNMARSIIAGLVASGYDAKKLTATAPSDARREPLARDFGIHTTSDNLNAAQNADVVVLAVKPQLMEEVCKPLQDINFAGKLVISIAAGINCDRLCEMLGQQVELVRVMPNTPSLIGKGMSGLYAKPQLTETDRLFATQLLQAVGEICWVQEESGINGIIAAAGSAPAYFFLFMEAMQQEAMNQGFDADTARLLVQQAALGAAELVKANPDTSLSTLRDQVTSKGGTTAEAINTFNQHQFSDIVAKAMQAAVSRAKEMEQLF

SEQ ID NO: 71265 - protein, 528 aa, Bacillus anthracis str. A2012
MNSFKWGKKIILFCLIVSLMGGIGVSCSFNKIKDSVKQKIDSMGDKGTYGVSASHPLAVEEGMKVLKNGGSAVDAAIVVSYVLGVVELHASGIGGGGGMLIISKDKETFIDYRETTPYFTGNQKPHIGVPGFVAGMEYIHDNYGSLPMGELLQPAINYAEKGFKVDDSLTMRLDLAKPRIYSDKLSIFYPNGEPIETGETLIQTDLARTLKKIQKEGAKGFYEGGVARAISKTAKISLEDIKGYKVEVRKPVKGNYMGYDVYTAPPPFSGVTLLQMLKLAEKKEVYKDVDHTATYMSKMEEISRIAYQDRKKNLGDPNYVNMDPNKMVSDKYISTMKNENGDALSEAEHESTTHFVIIDRDGTVVSSTNTLSNFFGTGKYTAGFFLNNQLQNFGSEGFNSYEPGKRSRTFMAPTVLKKDGETIGIGSPGGNRIPQILTPILDKYTHGKGSLQDIINEYRFTFEKNTAYTEIQLSSEVKNELSRKGLNVKKKVSPAFFGGVQALIKDERDNVITGAGDGRRNGTWKSNK

SEQ ID NO: 71266 - protein, 311 aa, Erythrobacter sp. SD-21
MKIMAANSNLPLARAIAGYLEMPLVDAGVRRFADEEIFVEIHENVRGEDVFVVQSTSYPANDNLMELLICIDALKRASARRITAVVPYFGYARQDRKPGPRTPISAKLVANLITEAGADRVLAVDLHAGQIQGFFDIPTDNLFGAPVMAADIQARYGDKDLMVVSPDVGGVVRARALAKRLDNAPLAIVDKRRDRPGESEVMNIIGDVSNRHCIMIDDIIDSGGTLCNAAQALLDQGAASVTAYITHGVLSGGAVARVNGSALKELVITDSIKPTDAAKDSDKVRILTIAPLIGEAVRRIADESSVSSLFD

SEQ ID NO: 71267 - protein, 467 aa, Staphylococcus epidermidis ATCC 12228
MNDTGDKKLSRTSLIGLVIGSMIGGGAFNIQSDMGGHAGGLAIIIGWLITAIGMISLALVFQNLTNERSDLDGGIYSYAQAGFGDFIGFASAWGYWFSAFLGNVAYATLLMSSIGNFFPIFKGGNTFPSIIVASILLWSVHFLILKGVETAALINSIVTITKLIPILLVIICMIVAFNFNTFKIGFFGMDGYGSLSFHFANTMSQVKSTMLVTVWVFIGIEGAVVFSGRAKNKKDVGTATVIGLISVLLIYFLLTVLAQGIVIQNHISKLEAPSMAQILAYIVGDWGATFVNIGLIISVLGAWLGWTLLAGELPFIVAKDGLFPKWFAKENKNGAPMNALFITNVLVQIFLISMLFTKSAYHFAFSLAASAILYPYMFSAFYQVKYTIEHKLTATPKQWIIGILASIYAIWLVYASGIDYLLLTMLLYIPGIIVYVVVQKNNQKRLTQFDYIFFSLIVILALIGLLR

SEQ ID NO: 71268 - protein, 335 aa, Staphylococcus epidermidis ATCC 12228
MKNIKKPFDLKGKSLLKEYDLTGEEFEGLIDFAMTLKKYKQQGTPHRYLEGKNIALLFEKTSTRTRAAFTVASIDLGAHPEFLGKNDIQLGKKESVEDTAKVLGRMFDGIEFRGFSQKTVEQLAEFSGVPVWNGLTDDWHPTQMLADYMTIKENFGYLKGINLTYVGNGRNNVAHSLMVAGAMLGVNVRICTPSSLTPRDVYFNIAKDQASNYGGSVKITDNIHTAVKDADVIYTDVWVSMGEESEFETRIHLLKDYQVNRKMLNLTGKVDTIFLHCLPAFHDTQTEYGQDIFKKYGLTEMEVTDEIFRSEHSRVFDQAENRMHTIKAVMAATLG

SEQ ID NO: 71269 - protein, 310 aa, Treponema paraluiscuniculi
LAVASDTARAGHSVTVFEALHKPGGVVTYGIPEFRLPEEVVVTEIETLKKMGVTFRMNFLVGRTATLEQLFSQYGFDAVFIGTGAGLPRFMNIEGEELCGVFAANDYLTRATLMKAYDTAHADTPVYAAKSVVVVGGGNVAVDSSRTALRLGAEQVHCLYRKTRADMTACVEEIAQAEDEEVTFHFLCQTTRILGDEEGNVRAVVFRDCQEQIDAGERVFLPCGDAECELAADAVIVAVGNGSNPLMAKTTRSLAVSERGTIVVDEDQRTSIPGVWAGGDIVLGAATVVRAMGQGRRAAASIKAYLAQKA

SEQ ID NO: 71270 - protein, 492 aa, Candida albicans SC5314
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDSDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKYEEVFSPSVKNYAYFTDGSYTPEEVVQAEKYMLTILNFDLNYPNPMNFLRRISKADDYDVQSRTLGKYLLEITIVDYKFIGMRPSLCCASAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 71271 - protein, 874 aa, Pneumocystis carinii
MIFKILITFFLYWIYLVRVRCETVPVDFENNDYYHFHFSEDVDIEEFSRAIGFKYHMKVDHLDNHHIFFIEKGVLEDEIKEKIENYFGLEKGRNAINGFNSDKLFYYEKQKLVKQENRGAIRDDIYFDNQDLYNDEVVNNVVKDPTGDDQAVNSTEEQAVNSTEDQAENPTEDLTQKLKEIKKQLNITDPCFDKQWYLFNTEKPGVDINVTGVWLQGITGKNVTVAIADNGIDYCNQDLAPNYNSEGSYNFHAGNSDPKPEKPDESHGTKCAGEVAAARNDLCGLGVAYESKISGLRFMTSPYALLLEGEALKYEPNLNHIYSCSWGPPDYGYVAMPMMPTTYSAIIKGIKEGRNGLGSIYVFGSGNGGLLDDCNYDGYANSPYTVTIAAIDAEDKKFDTSESCPCILASTYSGGENGSIYTTDLGKTNCTTQHSGTSASTAIAAGIIALVLSVNPNLTWRDVQALIVETAVPFRLKYYDWDELPSKRYYNNYFGYGKLDAYRMVERARTFETLNAQTMFSTRLIQVNMKFPEPSRRIKSSFYIHRGYPEHYNFKNLEYVGVSFYYRHRTRGYLQFKITSPSGVTSLLARVRIRDNESGYFSWIFTTVKHWGEPIVGTWTIDVTDKNNWNEQGYIFNWQLHFFGESINSSKALPPPYPFVHKQPTTMPPPEPTTTLPSDLDANPQPQPDPGSPPSSDPESPPSSDPESPPSSDPGSPPSSDPESPPSSEPGYQPPSEPPPQPPLDPRPPSKPDPNPPSDPSSQQDPDTSLSSNPTSTSSSEPPPPPPPPAPAPPAPAPPPPPAPAPPPPPPPPPPRPEPEPEPEPEPEPEPEPEPEPEPEPEPEPEPRQSHLHLHLHFHLHLHHLDHRNKNQHQ

SEQ ID NO: 71272 - protein, 286 aa, Fraxinus excelsior
MESKEEDVRVGANKFNERQPIGTAAQSQDKDYKEPPPAPLFDPGELSSWSFYRAGIAEFIATFLFLYIAILTVMGVSKSDSKCSTVGIQGIAWAFGGMIFALVYCTAGISGGHINPAVTFGLFLARKLSLTRAIFYMVMQCLGAICGAGVVKGFGKTLYMTKGGGANVVAPGYTKGDGLGAEIVGTFVLVYTVFSATDAKRSARDSHVPILAPLPIGFAVFLVHLATIPITGTGINPARSLGAAIIYNKDHAWDDHWIFWVGPFIGAALAALYHVVVIRAIPFKNK

SEQ ID NO: 71273 - protein, 487 aa, Burkholderia mallei ATCC 23344
MGIKHWIGGREVDSPETFTTFNPATGQPIAEVASGGAQEIDAAVRAAKDAFPKWAGTPAKERAKLMRRLGELIERNVPALADLETRDTGLPISQTRKQLIPRASENFHFFAEVCTRMNGRSYPVDDQMLNYTLYQPVGVCALVSPWNVPFMTATWKTAPCLALGNTAVLKMSELSPLTADQLGRLALEAGIPAGVLNVVQGYGATAGDALVRHPDVRAVSFTGGTVTGKRIMERAGLKKYSMELGGKSPVLIFDDADFDRALDASLFTIFSINGERCTAGSRIFVQRTIYDRFVAEFARRANNLIVGDPADESTQVGSMITRAHWEKVTGYVRLGVEEGARLVAGGPDKPANLPAHLANGNFVRPSVFADVDNRMRIAQEEIFGPVACLIPFDGEEDGLRLANDTAYGLASYLWTRDVGRAHRLARGIEAGMVFVNSQNVRDLRQPFGGVKESGTGREGGEYSFEVFAEIKNVCLSMGSHHIPRWGV

SEQ ID NO: 71274 - protein, 171 aa, Edwardsiella ictaluri
MSLSVRPYLSFMPTLGERLFIDATATVIGQVTLGDDVSIWPQVVIRGDVNSIVIGERSNIQDGSVIHVGNRSTSTQGHPTIVGSDVTVGHKVMLHGCCIGNRVLIGMGAIVLDGVQIEDEVILGAGSLVPPGKGLESGFLYLGSPARQIRPLTTQERAGLRQSADNYVNWK

SEQ ID NO: 71275 - protein, 185 aa, Oryza sativa Japonica Group
MKERGVRNKQGVIMKALLDRCLSKHRNGGRPEPPEGSFAVYVGGGGGGGGAARERFVVRTECVNHPLFRALLEEAEEEYGYVADGPLELPCDAGEFVAVLARIEREMAEERTVGCAGGPGVQAAPGGAPHAGCSGDAAADDRWLSVGAARPVAGGDRRADGLAVGMFLSKFFSVHRMCCRRRMHT

SEQ ID NO: 71276 - protein, 188 aa, Candida albicans SC5314
MSDRVLEINALAKELKANLKQFPNFPKEGILFEDFLPIFTKPDLFNKLVKAFKLHVGEQKIDYVIGLESRGFLFGPTLALALNAGFVPVRKPGKLPGPTFKVEFQKEYGSDEFEIQQDVIPKGAKVLIVDDILATGGSAFGAGELAKKTGAEIVEYLFVMELDFLKGRDKLDAPVYTLFGGQEEKFTE

SEQ ID NO: 71277 - protein, 341 aa, Burkholderia mallei ATCC 23344
MAQYMKAAVVHAFGEPLRIEEVPVPTPGAGQILVNVKASGVCHTDLHAADGDWPVKPTLPFIPGHEGVGFVAAVGEGVRHVKEGDRVGVPWLYTACGHCEYCQTGWETLCHEQQNTGYSVNGSYAEYVLADPNYVGHLPSNVAFDEIAPILCAGVTVYKGIRVTDTRPGQWIAISGIGGLGHVAVQYAKAMGLHVVAVDVAPQKLELARKLGATFVVDASKDDPAAVIQKEIGGVHGVLVTAVSRGAFAQALGMVRRGGTVSLNGLPPGDFPLPIFSTVLNGITVRGSIVGTRRDLQESLDFAAEGLVRAHIHRDKLEHINGVFSALREGKVDGRIVLTGQ

SEQ ID NO: 71278 - protein, 180 aa, Enterococcus faecalis
MFISTYNIIYADPPWRYDCKNVQGAAENHYSTMSIDELCALPVERLASKDCLLFLWATFPMLPEALRLIKAWGFSFKTVAFVWLKQNRKSLTWFYGLGRWTRGNAEICLLATHGKPKRRSASVHQFIISPIEQHSKKPDVTREKIVELAGDLPRVELFARQKTPGWDVWGNEVECDLILT

SEQ ID NO: 71279 - protein, 443 aa, Picrophilus torridus DSM 9790
MKRGHGSGVISVPVATAVGLGAIIGAGIFVLSGTAIALAGANALFSFILVGILAVIIAVQFGELGSIMPNAKGASFSYTYNAFGSELGFIIGILLYFSFATAISAIALGFGSYLSSVLLLHGNNYPIMFAILLIFILSIVNIIGIKKAARLDSFLVLIKLLILTVFIISAVLLAHFSGTLNLNNFHGSARQSGVLPVLSASIAVFFAYSGFQSISTITSNVRGGASGAARAIVLSVVISMIFYILVIFALMLMVPASKFVISADPLSFALKYVRAPYSIFILVDAGALMATASATLAMILTSSRVIYQISENKLLPGFFRKYDRKRDVPVNGVILSALIGVAMLFSGNIYIIAAISNFGLLISYLVSSLALIHFRRNNKTGSFKTPFYPYITVISIVMLLVFILGMPREVLDIGMILIIILLMLYYFLVEFKRDRVIHEELFK

SEQ ID NO: 71280 - protein, 251 aa, Mesorhizobium sp. BNC1
MTGEFKDKVALVTGAGSGIGAAIARELATGGAELVVADLERESANRIVEGIRASGGRAHAFAVDVADAEAVERMVDFAVRTCGDLHLAVNNAGIGGPSEPTADYPLDGWRKVIDVNLNGVFYGMKYEIAAILKSGGGAIVNMASILGSVGFANACAYVSAKHALLGLTKTAAMEYAAQGVRINAVGPAFIDTPLLSKNLDDQVLGQLAGLHPIGRLGTPEEVSALTCFLLSGRASFITGSYHLVDGGYTTR

SEQ ID NO: 71281 - protein, 362 aa, Candidatus Kuenenia stuttgartiensis
MGLNCGIVGLPNVGKSTIFNALTSAKAASANYPFCTIDPNVGVVSVPDIRMDKIAEIISTEKIVPTIVEFVDIAGLVKGASKGEGLGNQFLGHIKNVNALLHVVRCFEKSDTIHVEGSVHPERDIDIINTELILADIETVDKRLNRSEKLAKTGDKKNLATIDVLKKVKNALNNGVPVRLLCLTDEEKADIADLHLITSKPVLYVANIFDIEQDKKYIDAIAGFSKKENSGFVVISGDIESEIAQMEPSERKTYYEEMGLQESGLEKLIRETYQLLGFITYFTAGPKEIRAWTILQGTKAPQAAGVIHSDFERGFIRAEIYNYNDLITLGSEQKIKEKGLLRLEGKDYVMKDGDIVHFRFNV

SEQ ID NO: 71282 - protein, 165 aa, Nostoc sp. PCC 7120
MTMSIRIGNGYDIHRLVSDRALILGGVHIPHELGLLGHSDADVLTHAIMDAMLGALSLGDIGHYFPPTDPQWAGADSLVLLSQVNELIRTQGWRIGNIDSVVVAERPKLKPHIKTMRDKLADILQLEPNQIGVKATTNEKLGPVGREEGICAYAVVLLVSSDEIS

SEQ ID NO: 71283 - protein, 105 aa, Brassica napus
QQAIHSGWRPIEDILKLLPGPHLETKRSGFPSSPSVDSLHGASNGVADGRRSVVLVVFIGGVTFAEISALRFLASKEGVAYDLIIATTKIINGATLIETFMDKQG

SEQ ID NO: 71284 - protein, 744 aa, Vitis vinifera
  misc_feature (497)..(497): Xaa can be any naturally occurring amino acid
MPELAFPVSRRQHSRDLEISRSRSEGRDLAISQSRIAGFGEFCKEKAVESDNMKEQQPPTARKERSDSSNSPQDAASIPHPRDAVAGGDRTVYSPSVYAPQAQAFYYGGNVIVLFQLAILRHRATHAIMRSTGYDNAAGEWDEYPPYINAEGLEIGSPGIYNENPSLVFHAGYGYSPQMPYGPYSPVTTPLPSVGGDAQLYSPQQFPFSGPPYYQQLVPPSMPYITSPTPVSQPELTSLVTVDQQGEGMLFGPRPGYPPPLGSFGRGNFPGNPGTLGFHDLQQGFDGFRSGGLWSDWPKSSDRQRSLTPLSPAVSPQPIGTLGSFGQNIGMGPLTCSKLLVFAFLCATNQAKGLSFEGAFERTISYTSTGSQASQQQRSFYGFGSSSNSYNRGYLQAGFNQGSSFGSAPITSLGMNGRAWLSLDSSRRRGRGSGSLCSCNGTLDILSEQNRGPRASKPKSQITAEHGSSIDNNKHSTSTAKTNDGLYNQLSFVTEYXDAKFFIIKSYSEDNVHKSIKYGVWASTPNGNRKLDAAYREAKEKQAACPVFLLFSVNASAQFCGVAEMVGPVDFDKSVDYWQQDKWSGQFPVKWHIIKDVPNSQFRHIVLENNDNKPVTNSRDTQEVKLEQGIEILNIFKNYETDTSILDDFDFYEDRQKAMQERKARQQASLMVVGGNEHRNTVTLSTDFIKQMSKSYAQVVRLDDCGKDGTMPDRAGPASDPSMGARVKLDDAMTTAAVSSAQSS

SEQ ID NO: 71285 - protein, 476 aa, Vibrio sp. Ex25
MLSKYNKEGIMAHVNHYDVIVIGSGPGGEGAAMGLTKAGLNVAIVEKESSVGGGCTHWGTIPSKALRHAVSRIIEFNSNPLFCRNNTSVHATFSDILDHAKSVIDKQTRLRQGFYDRNSCTLLFGTARFIDNYSIAVMQSDGTEEIYSADKFVIATGSRPYQPNDVDFLHERIYDSDSILSLKHDPRHIIIYGAGVIGCEYASIFRGLGVKTDLINTRDRLLEFLDNEVSDALSYHFWNSGVVIRNDETYEKIEGTEDGVIIHLQSGKKMKADCLLYANGRTGNTDKLNLGAVGLEADSRGQLKVNRNYQTDIEHIYAVGDVIGYPSLASAAYDQGRFVAQAITKGQAENYLIDDIPTGIYTIPEISSVGKTEQELTAAKVPYEVGRSSFKHLARAQIAGKDIGSLKILFHRETKEILGIHCFGERAAEIIHIGQAIMEQKGSANTIEYFVNTTFNYPTMAEAYRVAALNGLNRLF

SEQ ID NO: 71286 - protein, 297 aa, Escherichia coli K12
MKPQVYHVDAFTSQPFRGNSAGVVFPADNLSEAQMQLIARELGHSETAFLLHSDDSDVRIRYFTPTVEVPICGHATVAAHYVRAKVLGLGNCTIWQTSLAGKHRVTIEKHNDDYRISLEQGTPGFEPPLEGETRAAIINALHLTEDDILPGLPIQVATTGHSKVMIPLKPEVDIDALSPDLNALTAISKKIGCNGFFPFQIRPGKNETDGRMFSPAIGIVEDPVTGNANGPMGAWLVHHNVLPHDGNVLRVKGHQGRALGRDGMIEVTVTIRDNQPEKVTISGTAVILFHAEWAIEL

SEQ ID NO: 71287 - protein, 468 aa, Mycobacterium avium 104
MSTTIPVFNPSTEEQIAEVPDSDQAAVDAAVARARETFESGVWRKAPASHRANVLFRAARIIEERKDELAALESQDNGMNLTAAGHIIPVSVDMLKYYAGWVGKIHGESANLVSDGLLGTWETYHTFTQLEPVGVVGLIIPWNGPFFVAMLKVAPALAAGCSAVLKPAEETPLTALKLEEIFREAGLPDGVLNVITGYGETTGAALTAHPDVDKISFTGSTEVGRLIVKAAAGNLKRLTLELGGKSPLIMFDDANLDKAIMGAGMGLLAGSGQNCSCTSRIYVQRGIYDQVVEGLAEFAMMLPMGGSDDPNSVLGPLISEKQRQRVEGIVNDGVAAGAKVITGGKPMDRKGYFYEATIITNTTPDMRLIREEIFGPVGCVIPFDDEDEVIAAANDTHYGLAGAIWTENLSRAHRVVNELRAGQIWVNSALAADPSMPISGHKQSGWGGERGRKGIEAYFNTKAVYIGL

SEQ ID NO: 71288 - protein, 343 aa, Gluconobacter oxydans 621H
MADTMLAAVVREFGKPLSIERLPIPDIKPHQILVKVDTCGVCHTDLHAARGDWPSKPNPPFIPGHEGVGHIVAVGSQVGDFVKTGDVVGVPWLYSACGHCEHCLGGWETLCEKQDDTGYTVNGCFAEYVVADPNYVAHLPSTIDPLQASPVLCAGLTVYKGLKMTEARPGQWVAVSGVGGLGQMAVQYAVAMGMNVVAVDIDDEKLATAKKLGASLTVNAKDTDPARFIQQQIGGAHGALVTAVGRTAFSQAMGYARRGGTIVLNGLPPGDFPVSIFDMVMNGTTIRGSIVGTRLDMIEAMDFFARGKVKSVVTPGKLENINTIFDDLQNGRLEGRTVLDFRS

SEQ ID NO: 71289 - protein, 507 aa, Zea mays
MAIDLNLQETMSLITEKHQGRLIAGAVLLVTTIVSFIKLLLMWSDSRVRSRSRLPPTIPAVPIIGGLIRFMRGPISMIREEYARLGSVFTLNALGYRITFLIGPEVSEHLFNGAESEMSQREVYRFTVAAFGRGVAFDVPYSLRLEQIRIFAEGLRGNKLRGYATLMVCEAEEYFSKWGESGTVDLKHELEQVILRITSRCLLGREVRENLFDDVATLFHDLCNGMQPVSVIFPYLPIPAHWRRDRARQRLREMFGTIIRARKASGRSEEDMLQRLIDYRYKDGRATTEDEIAGLLITVLFGGQQTSSITSTWTGAYLLQFRRYLAAAVEEQEEAIWRHGDRIDHDVFAEMDVLYRCIKEALRLQPPVAIMFRWSHSDFAVTTREGEELVVPKGQMVAASPAVANRLPHVYKDPDLYDPERFAPGRSEDKAAGALSYISFGGGKHWCLGEFFAYLEIKTVWAHLLRNFEMELVSPFPENEWNSMLVGVKGKLMVKYTRRKLVVVDGK

SEQ ID NO: 71290 - protein, 306 aa, Photobacterium sp. SKA34
MKPTATLLNEVLDEVRPLIGQGKVADYIPALANVPASKLGIAVCYNDGEVIQAGDSQEGFSIQSISKVLSLTLAMTLYEPEELWSRVGKEPSGHAFNSMIQLELEKGIPRNPFINPGAIVVSDLLHSRLCAPQYRMLELVRELSCNPHIVYDKVVASSEMQHSDRNASIAYLMRSFGNFDNEVMPVLTNYFSYCALKMSCVDLARTFSYLANKGLPLGAKKRIISQTKSKHINALLATCGLYDGAGEFAYRVGMPGKSGVGGGIVAIVPGEMTIAVWSPELDQSGNSVAGTAALEKLSERIGRSIF

SEQ ID NO: 71291 - protein, 353 aa, Glycine max
MEGESKEDVWCRETVPKVLKLVCSTLPLSLSHTNLVSLLLVSPSLHRTLLCSQPLWQSLNFRELNNAGNRLIAALSLPRYCNVKQINLEFARDVEDAHLILIMDKCFNSLQSLESLNLNGCQKISDTGIEAITSCCPQLKSFSIYWNVRVTDRGLQHIVKNCKHIIDLNISGCKNISDQGAQLVADNYPELESLNLTRCIKLTDDGLKSLLHKCLFLQSLNLYALSSFTDEAYRKICLLARLKFLDLCGAQNLSDEALSCISKCKNLESLNLTWCVRVTDEGVISIAKGCTSLEFLSLFGIVGVTDKCLEELSKSCSNKITTLDVNGCIGIKKRSREELLQLFPYLKCFKVHS

SEQ ID NO: 71292 - protein, 487 aa, Escherichia coli O157:H7 EDL933
MKPSTEWWRYLAPLAVIAIIALIPVPAGLESHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 71293 - protein, 520 aa, Glycine max
MPSFMAFLSHPYFFAALSASLTLLVVQLLFRKLNKRHSRKKYHPVAGTIFNQMLNFNRLHHYMTDLAAKHRTYRLLNPFRYEVYTTEPTNVEYILKTNFENYGKGLYNYHNLKDLLGDGIFTVDGEKWREQRKISSHEFSTKMLRDFSISIFRKNVVKLVNIVSEAATSNSTLEIQDLLMKSTLDSIFQVAFGTELDSMCGSSQEGKIFADAFDTSSALTLYRYVDVFWKIKKFLNIGSEAKLRKTTEILNEFVFKLINTRILQMQISKGDSGSKRGDILSRFLQVKEYDPTYLRDIILNFVIAGKDTTAATLSWFMYMLCKYPEVQEKAAEEVKEATNTKRISSYNEFVYSVTDEALERMNYLHAAITETLRLYPAVPVDAKICFSDDTLPDGYSVNKGDMVSYQPYAMGRMKFIWGDDAEDFRPERWLDENGIFKPESPFKFTAFQVNNNMKCTTCTGPRICLRVRFAYRQMKIFAAVLLGCFRFKLKDEKKNVTYKTMINLHIDEGLEIKAFNRYRD

SEQ ID NO: 71294 - protein, 120 aa, Vitis vinifera
MGKAKKAQKFAVMKKMVTSKALKKHKEEVLNPTKKDENKEKTSRNVPYVPSALFFKYNTALGPPYRVLVDTNFINFSIQNKLDLEKGMMDCLYAKCTPCITDCVMAELEKLGQKYRVALR

SEQ ID NO: 71295 - protein, 215 aa, Triticum aestivum
HEARSSRATRLVARAGGVDDLPLVGNKAPDFEAEAVFDQEFINVKLSDYIGKKYVILFFYPLDFTFVCPTEITAFSDRYEEFEKLNTEVLGVSIDSVFSHLAWVQTDRKSGGLGDLKYPLISDVTKSISKAFGVLIPSQGIALRGLFIIDKEGVIQHSTINNLAIGRSVDETMRTLQALQYVQENPDEVCPAGWKPGEKSMKPDPKGSKEYFAAI

SEQ ID NO: 71296 - protein, 325 aa, Solibacter usitatus Ellin6076
MNNNSETHAVAPMFAPNQILKTSASDLLKDLDLTDDELLYLLDLAAEVKASPRDYARALDGKNLGLLFEKPSLRTKLTFELAMKQMGGGSVFVEGPIGVREPLKDIARNLDRWVDGIVARVFLQSTVDGLAEWSRVPVINALSDLYHPCQALADMQTIREHFRVARLHGLKLAFIGDGNNVAQSLMLTSLRLGMDFALGCPEGYLPDPEIVTQAEGLAAVTGASLLITHDTGAAVEGAHTVYTDVWASMGQEQETIERRRAFREYQVNDVLFAQARPDAVFMHCLPAKRDEEVTDSIMEHPRSVIFHQAENRLHAQKALLLMILT

SEQ ID NO: 71297 - protein, 541 aa, Trifolium repens
MAIEIASVVSKLQMLSTSDHSSVVSMNLFVALLCACIVLGHLLEENRWMNESITALLIGIATGVVILLLSGGKSSHILVFSEDLFFIYLLPPIIFNAGFQVKKKQFFVNFMIIASFGAIGTLISCVVITFGATQAFKMMDIGPLDIGDYLAIGAIFAATDSVCTLQVLNQDETPLLYSLVFGEGVVNDATSVVLFNAIQSFDLDRLNPSIAVHLLGNFLYLFIASTLLGVLTGLLSAYVIKKLYIGRHSTDREVALMMLMAYLSYMLAELFYLSGILTVFFCGIVMSHYTWHNVTESSRVTTKHSFATLSFVAEIFIFLYVGMDALDIEKWKFVSDSPGTSIATSAVLLGLILLGRAAFVFPLSFLSNLTKKSQHQKISFRQQVIIWWAGLMRGAVSMALAYNQFTRSGHTQLRSNAIMITSTITVVLFSTVVFGLLAKPLIRLLLPHQKATNSMTTTESSTPKSVIVPLLGEPRDSEADLEGHEIHRPNSIRALLSTPTHTVHRLWRKFDDSFMRPVFGGRGFVPVEPGSPTERNGNLWR

SEQ ID NO: 71298 - protein, 429 aa, Cryptococcus neoformans var. neoformans B-3501A
MSHLLPPNLLKLFAPRPQPPFLKPLTRDERIRGPNNLGGVAGLAKRIKEEAEDAEVKQGMGMNPEKALDEQKEENVKMELKQDGEDGEVAEDSGKEKKKKTARDKIAEMGIIGEEAVKMRKELRKKRQEEYKKNAESNYKPQDDAQAIGDPYKTLFISRLSKKANETDLRREFEMYGPIERIRIVRNRKGKSNGYAFIVYERERDMKAAYKDAEGIPIHHKKILVDVERGRTVKGWKPQRLGGGLGGRPKPVAPEASPAPYVAPSNLRGGRGGFRGGGRGGGGGFRGGFQGNRGGFGGGNRGGFGGGDDRGGFAGRGGFRGGFQNRGDRGPGGFGQQQGGFGGPGGPGGYGGQGGGYGGGGGGFGGPGQQNGVQGGQGGGGFGGGGGYKRDYDNAGGPGGYGGGGGGGGGGFGGGGGGYQDRDPKRMRY

SEQ ID NO: 71299 - protein, 103 aa, Zea mays
STLQNLNEHPDAWPFKEPVDSRDVPDYYDIIKDPIDLRTMLRRVDSEQYYVTLEMFVADMKRMFSNARTYNSPDTIYYKCATRLENFFSGRITVLLAQLSTKS

SEQ ID NO: 71300 - protein, 377 aa, uncultured bacterium
MERLALIGVSQRRGGSAALQAWNEWLQVRLEPPPGLLQEWVPLLTCNRSELVLALGEGVELEQLRQHLIPSHLPRGYAFAGEAALEHLARVAASLDSVNPGEDQIMQQVRAAFEAASAAGTVGPTTSFAFQNALRIAKRVRREVLLAPAQTSLFSLARPALEAMLPRPARVAVVGAGEMGSLAARSLAAVEGLDLWVVNRSLDRARALAERLGAKALGLEEFLANPPALDAVVAATPVAGLLGPAFFQKQPRLVAVVDLGMPKNVVPEAVRGAVLFDLERLQRLGEERRARLQADLARAERIVLEEVEQVVMEWAERSMAPAIARMREVYRRTLDELVGELVGPEMVERLAHRFAHFPVKGLRGLARWHGAEVAQTF

SEQ ID NO: 71301 - protein, 296 aa, Rhodococcus ruber
VGRPVGPGVANIREGDHVVLAFIPACGRCRACAKGLQNICDEGANLLTGQAIADKTHRVTLNGDPVIQMCLLGTFAPYVTVHEASVIKIEDDFPLDKAALLGCGVATGWGSATAIGGTKVGDSVVVIGIGGVGINAVQGAAHAGARHVVAIDPVEFKRDQAKKFGATHTFASIEEALPVIGEITWGAMADVTIITVGEIHGDIIAPSMALTGKGGQVVVVGMGSAADTQVTLSLFELTLLQKRLQGAIFGGVGPRLQIPKLLDLYRSGQLELDKLVTKTYRLEDINDGYADMHEAR

SEQ ID NO: 71302 - protein, 173 aa, Triticum aestivum
  misc_feature (82)..(82): Xaa can be any naturally occurring amino acid
  misc_feature (133)..(133): Xaa can be any naturally occurring amino acid
MNSGDAAGSSSGGSGDAGAPRRASRKPKYSKFTQQELPACKPILTPKWVISVFVLVGVIFVPIGVASLLASNKVVEIVDRYXDACVPSNVTDKLAYIQNSTISKTCRRTLKVPKDMKQPIFVYYQWNYFYQNXRRFVKEPGMDHPLKRDAWLGQNKNPPLVGPWKKTRIWEWA

SEQ ID NO: 71303 - protein, 176 aa, Shigella flexneri 2a str. 2457T
MSLLNVPAGKDLPEDIYVVIEIPANADPIKYEIDKESGALFVDRFMSTAMFYPCNYGYINHTLSLDGDPVDVLVPTPYPLQPGSVIRCRPVAVLKMTDEAGEDAKLVAVPHSKLSKEYDHIKDVNDLPELLKAQIAHFFEHYKDLEKGKWVKVEGWENAEAAKAEIVASFERAKNK

SEQ ID NO: 71304 - protein, 308 aa, Aspergillus oryzae
MPTERSTEQPASKVSADDEPVSVTAKEQNNAAKDSTASQKGPEGAKASGNSSATVEPVKGDDTAAKARQRQERFKALQARAKSATERNLKETAAETQRLATDPSLLSSLSRKHAFASHNLLKADTEAAGEDFERKRAWDWTVDESEKWDKRMEKKQRHRDDVAFQDYTQDARKVYKRQLREIQPDLEAYEREKLAAIERAAANGDLEIVETNDGEMIAVDKNGSFYSTADTVGFTDNKPDRAAVDKLVGDLRKAEEVRLKKRRERRGEEDADVTYINEKNKQFNQKLARFYNKYTTEIRDSFERGTMI

SEQ ID NO: 71305 - protein, 384 aa, Anaplasma phagocytophilum HZ
MGDIRDLPVIDAANISNSRVLLRVDLNVPISNGEVHDKTRIERIAPTVEFLVKAKAKVVMISHLGRPKAQEEEFSLKQVVDVVSKVLGVEITFIPDITREEVDSVIDSLPWGSVVLLENLRFFTGEVENDLGFAGQLASLADMYVNDAFSCSHRKHASVDAIMNLLPSFAGFNLQEELNYLDGIVSESPGAAIIGGAKTSVKIPMLRNFASRLDFLILGGSLSTTFLDAMGFKVGNSFFEKNVEEALAVIEAAKESGCKIILPVDHAVAQNLEGPVTVKDNNDVTMEDSIFDIGEKTSRIIEETIRKCKTIFWNGPLGVFEHESFKGGTERLTKALVSCHKENGAKTIIGGGDSIFAMRSFGYCEQDFSYVSTGGGALLHFLAL

SEQ ID NO: 71306 - protein, 457 aa, Saccharomyces cerevisiae YJM789
MTSEPEFQQAYDEIVSSVEDSKIFEKFPQYKKVLPIVSVPERIIQFRVTWENDNGEQEVAQGYRVQFNSAKGPYKGGLRFHPSVNLSILKFLGFEQIFKNALTGLDMGGGKGGLCVDLKGKSDNEIRRICYAFMRELSRHIGKDTDVPAGDIGVGGREIGYLFGAYRSYKNSWEGVLTGKGLNWGGSLIRPEATGFGLVYYTQAMIDYATNGKESFEGKRVTISGSGNVAQYAALKVIELGGIVVSLSDSKGCIISETGITSEQIHDIASAKIRFKSLEEIVDEYSTFSESKMKYVAGARPWTHVSNVDIALPCATQNEVSGDEAKALVASGVKFVAEGANMGSTPEAISVFETARSTATNVKDAVWFGPPKAANLGGVAVSGLEMAQNSQKVTWTAERVDQELKKIMINCFNDCIQAAQEYSTEKNTNTLPSLVKGANIASFVMVADAMLDQGDVF

SEQ ID NO: 71307 - protein, 178 aa, Riemerella anatipestifer
MATQELIKKLEKTIDNIPNFPKEGIQFKDITPIFLNPELYEEVIDDLVAFSKGKVDVVCGIESRGFLFGIAVAVKLGVPFVLIRKKGKLPPPFISQKYDLEYGSSEIEMKEGQLKAGDRVLIHDDLLATGGTTEAAAKLVEKQGAKAAQFSFLIGLKALGGEAKLKKFNSEIYQLLEY

SEQ ID NO: 71308 - protein, 904 aa, Arabidopsis thaliana
MEEDNKKNTSWQMDSPCWLLLLLLGAFAIIGCVQAQDQQEFISLDCGLPMTEPSSYTESVTGLRFSSDAEFIQTGESGKIQASMENDYLKPYTRLRYFPEERRNCYSLSVDKNRKYLIRARFIYGNYDGRNSNPIFELHLGPNLWATIDLQKFVNGTMEEILHTPTSNSLNVCLVKTGTTTPLISALELRPLGNNSYLTDGSLNLFVRIYLNKTDGFLRYPDDIYDRRWHNYFMVDDWTQIFTTLEVTNDNNYEPPKKALAAAATPSNASAPLTISWPPDNPGDQYYLYSHFSEIQDLQTNDTREFDILWDGAVVEEGFIPPKLGVTTIHNLSPVTCKGENCIYQLIKTSRSTLPSLLNALEIYTVIQFPRNQLHLLILTSLSSTSVVAVKNIEAAYKLSRIRWQGDPCVPQKYAWDGLNCSNNTDVSKPPRVLSLNLSSSGLTGIIAAAIQNLTHLEKLDLSNNTLTGVVPEFLAQMKSLVIINLSGNNLSGPLPQGLRREGLELLVQGNPRLCLSGSCTEKNSKKKFPVVIVASVASVAIIVAVLVIIFVLSKKKSSTVGALQPPLSMPMVHDNSPEPSIETKKRRFTYSEVIKMTNNFQRVVGEGGFGVVCHGTINGSEQVAVKVLSQSSSQGYKHFKAEVDLLLRVHHTNLVSLVGYCDERDHLALIYEFLPKGDLRQHLSGKSGGSFINWGNRLRIALEAALGLEYLHSGCTPPIVHRDIKTTNILLDEQLKAKLADFGLSRSFPIGGETHISTVVAGTPGYLDPEYYQTTRLGEKSDVYSFGIVLLEIITNQPVIDQSRSKSHISQWVGFELTRGDITKIMDPNLNGDYESRSVWRVLELAMSCANPSSVNRPNMSQVANELKECLVSENLRENMNMDSQNSLKVSMSFDTELFPRAR

SEQ ID NO: 71309 - protein, 264 aa, Anaplasma phagocytophilum HZ
MGRGTITIHSKEDFACMRRAGMLAAKVLDFITPHVVPGVTTNALNDLCHDFIISAGAIPAPLGYRGYPKSICTSKNFVVCHGIPDDIALKNGDIVNIDVTVILDGWHGDTSRMYWVGDNVSIKAKRICEASYKALMAAIGVIQPGKKLNSIGLAIEEEIRGYGYSIVRDYCGHGIGREFHAAPNIVHYYDEEDDVTIQEGMFFTVEPMINAGKYHTVLDKKDGWTVTTRDFSLSAQFEHTLGVTETGVEIFTMSPKNWHCPPYL

SEQ ID NO: 71310 - protein, 184 aa, Aspergillus oryzae
MSISSQVAARCCRQIVRPSAASLRLSSSTYLSQRTRRWQSTEAEAAAPVNPKISQIVDQISTLTLLETADLVATLKTRLNIPDLPVGGFAMAGGAAPAAAPAEEEEAAPAAQEKTLFNLKLESIDAASKAKVIKEIKSLLGLSLVDSKKFVESVPKVLKESVPKEDAEKIIETLKAVGAKAIME

SEQ ID NO: 71311 - protein, 265 aa, Acinetobacter sp. ADP1
MSGSTIIPWVVGNWKMNPKQSDAIQLVQQFKDLLKQQPISEQYCHVGVAPIAIALTTIQSELATANRQVATVAQDVSRFAGTGAYTGEISAELLTDSQIRYVLIGHSERRDLLGDHVEILKAKLSHALNAGMTVIYCVGESLEQREQGLAEQIVLQQICDIAPVVSAEQWQHQIVIAYEPIWAIGTGRTASPEDAQAIHAKIREGLCQITPAGSQIALLYGGSVKPENAVELAACPDINGALVGGASLNAESFYKIAQAFAQTQQ

SEQ ID NO: 71312 - protein, 248 aa, Ustilago maydis 521
MARTFFVGGNWKMNGSLESTKQLTQTLTQAKLDSNVEVVVSPPALHLLAVQEQLKGSKVAVAAQNAYHKPSGAFTGEVSVTMLKDAGIPWVILGHSERRTLFHESDANVAEKTAAALAENLSVILCIGETLEQREANETVNVVVRQLDAVADHVKDWSKIVVAYEPVWAIGTGKVATSEQAQEVHAAIRKWATEKLGKDTADQLRIIYGGSVAAKNCKELAQRPDIDGFLVGGASLKPEFVDIVNANA

SEQ ID NO: 71313 - protein, 278 aa, Polaromonas sp. JS666
MSTPNPGSNEHIAFIGGGNMASAVIGGLLKQGLPAGQIQVVEPFAEQRARLVQQFGVAVSDAPGASLSSAGLVVWAVKPQTFKEAAAQARAHTQAALHLSVAAGIRSDSIAQWLGTERVVRSMPNTPALVGKGMTALFARPAATAADRAAVERVIQTTGEYLWLNDEVQLDAVTALSGSGPAYVFYFLEAMIQAGTDMGLEPEQARKLAVGTFVGASALAHASDEPLEVLRARVTSKGGTTYAALTSMEQAGIKQQFMQAIEAARQRAGELGDEFGAA

SEQ ID NO: 71314 - protein, 333 aa, Mesorhizobium sp. BNC1
MPVNLHGRSFLTLLDFTPDEIRFLLRLSASLKQAKYGGYEQQRLKGKNIALIFEKDSTRTRTGFEVAAYDQGAHVTYLGPSGTQIGHKESMKDTARVLGRLYDAIEYRGFGQDLAEELACHAGVPVYNGLTDAFHPTQILADFLTMREYTRKHLSAVSFAFLGDAGNNMGNSLMVGAALIGMDARLCGPEQDWPDPQLVDQCREIAARTGGRITLTEDIEKAVKGCDYVYTDVWVSMGEPQSVWAERIERLTKYRVTSEVMEATGNPHTKFMHCLPAFHNRETKMGENIFQEFGIDCMEVSEEVFESPASVVFEQAENRMHTIKAVLVATIGG

SEQ ID NO: 71315 - protein, 128 aa, Anabaena variabilis ATCC 29413
MSAATDQILDQLKSLSLLEAAELVKQIEEAFGVSAAAPVGVAVAAPAAAAAAEPVEEQTEFDVILESVPADKKIAVLKIVREITGLGLKEAKDLVEAAPKAVKEAIAKDAAEDAKKRIEEAGGKVTIK

SEQ ID NO: 71316 - protein, 221 aa, Glycine max
  misc_feature (50)..(50): Xaa can be any naturally occurring amino acid
  misc_feature (52)..(52): Xaa can be any naturally occurring amino acid
  misc_feature (81)..(81): Xaa can be any naturally occurring amino acid
  misc_feature (95)..(95): Xaa can be any naturally occurring amino acid
  misc_feature (113)..(113): Xaa can be any naturally occurring amino acid
  misc_feature (124)..(124): Xaa can be any naturally occurring amino acid
  misc_feature (167)..(167): Xaa can be any naturally occurring amino acid
  misc_feature (187)..(187): Xaa can be any naturally occurring amino acid
IKTSIQLHGESLSSSHSTSAFRVGEGIIRDQGALGLSRGLSPAIIRHMFXSXVRIVGYENVRNVVSVDNDSFSIVGKQVVXGMSGVLGQVITSPXDVVKVRMQGDVQRVSQGXQPRYSGPLDAXTKLLKVKDFQGWGKGVLLYIQRPFLVSRGQEAGYDQDKQLSIXTRIADPNVFAHTIASIMSGXAATSERCQQDVVKTRMSNQVFKHNKVGTGGGKGF

SEQ ID NO: 71317 - protein, 367 aa, Selaginella kraussiana
MNVEAETERVQLKESKEVVPLSTWVLISNLKVAYTLARQPDGSFNRELAEFLDRKVAPCNVDGVVSMDVVMDRSTGLWSRIFIPTGGANHGNVGGGNGDGAATMPIFFYFHGGSFAHSSANSALYNTVCTHVARHCQVVVISVNYRRSPEHRYPAAYDDCATAVHWLAAQINSGNHTTWLPPTADPSRCFLAGDSNGGNIAHHVAVRWARDRTAGISPATSSLNIVGTILLIPMFGGTRRTPSELRYDGQYFVTIRDRDYYWQSFLPLGADRDHPACNIFGPNSPRLDELPLPPMLLAVAELDMILDWQMEYLSGMRRAGKTIHKLFLREATVGFFIFPNTLHFHLLMDAIKKFIRDPGAASIGEEA

SEQ ID NO: 71318 - protein, 1283 aa, Ustilago maydis 521
MIRVVLFSCLSAKIRLNEAVSSEQHHPLHHRRSHWQEKLQRQFGRVPLLLDDSTEQHQEQLRLTWSLSARPTGWPVQTITDSVISLDHQKGTQNSFSLIDPAVEPPSTHHVMLSNHSSSDSRAMMTVQPLSSATAPLAAGPSGSRLPASPSKRVRTRQIAGASVSPAKKRRLKTLPAVKKRPPTRPATRRAPPQETCAFCLQPADRSRGGTPKLLISCYECGSSGHPSCLKWGRKSTKVHKALSYNWRCIECKKCEVCDDKGDDAQLMFCDRCDRGWHLYCLTPALSKPPKGQWHCPTCVAGDQHHQWSLPACPASTHLPSQIVRVSSSGRQSKPSNPDRSIDSLLTAHASLHRAKDAQLLAGPNFAVMNTLKNGLLSAAGSLLNFAPVSPWSPRSKIQTGMMPSSLNSSSKQTATGGGGSARGGKRGRPRKSAGASRSNQRPVSSLTGADRHASSSRNARLGDQEGSDSSDGEHGLEHGVHDGDSTKDVREDDEDDAAGECDAKSSEEEDPFGGVLEGSDALTLPYKPTPQDIERFQRAQQAAQDKLGGILADLPASSGSRVVRRPGLTPTVISSSAAASPRHASSIIPTDSPIGTSRTSRAQLVTRHSPSSTSVLSQVEITTAASSAETGTASPIKCIRFGEFDIDTWYQAPYPEEYSMVPDGRLWICEFCLKYMKSRFMAQRHRLKCKMRHPPGDEIYRDGNICVYEVDGRKNKIYCQNLCLLAKMFLDHKTLYYDVEPFLFYIVTEGDSTGDHFVGYFSKEKRSPMNYNVSCIMTLPVRQRRGWGNFLIDISFLLSKKEGRTGTPEKPLSDLGLLSYRNYWTLAVFYYLRTAPDEVSMDDISRATAMQLEDIYYVLAEKDMIVVYDGNNANSRTPATSKYRAREGIAAGSASAGGTSSAPESQLRKRGRPPLQHRPPPATRLPSYKDRDKNAAASLPRDYRIHFDRDYVIAHLKNYESKGYLKVRADKLKWTPFLVSRSFPQPISSAINGHSVCSGVGHSNGTPAPSGSGTFTPAEMMANLGYSVLNQVQKTPGRADTVSARASPAAAAGRRNMALVGPAAASPAAIGASNSANASLPSSPGQIPIATPTPSSPKKRNRPVPPAGNALYDITLGNTKSEEDGPRSQAEIASGLVGSLQVSPDISSSKTATANIDVAGAADAWDEDLDADGDADGEHEADEYVYDTSAPLTKQESQSTIAPGTEPLSVNAQRLERVLTASSGAPSGPAIRVSPQVQLPLEVANPWQARDGATTTPDAYDAEYDLGDEDADGSDDPALEEI

SEQ ID NO: 71319 - protein, 364 aa, Shewanella sp. ANA-3
MSYQIAVLAGDGIGPEVMAEARKVLKAVEARFGLNIEYSEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREIARIARIAFEAARGRRKKVTSVDKANVLACSVLWRQVVEEVAVDFPDVELEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVSKALNSGYLTGELLSSDQRHKAKSTVEMGNFIADAVKAGV

SEQ ID NO: 71320 - protein, 409 aa, Arabidopsis thaliana
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVAALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 71321 - protein, 491 aa, Mycobacterium avium 104
MSVAPETTVALQDRFFRELPELAVRWQAETFPELRLLALNEPLATQLGLDTGWLRGPDGLRFLTGNLVPTGAAPVAQAYAGHQFGGFVPRLGDGRALLLGELVDDEGRLRDIHLKGSGATPFARGGDGLAAVGPMLREYVVSEAMHALGVPTTRSLAVVGTGRPVYREATLPGAVLARVAGSHLRVGSFQYAAATGNRDLLRRLADHAIARHHPGAADAEQPYLALFEAVVAAQASLIAQWMLIGFVHGVMNTDNMTISGETIDYGPCAFMEAYDPDTVFSSIDFWGRYAYGNQPVIAGWNLARFAETLLPLFSENTEEAIALAERSFGVFQTRYDAVWAAGMRAKLGLPAQVDAEFAAALIDELLALLKANHVDYTSFFRQLGRAARGDDRSAAEPAREMFMDLPGFDAWLARWRALGPDADAMDRVNPIYIPRNHLVEEALAAATDGDLDPLDQLLAAVTAPYTERPGFERYASPAPEDFGKYQTFCGT

SEQ ID NO: 71322 - protein, 560 aa, Acinetobacter sp. ED23-35
MTTLKITGMTCDSCAAHVKEALEKVPGVQSALVSYPKGTAQLAIEAGTSSDALTTAVAGLGYKAMLADAPPTDNRTGLFDKVRGWMGAADKGSGGERPLQVAVIGSGGPAMAAALKAVEQGAQVTLIERGTIGGTCVNVGCVPSKIMIRAAHIAHLRRESPFDGGMPPTPPTILRERLLAQQQARVEELRHAKYEGILDGNSAITVLHGEARFKDDQSLIVSLNEGGERVVMFDRCLVATGASPAMPPIPGLKESPYWTSTEALVSDTIPERLAVIGSSVVALELAQAFARLGSQVTIQARSTLFFREDPAIGEAVTAAFRAEGIKVLEHTQASQVAHVDGEFVLTTGQGEVRADKLLVATGRTPNTRSLALEAAGVAVNAQGAIVIDKGMRTSSPNIYAAGDCTDQPQFVYVAAAAGTRAAINMTGGDAINLTAMPAVVFTDPQVATVGYSEAEAHHDGIETDSRTVTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 71323 - protein, 303 aa, Rhodococcus sp. DS7
MKTKAAVLLEPGKPFEIMELDLDGPGVGEVLIKYTAAGLCHSDLHLTDGDLPPRYPIVGGHEGSGIIEEVGPGVTKVKPGDHVVCSFIPNCGTCRYCSTGRQNLCDMGATILEGSMPDGSFRFHGNGMDFGGMCMLGTFSERATISQHSVVKIDDWLPLETAVVVGCGVPSGWGTAVNAGNLRAGDTAVIYGIGGLGINAVQGAVSAGCKYVVVVDPVALKRETALKFGATHAFADAESAAAKVNELTWGQGADAALILVGTVDEDVVSAATAVIGKGGTVVITGLADPAKLTVHVSGTDLTL

SEQ ID NO: 71324 - protein, 374 aa, Solibacter usitatus Ellin6076
MPQSYPAIQAPPRLLFGPGPSMVAPRVYQAMSQPVVGHLDPFFFQVVEEVRGLLGYAYSTKNHFNLATSGTGTSGMECAVANFTEPGDKFALLTNGFFGDRIGDMARRHGGEVVRLTKPWGEPFDAQEVREFIRRERPRVVAFVQAETSTGMFNQAKPICDAAREVDAVTIADCVTSLGGMPVLVDENGIDIAYSCSQKGLGCPPGLAPMTVGPRALGRLKERKAPVQSFYLDLQLLDSFYCGKKYHHTASATMFYALREGLAIVAEEGLEARWARHKANHEAFVKGIEAMGLSMLVPEGHRLWTLNTPRIPEGVDDAKVRQFLLEQYNMEIAGGFGPLAGKVFRIGTMGYSSTAENVQLILQALEEALKAAKA

SEQ ID NO: 71325 - protein, 486 aa, Oryza sativa Japonica Group
MAVSSSSLLLRRGATGGAGRRWGPGEALRRLVSSSEAAPAEKVPARSPPVMPPFEHRPRPYAGWSGDEILAKRKQFLGSSVFYYYQKPLNIVEGKMQYLYDENGKRYLDCFGGIVTVSCGHCHPDIVNAVVEQTKLLQHTTTIYLNQPIVEFAEALASKMPGNLKVVYFVNSGTEANELAMLMARLYSGNLNMIALRNAYHGGSAGTIGLTGLQTWKYPIPQGEIHHVMNPDPYRGTFGSDAVAYAKEVEEQINYGTSGRVAGFIAETFQGVGGAVELAPGYLKLAYDTVRKAGGVCIADEVQSGFGRTGSHYWGFQTQDVIPDIVTMAKGIGNGLPLGAVVTTPEIANVLAQKIQFNTFGGNPVCSVGGLAVLKVLDKEKRQAHCADVGSHLVNRLKELQQKHEIIGDVRGRGLMLGVELVTDRKEKTPAKAETNLLFEKLKDLNILVGKGGLHGNVFRIKPPMCFTRDDADYLVDAMDYAMSGL

SEQ ID NO: 71326 - protein, 252 aa, Triticum aestivum
  misc_feature (138)..(138): Xaa can be any naturally occurring amino acid
  misc_feature (150)..(150): Xaa can be any naturally occurring amino acid
  misc_feature (214)..(214): Xaa can be any naturally occurring amino acid
  misc_feature (227)..(227): Xaa can be any naturally occurring amino acid
MSWCTIESDPGVFTELIQEMQVKGVQVEELYSLDVDSLSQLQPVYGLIFLFKWMAGGNDERPVVSDPNPNLFFARQVITNACATQAILSILMNRPEIDIGPELSNLKEFTGAFAPDMKGLAINNSDSIRAAHNSFARXEPFVSDEQKAPXKDDEVYHFISYIPFEGVLYELDGLKEGPISLGQYPGGPEDLGWLQMVQPVIQERIERYSQSEIXRFNLMAIIKNRKXDVSMPDCRDLKKKKEQILAGPDAYR

SEQ ID NO: 71327 - protein, 462 aa, Glycine max
MALQTATPPTTPSAQVVGNAFVEQYYHILHHSPGSVYRFYQDSSVISRPDSSGVMTSVTTMKGINEKILSLNFKEFKAEIKTADAQKSYKEGVTVLVTGCLTGKDNLRRKFAQSFFLAPQDNGYFVLNDVFRYVEDHEPSELPPVTGDGDSAAVTVTPELEPSHVADSCAPEPTNSHVNKGQTVAENAYELSNNHERQIPVENEGNVESHFQSNGNDDSQATELASSAQDDAPKKSYASIVKVQKGSSVPTKVYVPTNTLKSGPNKTESKVVESVESTEVPEAALESVSNPESSDAHEEVEGHSIYIRNLPLNVTVAQLELEFKKFGPIKPGGIQVRNNKQQGYCFGFVEFLSLNSMNSAIQASPVPIGGRQAVVEIKRTTTRVGSGINGTGRPRIPSGRGGLRNDSFRGRGNYVGGRGYGRNDYVSRGGFSGRGRGHGEGYHQGRGRGGRSSGQKQNAVSN

SEQ ID NO: 71328 - protein, 163 aa, Photorhabdus luminescens subsp. laumondii TTO1
MRRILSVLLENESGALSRVVGLFSQRGYNIESLTVAPTDDPTLSRMTIQTKGDARVLEQIEKQLHKLVDVLRVSELAPGSHVEREIMLVKLQASGYGREEIKRSTDIFRGQIVDVTATLYTVQLVGTSDKLDAFLDAVRDVAEIVEVARSGIVGVSRGDKIMR

SEQ ID NO: 71329 - protein, 464 aa, Paracoccus denitrificans
MSTYDLIVIGAGPGGYVCAIRAAQLGLKVACVEGRETLGGTCLNVGCIPSKALLHASHMLHETHENFEKMGLMGAKPKVDWGKMQGYKAETVGGNTKGIEFLFKKNKIDWLKGWASIEAPGKVKVGDTTHETKNIVIATGSEPASLKGVEVDNDAGIVVDSTGALSLPKIPKSMVVIGAGVIGLELGSAYARLGAEVTVVEFLDAITPGMDGEVQKQFQRILAKQGLKFVLGAAVSGVEVEKGKAEVKYKLRKDDSEHEIKAECVLVATGRRPYVAGLGLDKVGVALTDRGFVQIDDHWQTSVKGIYAIGDAVPGPMLAHKAENEGMAVAEVIAGKHGHVNYDVIPGVIYTTPEVASVGLTEEAAKESGRKIKVGKFPFMGNARAKALFQAEGFVKMIADAETDRVLGCHIIGPNAGEMIHEVCVAMEFGASAQDIALTCHAHPTCSEAVREAALACGDGAIHA

SEQ ID NO: 71330 - protein, 455 aa, Vitis vinifera
MAKFGVLETDPSMAAKATEELKKELQRLVSRIVDEDESCADTTDKALKILFALRDFKFKGSLDFGVETENPALPQEFRCPISKQLMRDPVVVATGQTYDRPFIQKWLKDGHRTCPRTQQVLSHTILTPNNLVREMISEWCKEHGIELPKPVEDVDEEVITDADRGHLNSLLERMSSSASDQKEAARELRLLTKRMPSFRALFGECTDAVPQLLSPLSPDAVDVDPELQEDLITTVLNLSIHDNNKKLVAEDPMAIPVLIESLKSGTIETRTNAAAALFTLSALDSNKLIIGKSGALKPLLDLLEEGHPLAMKDVASAIFNLCIVLENKGRAVHDGAVTVILKKIMDGILVDELLAILAMLSSHQRAVEEMGELGAVPCLLRIIRESKCERNKENCIAILHTVCFNDRAKLRAIREEENDYGTISRLAQTGTSRAKRKANGILERLNRVALITHTA

SEQ ID NO: 71331 - protein, 198 aa, Helicobacter pylori
MLVTKLAPDFKAPAVLGNNEVDEHFELSKNLGKNGAILFFWPKDFTFVCPTEIIAFDKRVKDFHEKGFNVIGVSIDSEQVHFAWKNTPVEKGGIGQVSFPMVADITKSISRDYDVLFEEAIALRGSFLIDKNMKVRHAVVNDLPLGRNADEMLRMVDALLHFEEHGEVCPAGWRKGDKGMKATHQGVAEYLKENSIKL

SEQ ID NO: 71332 - protein, 388 aa, Vibrio sp. Ex25
KFTLDSDLPKGEGNQESVGLDYKELPQDVSPNDILLLDDGRVQLQVTSVEGNKVHTRVIVGGPLSNNKGINKKGGGLSADALTEKDKADILTAAEIQVDYLAISFPRNGEDMHYARRLARDAGLEAMLVAKVERAETVATNESIDDIILASDVVMVARGDLGVEIGDPELIGVQKKLIRRARSLNRIVITATQMMESMITSPMPTRAEVMDVANAVLDGTDAVMLSGETAAGKYPVETVKSMAEVCVGAEKMSEASLSTYRLDRTFETAEETIAMATMYSANHMEGIKAMISLTESGRTALMMSRLSSGLPIFALSRNESTLNRAALYRGVTPVYFESKSDAGLPTAQAAIASLKEQGFLHKGDLVMITQGDVMDVVGSTNCMRILQA

SEQ ID NO: 71333 - protein, 486 aa, Xylella fastidiosa Temecula1
MMHHNVHQSEILADPCDLQRAERWRQRDLRVLWHPCTQMREHPDTLPLVPIVRGEGVWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACSAISTDTDDKDLGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEQQLHLLAETTRVAIDEAIACV

SEQ ID NO: 71334 - protein, 311 aa, Zea mays
MGSGSLLKVFANNFDVLAGPLVALAYPLYASIKAIETKSPVDDQQWLTYWVLYSLITLFELTFASIIQWLPFWPSMKLIFICWLVLPYFNGAAYVYQNYVRPAFIKNQMVNIWYVPQKKGLLGKSDDFLTALDKFIEENGTDALKKLANKAGKPFKQSGKSSKDQKETKSSKDSKEPKPSKDAKQPKPSKDTKEPKPPKVSKSPKDSKEQKKATLKDPKKAPKDSKGLKKALKDPKEQESLEDPKEHTAKKAGKRVTFAEVEPEKELKASNSDWHPSSDFHAAYPEQNPWASGFMIFEDENSYWNRGPLDC

SEQ ID NO: 71335 - protein, 446 aa, Xylella fastidiosa Temecula1
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPALKKQSGVQHSNGSRNRDGMLPVHQRG

SEQ ID NO: 71336 - protein, 165 aa, Acanthus ebracteatus
MSLTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLAAGMAIGIVGDAGVRANAQQPKLFVGMILILIFAEALAWYGLIVGIILSSRAGQSRAE

SEQ ID NO: 71337 - protein, 260 aa, Oryza sativa Japonica Group
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTAFVAGNDFAQVEFNRLPLGRLGKPEDISSLVAFLCMPAASYITGQIICVDGGRMLS

SEQ ID NO: 71338 - protein, 459 aa, Capsicum chinense
MANITNEFMGHDMLAPFTAGWQSDMEPLVIEKSEGSYVYDINGKKYLDTLSGLWCATLGGSETRLVEAANKQLNTLPFYHSFWNRTTKPSLDLAKELLNMFTANKMAKVFFTNSGSEANDTQVKMVWYYNNALGRPQKKKIIARAKAYHGSTYISAGLSGLPPMHQKFDLPPPFVLHTECPHYWAYHLPGETEEEFSTRLANNLESLILKEGPETVAAFIAEPVLGAAGVILPPATYFDKVQAILRKHDILFIADEVVCGFGRLGTMFGSDKYNIKPDLVSVGKALSSGYMPIAAVLVSQKISSVILSESNKIGAFCHGFTYSGHPVACAVALEALKIYKERNITEVVNKISQKFQEGLKAFADSPIIGEIRGTGLALSTEFVDNKSPNDPFPYEWAVGTYFGAQCAKYGMLVSSTGDHVNMAPPFILSLEELDELIRIYGKALKDTEKRVEELKSQKQ

SEQ ID NO: 71339 - protein, 358 aa, Arabidopsis thaliana
MSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTDGETTTQGLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 71340 - protein, 193 aa, Anaplasma phagocytophilum HZ
MLGCRFVAGVQDRKSFPDFGVPEVAFAGRSNVGKSSLINAITNNKKNAKTSSNPGSTRQINFYLNKGIVALVDLPGYGYSKASKEATRGYLDVMEHYLMSREALQRLVLLIDSRIGLKEIDRDFLCWLEEHGIYYSIVLTKADKLSEQALGSMVSFVQNQAQGGNFLLQPIMWVSSKSGRGIRELAHEISRCI

SEQ ID NO: 71341 - protein, 533 aa, Polaromonas sp. JS666
MQPMTTESLPAPAPTRRHDLIARLAQPCQYDLAIIGGGATGLGVALDAAARGFSVVLVESHDFAKGTSSRATKLVHGGVRYLAQGNISLVREALHERTTLLANAPHLAQPLAFVMPSYKFWEAPFYGVGLKMYDALAGKAGLGPTEFLSRTETLDCLPTAQPQGLKGGVKYWDGQFDDARLALALARTAARQGALLVNYCAATGLIHENGKLVGLHAQDQETGRLFEIKAKCVVNAAGVWVDQLRLQDGQAIGRETQPMVAPSQGVHIVVDRSFLPTDHAMLIPKTADGRVLFAVPWLGKTILGTTDTPRHDLAREPLPFKEEVDFILRESARYLSRAPGPTDIKSIWVGLRPLVKPSDDHAERTQALSREHTVLVSNSGLVTVTGGKWTTYRAMAEDVMETCFAAGLLPRRAGTATAHLKLVGAQDLGRKISDAPGVHLYGSEAAVVQGLPGAAHELGGGLTEAMVRFAARYEYARCVEDVLARRSRLLFLDAALARSLASEVAVLLQQENGVDPQLEAFLALCGQYLSLPD

SEQ ID NO: 71342 - protein, 436 aa, Arabidopsis thaliana
MLLHFGVVPVIIVSSKEGAEEVLKTHDLETCSRPKTVGSGLFTYNFKDIGFAPYGENWREMRKIAVSELFSQKKLKSFRYIREDESQLLVRKVSKSALETPTSSVNLRKVIFTFAASIICRLSFGQNFCDFVDMETVEELVLESETNLGSLAFADFLPAGWIIDRISGQHSTVMKAFSKLTNFFELVIDDHLKSGKIEDHSDIISVMLDMINKPTEVGSYKVTDDHLKGLMSDVFLAGVNAGSITMIWTMTELSRHPRVMRKLQEEIRAALGPNKEKITEEDLEKVEYLKMVIEEAFRLHPPAPLLLPRLTMSDINIQGYSIPKNTMIQINTYTIGRDPKNWTKPDEFIPERFVDNPIEYKGQHFELLPFGAGRRVCPGMATGITIVELGLLSLLYFFDWSLPNGMTTKDIDMEEDGAFVIAKKVSLELVPTLHRW

SEQ ID NO: 71343 - protein, 354 aa, Ustilago maydis 521
MSHAHGQQPNHSTTFKVGETYKVVDVVGEGAYGVVCSAIHVPSSSRVAIKKITPFDHSMFCLRTLREIKLLRHFNHENIISILDIVKPDDYDSFSEVYLIQELMETDMHRVIRTQELSDDHCQYFIYQTLRGLKALHSAQVLHRDLKPSNLLLNANCDLKICDFGLARSANQPEAEGTGFMTEYVATRWYRAPEIMLTFKEYTKAIDVWSVGCILAEMLAGKPLFPGRDYHHQLSLTLEILGTPSLDDFYAITSTRSRDYIRALPFRKRRNLSLMFPNANPLAVDLMEKCLTFSPRKRITVEEALAHPYLEPYHDPEDEPTAEPLDPSFFDFDYCKEQLSRSELKRLIYNEIMR

SEQ ID NO: 71344 - protein, 458 aa, Ustilago maydis 521
MPGVNSIKLLTGNSHPELAQQVADRLGIPLTPCVCKKFADQSIDVRIGSSVRDEDVYVLQTGNSPYTDPNDSLMELLILLSACKTASARRITAVIPSFPYSRHDKKDKSRAPITAKLVANMLTVAGADHVITMDLHASQIQGFFDIPVDNLTSEPSVARWIRSKVENWREAIIVSPDAGGAKRATALADSLGVDFALINRNRRREQHKRIRAAQKTALGLSSRSSFDDLRSGVSTPMSSSYLLDGTGLNSKATVGQATDKLNALSVSAESQSFTSTQQSIGSKHVYSEVANGIKCDETGEWIMTDEQGHLVRSGRSKRDIPGESGTSAEDDSEDENSSRMEILVGDVKGKVAILVDDMVDTGRTLALAAKTLEAAGAAKVYAIITHGLLSGQSIDLLRKLSLERLVVTNTIANTEKAKASEGKLEIMDVSAVIGETIRRSHHGESISQLFRQDAEIMF

SEQ ID NO: 71345 - protein, 149 aa, Oryza sativa
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYEGRYWTMWKLPLFGCTDSAQVLKEVEECKKEY

SEQ ID NO: 71346 - protein, 375 aa, Mesorhizobium loti MAFF303099
MKTRAAVAVAAGKPLEIMEVDLDGPREGEVLVEIKATGICHTDEFTLSGADPEGLFPAILGHEGAGVVVDVGKGVTSVKKGDHVIPLYTPECRQCPSCLSRKTNLCTAIRATQGQGLMPDGSSRFSIGKDKIFHYMGCSTFSNFTVLPEIALAKVNPDAPFDKICYIGCGVTTGIGAVINTAKVEQGATAVVFGLGGIGLNVIQGLKLAGADMIIGVDLNNDKKAWGERFGMTHFVNPKEIDGDIVPHLVNMTKRGADQIGGADYTFDCTGNTKVMRQALEASHRGWGKSVVIGVAGAGQEISTRPFQLVTGRTWMGTAFGGARGRTDVPRIVDWYMDGKIQIDPMITHLLKLEDINKGFDLMHEGKSIRSVVVY

SEQ ID NO: 71347 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKIDPTHSHVKDIDDLSKHTLDKIKHFFETYKDLEPNKWVSVKGFEN

SEQ ID NO: 71348 - protein, 653 aa, Desulfitobacterium hafniense Y51
MNLLTAESLTKSYGIKPLFQDISLGIEEGQKIGIIGVNGTGKSTLLKILAGLEQPDQGQITTNNELQLEYLPQEPDFDPEATVLQQVFKGNSPLMKLLRDYETALERLNQDPNSESYQNTLLQLGQKMDSHNAWQIESEAKAVLTKLGITQFDIPVGTLSGGQRKRVALAGALIQPSNVLILDEPTNHIDNEMVDWLENYLHKLKGALLMVTHDRYFLDRVANRIFELDRGKLYAYPGNYSRFLELKAERDEQEEATERKRQNILRNELAWIRRGAKARTTKQKARIDRFEQLQADQPEEKTGKVEVSAGAARLGKKVIQCSHLRKSYSGSGTVIDDFSIILAKYDRIGIIGPNGSGKSTLLNILAGRMPADAGEIEWGPTVKLGYFAQEYREFEPQTKVIDVIKAVAEVIPTSDGGVLTASQMLERFLFTPAQQWTPVEKLSGGEKRRLYLLQVLMSSPNVLLLDEPTNDLDIQTLSILEDYLEDFPGVVITVSHDRFFLDRVVDQILAFEGQGKIHSAIGNYTDYREQLARRIAEEQSSREALSKTQKLNGQNSRLGEAEAAGHQAKPKERPVKMSYKEQREYEQIEDRIAGLEGQLEQVDQDMAEAGSNYGKLNELMKAKEDLEKQLEESLERWTYLSELAEEIAGRKAP

SEQ ID NO: 71349 - protein, 101 aa, Lavatera thuringiaca
MAISKALIASLLISLLIIQIVEADHQLVTSASKGSSFPKKIDCGGACAARCQLSSRPHLCKRACGTCCARSRCVPPGTAGNQEMCPCYASLTTHGGKRKCP

SEQ ID NO: 71350 - protein, 363 aa, Photorhabdus luminescens subsp. laumondii TTO1
MSNNYHIAVLPGDGIGPEVMAQAYKILDAIRKRFNICITTSEYDVGGIAIDRHGCSLPAKTVAGCEQADAILFGSVGGPKWEHLPPAEQPERGALLPLRKHFKLFSNLRPARLYAGLEVFCPLRNDIAAKGFDILCVRELTGGIYFGQPKGREGQGKYERAFDTEVYHRFEIERIARIAFESARKRSNKVTSIDKANVLQSSVLWREVVTEIAKAYPDVEINHMYIDNATMQLIKDPSQFDVMLCSNIFGDILSDECAMITGSMGMLPSASLNEKGFGLYEPAGGSAPDIAGKGIANPIAQILSAALLLRYSLGHNDAANAIEQAVNYALEQGYRTTDLAGNGKAISTDEMGSTIARYIAEGV

SEQ ID NO: 71351 - protein, 607 aa, Glycine max
MDTNIGSLSLDACKPANNDVGCPPNGAVSAIKPSVPATTMTSSDATLGRHLARRLVQVGVTDVFSVPGDFNLTLLDHLIAEPQLKNIGCCNELNAGYAADGYARCRGVGACVVTFTVGGLSVINAIAGAYSENLPLICIVGGPNTNDFGTNRILHHTIGLSDFSQELRCFQTVTCYQAVVNNIEDAHELIDTAISTCLKESKPVYISISCNLPGIPHPTFSREPVPFSLSPRLSNKMGLEAAVEAAAEFLNKAVKPVMVGGPKLRVANACDAFVELADACGYPFAVMPSAKGLVPEHKPHFIGTFWGAVSTAFCAEIVESADAYLFAGPIFNDYSSVGYSLLLKKEKAIIVQPERVVISNGPAFGCVLMKDFLRELAKRLKHNNTAYENYSRIFVPEGKPVKAEPREPLRVNVLFKHIQDMLSGETAVIAETGDSWFNCQKLKLPKGCGYEFQMQYGSIGWSVGATLGYAQAVPEKRVISCIGDGSFQVTAQDVSTMLRNEQKTIIFLINNGGYTIEVEIHDGPYNVIKNWNYTGLVDAIHNGEGKCWTTKVTCEEELVEAIQTATGDKKDCLCFIEVIVHKDDTSKELLEWGSRVCAANGRPPNPQ

SEQ ID NO: 71352 - protein, 233 aa, Musa acuminata
MKLSDSCLRLGVPKHVDSESPAAVDCCLADTDSFMKPCHLMALSQLHRERIDRDDIHQQGHAGVRLRRAAAQSVWRRFRSAAAPACICRVGAGGVGHQQADREHSDLSAPAVPCLHLSYLLVALSVTCFYSIITMVASFAAITSPSSSPRMLFHLVLSDAVMAGVMASAAGTAGSVAYLGLKGNSHVNWNKVCNVYDKFCRHVGSSAAVSLVASVLLVSLVVLSSYSLYRRCR

SEQ ID NO: 71353 - protein, 520 aa, Oryza sativa
  misc_feature (165)..(165): Xaa can be any naturally occurring amino acid
  misc_feature (199)..(199): Xaa can be any naturally occurring amino acid
  misc_feature (374)..(374): Xaa can be any naturally occurring amino acid
  misc_feature (415)..(415): Xaa can be any naturally occurring amino acid
  misc_feature (467)..(467): Xaa can be any naturally occurring amino acid
MDQLTSSTVFWLTTAVAFLLINTVILRALQKRKSSPAAAAAAAPPPVVQGVGLVRFVRAMARDGPLEAIREQQAKLGSVFTASAPLGLFKVTFLIGSEVSSHFYVASYSEISMGRLYEFTVPIFGPGVLYGVDLETRKEQIRFNWDILKPRSLKASVGAMAEEVXRWGDQGTVDLKHELEQVLMLTASRCLLGKELREXSVPGKLCELFGELDNGLHLISGLLPYLPIPAHRRRDRARQRLGEIITEVIRLRRNSSRGAAGTDENNDDMLQCLINSRYKDGCAMTDAEIAGLVVALMFAGKHTSSGVSIWTGVHLLSNPNHLAAVVAEQDRLMASCPGRTDDYHRLDYDTVQEMRSLHCCVKEALRLHPPVAAXRQAYKHFTGQTKEGKEDTIPGGDMGVSTILVNHYLPHIYKXDPHVFDPQGLRLGRKERKVVGRFLFLLLQWWGGMAWAGEFFSYPPNKGLWKXLLSNFETKWEPLFLKKKETRLFPKPKGKRGVLFTGKLPTPPKNLKKGGEGYCF

SEQ ID NO: 71354 - protein, 610 aa, Musa acuminata
MYKNQLQELAQRSCFNLPSYASIREGPDHAPRFKATVNFNGEAFESPTFCSTLRQAEHSAAEVALNTLSKRGPSRSLAAKVLDETGIYKNLLQETAHRAGLKLPVYTTVRSGPGHTPIFTCTVELAGMSFTGDPAKTKKQAQKNAAMAAWSALKHFKSYLVDGANAAPRLGSSSSPSAPSLSESEKNEEQEPVILAHALAKLQRSEENWSSSQNGRRRGQQRSPPQKSMHPTSNVCFCPIPFQNLVYPDLSSESEFYQMWHRAHASPQQSHFSLTPHARDHRSFPILHYFYPSQVLHTPSVEQDPVSSLRCSTGSSPSLLVCFSDHPVSVASGSWSQFTIQQIHGEQNQRVGKEWLILPSSAEAYSALDVSGSSLQSDNISDASTVQKSHEDQEKECSLGGAEAHLEEEANSSCHGFKSVASASCPTMVQDPAGRTEMQERKTAEKSQGKSYGWMPRASVWPGPSPPNHSLLYNLNSDSSPTQFSHGSPNSSSLDRKFRPSAVSASMRPISSALLHPSGLRYEAFRRQVPSPAAPVTIRTTIPVCSARAGAVNPGTLVSSTSFVAPPVNVRSVVPVCSAPPVRKPEQNQKSIEEKETMSKIDSEFGKIQI

SEQ ID NO: 71355 - protein, 462 aa, delta proteobacterium MLMS-1
MDAKKRMAIPRQYPRELPVAERISNFNEVVYGYDDAMAQREAERCLQCKKPKCRKGCPINNDIPGFIRLIREGKIEEAYWLDRQTNTLPAICSRVCPHEFQCEGSCLLGKKKEPVAIGMLERYIVDWMVTNGKNMLQSCALPNGHKVAIVGSGPAGMSVAYYLAKEGYECTIFESLPKVGGMLTVGIPAYRLPRSIIAAEFEALSNCGVKVVSGVEIGRDKTLADLKNEGFEAIFLGPGAHASRKLGVDGEEFAGVVHGVDYLRRFNLGENIDLGSNVVVVGGGNVAIDCARTALRQGSKNVFILYRRGRDEMPASRAEIHHLEEEGVRIETLAAPVKIHGENGRLNKIECIRMQLGACDASGRCRPEPVEGSNFMIEADAIIPAISQDVDVSAADGQELALSRWGTFEVDEATLQTSVPWIFAAGDAVLGPQTVAKAVYQAKEAAESIHRLIQGRDLKEGR

SEQ ID NO: 71356 - protein, 2310 aa, Staphylococcus epidermidis ATCC 12228
MTKKEKDYKKSLEQQKTRVKLYKSGKSWVKASINEIELLKTMGLPFLSKNEIQENVTEKTEGHKFKKSAAKTTALVGGAFTFNMLNNHQAFAASETPITSEISSNSETVANQNSTTIKNSQKETVNSTSLESNHSNSTNKQMSSEVTNTAQSSEKAGISQQSSETSNQSSKLNTYASTDHVESTTTNNDNTAQQDQNKSSNVTSKSTQSNTSSSEKNISSNLTQSIETKATDSLATSEARTSTNQISNLTSTSTSNQSSPTSFANLRTFSRFTVLNTMAAPTTTSTTTTSSLTSNSVVVNKDNFNEHMNLSGSATYDPKTGIATLTPDAYSQKGAISLNTRLDSNRSFRFTGKVNLGNRYEGYSPDGVPGGDGIGFAFSPGPLGQIGKEGAAVGIGGLNNAFGFKLDTYHNTSTPKSDAKAKADPRNVGGGGAFGAFVSTDRNGMATTEESTAAKLNVQPTDNSFQYFVIDYNGDTKVMTVTYAGQTFTRNLTDWIKNSGGTTFSLSMTASTGGAKNLQQVQFGTFEYTESAVAKVRYVDANTGKDIIPPKTIAGEVDGTVNIDKQLNNFKNLGYSYVGTDALKAPNYTETSGTPTLKLTNSSQTVIYKFKDVQGPQISVDSQTREVGKTINPITITTTDNSKDVLTTTVTGLPSGLSFDQTTNTIIGTPSEVGTTTVTVNTTDATGNVTSKQFTITIQDTISPVVNVTPSQASEVFTPINPITITATDNSGKVVTHTVTGLPQGLKFDASTNSIVGTPTQIGTNTITIESTDASGNKTTTKINYEVTRNSASDSTSTSIVNSVSTSISNSTSLSDSVKASQSLSTKESTSKSLSGSLSASTSNSTSIQASESVSTSKKLSESASTSMSDSASIKASESASTSKKLSESASTSTSDSASIKASESASTSKKLSESASTSTSDSASTQASESASTSKKLSESASTSMSDSASIKASESASTSKKLSESASTSTSDSASTQASESASTSKKLSESTSTSTSDSASTSTSESDSTSESTSLSDSTSASLSESTSTSTSDSASTSTSESDSNSTSTSLSESTSTSLSESTSTSTSDSASTSASVSDSNSASTSLRESTSTSLSDSTSTSTSDSASTSTSESDSDSASTSLSGSSSTSVSDSTSASTSESASTSTSISDSNSTSTSLSESTSTSLSESTSTSTSDSASTSMSVSDSNSASISLSESTSTSVSDSTSTSTSESASTSTSESDSNSASTSLSESTSTSVSDSTSTSTSDSASTSTSVSDSNSASTSLSESTSTSISDSTSTSTSDSASTSTSVSESSSTSTSISESLSTSDSDSKSMSTSESASTSTSVSDSESASTSISESTSTSLSDSTSTSTSDSTSASTSESDSNSTSTSMSESLSTSVSDSTSTSTSDSASTSTSVSDSNSASTSLSDSTSTSISDSTSASTSTSVSDSNSASTSLSESTSTSLSDSTSVSTSDSTSTSTSESDSNSTSTSLSESISTSLSDSTSTSTSDSASTSASESDSNSASTSLSDSTSTSISDSTSTSTSESASTSTSESESASTSKKLSESASTSTSESASTSTSTSTSDSASTSTSESDSNSASTSMSESLSTSVSDSTSMSTSESASTSTSESESNSESTSLSDSTSTSVSDSTRTSTSDSASTSMSVSYSNSASTSLSDSTSTSISDSTSTSTSDSASTSTSVSDSNSASTSLSESTSTSVSDSTSTSTSESASTSTSESESASTSKKLSESASTSMSDSASASTSESNSTSTSLSGSTSTSLSGSTSTSTSESASTSTSVSDSNSASTSLSESTSTSLSGSTSTSTSDSASESASESESTSTSVSDSTSASTSTSESESNSTSTSLSESTSTSLSDSTSTSTSDSASTSASESDSNSASTSLSGSLSTSVSDSTSASTSDSTSTSTSESESNSTSTSLSESTSTSLSDSTSTSTSDSASTSTSVSDSNSASTSLSESSSTSVSDSTSTSTSESASTSTSVSDSNSTSTSLSESTSTSLSNSTSTSTSESASTSTSVSDSNSASTSLSGSLSTNVSDSTSTSTSDSASTSTSESDSNSASTSLSGSLSTSISDSTSTSTSDSASTSTSESASTSTSVSESDSESTSMSVSDSNSTSTSLSDSTSTSVSDSTRTSTSDSASTSKSVSESNSASTSVSGSTSTSISDSSSTSTSMSTSETFTSQSPINSESQFIGDSLSEDTIVTQSKNTNMLNKTGKDYDLQEQRGYTDSEQHNETQSNQADNHSNNLDLLHQNRLQDKVVKQPTKGEDGVVSNGFIVAVAIVLAIFGLAKKSRKDDDDQDGSK

SEQ ID NO: 71357 - protein, 445 aa, Picrophilus torridus DSM 9790
MELKRSITLTGAIMINLGAIIGAGIFVIIGIAAYRAGPGVIISIVLSGIIAILTGLSFSEIARHVAKEGGAYEYAKDTLSPSAGFVAGWMWTSGNIIAIAAVATSFGSYFDVLFNINVNPFFIAVICILAFMTLNILGIKNSTKTITGLVILNVLVLLVFIFSGITRFNSNNYVNFMPHGISGIITGTALIFFAFTGFSRVTTVSDEVINPEKTIPLAIIVSIIISSILYILIAVVLIGLKPYYAYQGSTSPLSLAVSSLHNRYIDIIVSIGGVTSTAGVTLTGILGTSRVLFAMGRDKELPEKLSYIDRFSTPVFAIILSSILGIIFLIFVSFGTIVEASNSSVLISYIIINVAAGFLYLKLRKRETKRLAGRPFFIIIPALGIATILLIISHINIGSLEITGVILLICIIYYIIRRIALNIEGRRVPRHSDVRLFGKSRSRTN

SEQ ID NO: 71358 - protein, 67 aa, Vibrio sp. Ex25
MIVEQLGVDEAEVKNEASFVDDLGADSLDTVELVMALEEEFDTEIPDEEAEKITTVQAAIDYVNSAQ

SEQ ID NO: 71359 - protein, 223 aa, Xylella fastidiosa Temecula1
MSNCLIAPSILSADFARLGAEVDAVLAAGADWIHFDVMDNHYVPNLTFGPMVCKALRSYGITAPIDVHLMVEPVDRIVPDFAQAGASMISFHMEASRHVHRTIQLIKSHGCMAGLVFNPATPVDMLDWVLPELDLVLLMSVNPGFGGQRFIPGTLDKLRLVRKKIDLLGRPVRLQVDGGVGIDNIGAIAEAGADTFVAGSAIFHARDYADVVAQMRAAVAAVR

SEQ ID NO: 71360 - protein, 414 aa, Picrophilus torridus DSM 9790
MNGSFFTMDDFDLDGKRIYLRIDINSPVNPETGEILDDSRFRAYSKTINELKSSKVVIVSHQSRPGKNDFTSLMGHARYMSNIIKKEIKFIDSLFSHDAINAISNMSAGDIIMLENSRFYSEETLNADFETIKNTHIVRRLSPLFDYYVIDAFPAIHRAQTTLIGFKGSGPNIAGRLMEREITMLDKFKFFRGSPKIAILAGSKIEDSIKVSRAFLKDNIVDYILTGGVVANAFLYAGGFNIGRKNMEFIIKNNDNYESLINSATQLLQTFRGRILMPDDFLLSPSGRHVTISESINDDEIIADIGFNTVDKYSKIISRASAIFMNGPMGIYEIPEYSIGTREIFNIVAETPALKIAGGGHTLNALNSMHLTKKLDYTSTGGGALINYLSGDSIPVIDALIENKRLFGGKYNGR

SEQ ID NO: 71361 - protein, 322 aa, Acinetobacter sp. ADP1
MFTFRSDNMSNENQKPQTPTEQAQRSDTQSPFLNQPLPQGTPQGQQQSLQQDLTNSSTRAVPKYNLPRGAGKTGNVGETTHFGYQTVNADDKAQKVAEVFHSVASKYDIMNDLMSFGIHRLWKRFAINMSGVRRGQHVLDIAGGTGDLAKVFSREVGPQGHVVLSDINESMLNVGRDRLIDAGCTNVDFVLANAETLEPFADNSFDLVTISFGLRNVTDKDAALEAMYRVLKPGGRLLVLEFSKPVFEPFSKLYDFYSFTALPLMGKLVANDSESYKYLAESIRMHPDQRTLKGMMEQAGFQNCDYHNLTGGIVAVHRGFKL

SEQ ID NO: 71362 - protein, 400 aa, Oryza sativa Japonica Group
MAAATTSLLLEATPRLLSLPPRRPVQPRGGIFLLKPPPPPPFPSRRGVAVAVAPPLRASHPDTARRVSVSPAAVEPPPKPRALLDAIKRSLLDSLAALKKPALALLLAGALLAAAGPHHGAALAASGGRVGGSAFSSRSSSPPSSYGYTAPAPRGGYSAAPFYSPSPFVSVGPAVGIGFGGSSFFFVLMGFAAFLYLAGFLSDSSGGSVLTETDKTTVLKLQVGLLGMARSFQKELDQIAEKADTSTPAGLSYVLTETTLALLRHPDCCISAYSSVDVKRSIDDGEKRFNQLSIEERGKFDEETLVNVNSIKRQKAGSQRSSGFSNEYIVEKITILVAAEGVHKLPSINGSGDLKTALQKLGAIPSRKILAVEVLWTPQNENDTLSERELLEDYPLLRPL

SEQ ID NO: 71363 - protein, 631 aa, Vibrio sp. Ex25
MAIEINVPDIGADEVEVTEILVSVGDKVEEEQSLITVEGDKASMEVPASQAGIVKEIKVAEGDKVSTGSLIMIFEAEGAADAAPAPAAEAAPAAAPAPAAAAAELKEVHVPDIGGDEVEVTEIMVAVGDSIEEEQSLLTVEGDKASMEVPAPFAGTLKEIKVAAGDKVSTGSLIMVFETAGSGAPVAPAAAEAPATAAPAASAAKEVNVPDIGGDEVEVTEIMVAVGDTVEEEQSLITVEGDKASMEVPAPFAGTVKEIKIAAGDKVSTGSLIMVFEVAGAAPAPAAAPAQAAAPAAPAPKAEAPAAAAPAATGDFKENDEYAHASPVVRRLAREFGVNLSKVKGSGRKSRILKEDVQAYVKDALKRLESGAGAAASGKGDGAALGLLPWPKVDFSKFGETEVQPLSRIKKISGANLHRNWVMIPHVTQWDNADITALEAFRKEQNAIEAKKDTGMKITPLVFIMKAVAKALEAFPAFNSSLSEDGESLILKKYVNVGIAVDTPNGLVVPVFKDVNKKGIYELSEELMAVSKKARAGKLTAADMQGGCFTISSLGGIGGTAFTPIVNAPEVGILGVSKSEMKPVWNGKEFEPRLQLPLSLSYDHRVIDGAEGARFITYLNSCLSDIRRLVL

SEQ ID NO: 71364 - protein, 475 aa, Vibrio sp. Ex25
MSKEIKAQVVVLGSGPAGYSAAFRCADLGLETVLVERYSTLGGVCLNVGCIPSKALLHVSKVIEEAKAMADHGVVFGEPQTDISKIRIWKEKVVNQLTGGLSGMAKMRNVTVVNGYGKFTGPNSILVEGEGEPTVVNFDNAIVAAGSRPIKLPFIPHEDPRIWDSTDALELKEVPEKLLIMGGGIIGLEMGTVYHSLGSKVEVVEMFDQVIPAADKDIVKVFTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKEEGIKYEVATFPWAASGRAIASDCTDGMTKLIFDKETHRVIGGAIVGTNGGELLGEIGLAIEMGCDAEDIALTIHAHPTLHESVGLAAEVFEGSITDLPNKKAVKKK

SEQ ID NO: 71365 - protein, 506 aa, Arabidopsis thaliana
MADPLNGKSFFICFSLLFSFTLLFISPLYATESPVIEDVSTDVAVSVSETNREAVLLHNLEELVKNLTELVANLDAKLSATPLKEKNEISVDDDIGEEKERGRAKAFSVTKYSPFWSERFQFTSAVKLNSDATCINVLPFRDFEGSSKYFAIGDSKGRVYVFLRNGDVLIEFFTTVDSPVTAMVSYSSVFKNSSFVVTGHQNGAVLLHRIHEGSNGEDWNSNSVSMEHVGKFDVDDSADPVTLLEVHHVGRVRYILATDLSGKLTVLTENRTVYGSVIPSSRPLVFLKQRLLFLTESGAGSLDLRSMKIRETECEGLNHSLARTYVFDAAERSKAYGFTSEGEIIHVLLHGDIMNFKCRVRSKKKFQMEEPVALQSIKGYLLVINEEKVFAFNVSTQHYVRTAGPRLLFSAGLEEIRSAFLSHRESSSRTTTVVKTRPLIASDRENLLVIGLENGYFAVYKSKLPTLKGDFNNALEQSCVLLHTISIRGLAFLCQEERIAHCMGTR

SEQ ID NO: 71366 - protein, 476 aa, Photobacterium sp. SKA34
MSKEIKAQVVVLGSGPAGYSAAFRCADLGLDTVLIEKFNTLGGVCLNVGCIPSKALLHVAKVIEEAKAMAEHGIVFGEPQTDINKVRLWKDKVITQLTGGLGGMAKMRKVNVVNGYGKFTGPNSIVVEGADGPTTVNFDNAIIAAGSRPIELPFIPHEDPRIWDSTDALELKEVPEKLLVMGGGIIGLEMGTVYHALGSQIDVVEMFDQVIPAADKDIVKVFTKRIAKKFNLMLETKVTAVEAKEDGIYVTMEGKKAPAEPVRYDAVLVAIGRVPNGKLIDAEKAGINVDERGFINVDKQMRTNVAHIHAIGDVVGQPMLAHKGVHEGHVAAEVISGKKHYFDPKVIPSIAYTEPEVAWVGKTEKEAKAEGINYEVATFPWAASGRAIASDCADGMTKMIFDKDTHRVIGGAIVGTNGGELLGEIGLAIEMGCDAEDIALTIHAHPTLHESVGLAAEVFEGSITDLPNAKAVKRKK

SEQ ID NO: 71367 - protein, 631 aa, Photobacterium sp. SKA34
MAIEINVPDIGADEVEVTEILVSVGDKVEEEQSLITVEGDKASMEVPASQSGIVKEIKVAEGDTVSTGSLIMIFEAESAADAAPAPVAEAATAAPAPAAAAELKEVHVPDIGGDEVECTEIMVSVGDTVEEEQSLITVEGDKASMEVPAPFAGTVKEIKIVEGDKVSTGSLIMVFEVASSGSAPAAPVAQAAAPAPAAPAASAAKEVNVPDIGGDEVEVTEIMVSVGDTVEEEQSLITVEGDKASMEVPAPFSGTVKEIKIVEGDKVSTGSLIMVFEVAGAAPAAAPVAQAAAPAPTAAPAAAPAKAEASAATGDFVENNEYAHASPVVRRLAREFGVNLAKVKGTGRKNRVLKEDVQNFVKDALKRLESGAAASASGKGDGAALGLLPWPKIDFSKFGETEVKPLSRIKKISGANLHRNWVMIPHVTQWDNADITALEAFRKEQNAIEAKKDTGMKITPLVFIMKAAAKALEAFPSFNSSLSDDGESLILKKYVNIGIAVDTPNGLVVPVFKDVNKKGIYELSEELMAISKKARAGKLTASDMQGGCFTISSLGGLGGTAFTPIVNAPEVGILGVSKSEMKPVWNGKEFEPRLQLPLSLSYDHRVIDGAEGARFITYLNGCLSDIRRLVL

SEQ ID NO: 71368 - protein, 321 aa, Populus alba
YAYAQLTPTFYDGTCPNVSTIIRGVLVQALQTDPRIGASLTRLHFHDCFVDGCDGSILLDNTDTIESEKEAAPNNNSARGFDVVDNMKAAVENACPGIVSCADILAIAAEESVRLAGGPSWTVPLGRRDSLIANRSGANSSIPAPFESLAVLKSKFAAVGLNTSSDLVALSGAHTFGRAQCLNFISRLYNFSGSGNPDPTLNTTYLAALQQLCPQAGNRSVLTNLDRTTADTFDGNYFSNLQTNEGLLQSDQELFSTTGADTIAIVNNFSGNQTAFFESFVVSMIRMGNISPLTGTDGEIRLNCRIVNNSTGSNALLVSSI

SEQ ID NO: 71369 - protein, 129 aa, Vitis vinifera
MELNLAPKFAQKIFEGEGGTYYRWSSAEYELLKEAKVGGGRLVLQPRGFALPHYADSNRIGYVLQGSCGVVGIVPPKASQEVVLRLKKGDIIPVPSGAVSWWYNDGDSELIIVFLGETSKAYVPGEFTC

SEQ ID NO: 71370 - protein, 319 aa, Herbaspirillum huttiense
MLILGGGIIGLEMGTVYSTLGARLDVVEMMDGLMQGADRDLVKIWQKMNAKRFDNIMLKTKTVGAEATPEGIKVTFAPAEEGGTTPEPQVYDLVLQAVGRTPNGKKIAAEKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWTASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 71371 - protein, 473 aa, delta proteobacterium MLMS-1
MSEVNTGKVIQVVGPVVDVEFEPGKLPEIMNALLISNKGLSDEADNLVVEVAQHLGDNVVRCVSMDGTDGLVRGQEAKDTGKPIEIPCGQNALGRIMNVVGRSVDGMGKIESDKMRPIHKPAPLFTEQDTEVHVLETGIKVIDLLVPFPRGGKMGLFGGAGCGKTVIMMEMVNNIAMHHGGISVFCGVGERTREGNDLYHEMKESGVLPKAALVYGQMTEPPGARSRVALTGLSAAEYFRDEEGQDVLLFVDNIFRFTQAGQEVSALLGRIPSAVGYQPTLGTDLGGLQERITSTNKGSITAVQCVYVPADDLTDPAPATTFAHLDGTVVLSRQIAELGIYPAVDPLDSTSRILDPNVLGEDHYLVARGVQMTLQKYKDLQDIIAILGMDELSEEDQLTVSRARKMQRFLSQPFTVAETFTGMAGKYVKVEDTVRGFKEILEGKHDELPESAFYMVGSIDEAVEKAGKEKAEA

SEQ ID NO: 71372 - protein, 534 aa, Musa acuminata
MAIRNVATLQGHAPQCTSYAAARLMSSTAPLQSESTEERGFKGHDMLAPFTAGWQTTDLHPLVIDKSEGSYVYDINGKKYLDALAGLWCTALGGNEPRLVAAATAQLNKLPFYHSFWNRTTKPSLDLAKEILEIFTARKMGKVFFTNSGSEANDSQAKQEEIYSTFKIVSWININICQSFWFSLLVPFAVFQLYTRSLICQHHLFCTQIALTTGAFTFLEEFSTRLANNLENLILKEGPDTIAAFIAEPVMGAGGVIPPPKTYFEKVSLAVSLIQAVVKKYDILFIADEVITAFGRLGTMFGCDKYKIQPDLVSIAKALSSAYMPIGATLVSPEIVEVIHSQSNKLGSFSHGFTYSGHPVSCAVALEALKIYKEREIPSHVSAISPKFQEGIRTFSGSPIIGEIRGTGLILGTEFSDNKSPNDPFPTEWGVGAIFGSECEKRGMLIRVAGDNTMMSPPLVMTPDEVDEAFVVSVVAVGEHLRRRAEEHGGEGGRAEIQENTVGRANHLKCLEEGASSSSDWLLHHPSSIIRWSL

SEQ ID NO: 71373 - protein, 401 aa, Musa acuminata
MATKKSVGALTEADLKGKKVFVRVDLNVPLDENLKVTDDTRIRASVPTIKYLMERGARIILASHLGRPKGVTPKYSLKPVVPRLSELLGVNVAMANDCIGVEVEKLISALPDGGVLLLENVRFYKEEEKNDPEFAKKLASLADLYVNDAFGTAHRAHASTEGVTKYLKPSVAGFLMQKELDYLVGAVSNPKKPFAAIVGGSKVSTKIGVMESLLEKVDILILGGGMIFTFYKAQGYSVGSSLVEEDKLNLATSLLEKAKSKGVSLLLPTDVVVADKFAADAESKIVPASGIPDGWMGLDIGPDSIKSFSGTLESTKTIIWNGPMGVFEYEKFAVGTEAIAKKLADLSGSGVTTIIGGGDSVAAVEKVGLAAKMSHISTGGGASLELLEGKTLPGVLALEDA

SEQ ID NO: 71374 - protein, 224 aa, Brassica napus
  misc_feature (207)..(207): Xaa can be any naturally occurring amino acid
MELEDEKKGGEASGQTSDKEMGLSRKNSDSSLSPTEDDDEDEEKKPQLGPMIALKEQLEKDKDDESLRRWKEQLIGVVDLEDVGETPDPVVKILDLTVRSPNREDMVLTIPDDGLPNPKGPWFTIKEGSKYTLVFNFRVTNNIVSGLRYNNTVWKTGVKVDSTKAMLGTFSPQAEPYQHVMPEEITPSGIFARGSYSARTKFIDDDXKCYLEINYTFDIRKNWQ

SEQ ID NO: 71375 - protein, 59 aa, Taraxacum officinale
KVRKLQYIAELEKNVQALQAEGSEVSAEVEFLNQQSIILGMENKALKQRLESLAQEQLI

SEQ ID NO: 71376 - protein, 201 aa, Synechococcus elongatus PCC 6301
MRLMTEGALRVGQLAPDFEATAVVDQEFQTIKLSNYRGKYVVLFFYPLDFTFVCPTEITAFSDRYADFSALNTEILGVSVDSQFSHLAWIQTSRKEGGLGDLAYPLVADLKKEISTAYNVLDPAEGIALRGLFIIDKEGVIQHATINNLAFGRSVDETLRVLQAIQYVQSHPDEVCPANWQPGAATMNPDPVKSKEFFAAV

SEQ ID NO: 71377 - protein, 364 aa, Glycine max
MIKTNSSQDWPEPIIRVQSLSERCTDSIPERYIKPLSERPSDDVVAVDDDDDVNIPIIDLAGLYGGDPDARASTLKQISEACNEWGFFQIVNHGVSPELMDMARETWRQFFHMPLEVKQHYANSPKTYEGYGSRLGIEKGAILDWSDYYYLHYLPLSLKDHNKWPTQPPSCREVCDEYGREVVKLCGRLMKVLSINLGLEEDVLEKAFGGEDVGACLRVNFYPKCPRPELTLGLSSHSDPGGMTLLLSDDQVPGLQVRKGNNWITVKPLPHAFIVNIGDRLEVLSNANYKSVEHRVLVNSNKERVSLAFFYNPKSDIPIEPVKELVKPDKPALYTPMTFDEYRLFIRLRGPCGKSHVESLKSPR

SEQ ID NO: 71378 - protein, 671 aa, Hypocrea jecorina
MARADQPQDKTKTEQRIGAYTVVRTLGEGSFGKVRLAIHNGTGQKVALKIITRKKLISRDMAGRVEREIEYLQLLRHPHIIKLYTVIKTPSEIIMVLEYAGGELFDYIVQNGRMKEAEARRFFQQMICAVEYCHRHKIVHRDLKPENLLLDENLNVKIADFGLSNIMTDGNFLKTSCGSPNYAAPEVIGGKLYAGSEVDVWSCGVILYVLLVGRLPFDDEHIPSLFAKIARGTYSMPQWMPPGAAALIKGMLVVNPVQRMTIDEIRADPWFNTDLPAYLQPPVEEFFNTGVDPNKAIKKSDIAPNAPEKVQEKLHNEVTEKISKTMGYGKDDVEEALQSDEPSAIKDAYMIVRENKLMLANNPDAGLTGDEGSPMMSISSTRSAISPGGASPRPYVTKIGILPSSLPAYHKDYMEREKNGTGHDPVTPAITINDELPVTRTEVEKEEAARRLNPHSRSALRLDESSKRPQGMTPITAPVKKPKPVRWQFGIRSRNAPWEALLCIHKALNKLGASHLRDEGYDEAQRRGVEDATSRDSSFANGAPLERDPNGHDKDPTKRYKLPADPWHIQVRWPSTSMQAGADRRDELGSKAGSPDSFVYTRGDAASRKDFVALHMDIQIYEMEQGVYLVDFKCSGYETQDGRLLEEKEVTSPFPFLDRAAKLIMQLAEAD

SEQ ID NO: 71379 - protein, 776 aa, Picrophilus torridus DSM 9790
MSEKSKKPVLWLNEVDKNDVSIAGGKAAGLGELMNIPDVHVPEGFVITAYAYKLFLDRNDIEKKINEIIEMLDVDDTRALQRASSEIKSLFVNSKMPDDLFDSIIEHYEDLVQREGAAYVAVRSSANLEDMANASFAGEQETYLNVKGNDQVIEKVKECFASLYSTRAIYYRKKENINERASLSVIIQKQIFSDVSGVMFTLDVSNGDRSKIVIESSYGLGEYIVSGQVTPDTFYVDKNTMKIVKSTVVSKSKMLKALEGGGTMEVSVPETLCEEPSLTDDEVIELAMAGKSIENHYNHPMDIEWAKYQGKLYIVQARFETVWSNREPEEPEKKDYENEVILKGLPASPGFITGRAHVILDVSNIDHFKNDEILITRMTAPDWVPVMKKSRAIITDDGGMTCHAAIVSRELGVPCIVGTSSFGKKATETIKTGDLITVDSRNGLVYRGKVGSETENEVSVEIPEIITGTKVMVNMGEPSIAERIAKLPCDGIGLMREEFIWAEIGEHPLSLLKNNRGDYFVDKLSEYMAQVCRAFNPRPVILRFSDFKTDEYSNLKGGSEFEPVEDNPLLGWRGASRYYDERYREAFKLELMAVRKAREEYRARNLWVMVPFTRTVEEMERIIRIMEDNGLYRGKDFKVFLMAEIPSNILLADKFNKYVDGYSIGSNDLTMLLLGSDRNNGKMSSMFDERDLAVKRAIKYLIKIAHKDKKIVSICGQAPSQYDELVDFLVRAGIDDISVNPDAVIHVKKLVASVEARIKLEAALGHVEIDDDWDLP

SEQ ID NO: 71380 - protein, 270 aa, Anaplasma phagocytophilum HZ
MLKNVVTHLRDKFAATPLVGVELEFYIHGHENGLAKFLQHISPKLCQLRFDLLKEICEHQFELRTYHTTDVKQLLTDIARAKDLMFEIAKSYDCTLDFSAKPFLDKAGNAFHIHVNLLDRNSQNMFFMDRSGNNLSETLTYSLGGLCTFMKEHMILFAPNESSYMRYTYNDIHTPTTISWGGNNRSTALRIPDTTLSPQNCRIEHRVPGADCDYDSAVTAILYDIVRGMEKKILPPKKTFGVASDAQYGLEKLPYSLDRAKLLFSPIALE

SEQ ID NO: 71381 - protein, 241 aa, Brassica napus
MSVQEYLDKHTLSRKIEDAVNAAVRAKTSDPVLFIANHMKKAVASVITKVKARQILDSRGIPTVEVDLHTNKGVFRASVPSGDSSGTYEAIELRDGDKGMYLGNSVAKAVKNINERISEALIGMDPKLQAQIDHAMIDLDKTEKKNELGANAILAVSIAACKAGAAEKEVPLCKHLSDLSGRANMTLPVPAFTVLSGGNHASNHLAIQEIMILPVGASRFEEALQWGSETYHHLKAGVTEK

SEQ ID NO: 71382 - protein, 570 aa, Vibrio sp. Ex25
MTFYFLKLNAGKSAVFGSRFEDINFKGDVFGGVTTAIISLPLALAFGVASGAGAEAGLWGAIMVGLFASLFGGSNTLISEPTGPMTVIMTAVLTSMMAKYPETGMAMTFTVVMMAGAFQILLGTLKLGKYVTLMPYSVISGFMSGIGVILIILQLSPLMGHAAPSGGVLGTLSALPDTISNLKFSELFLGLLTLGILFFFPKQYRKYVPAQLVALVAVTLLSVMLFDTEDIRRIGEIPAGLPSLVAPHIDPDMFVEMVIDALVLGTLGCIDTLLTAVIGDSLTRKEHDSDKELRGQGLANMISGLFGALPGAGATMGTVTNIQVGARSPLSGVIRALMLALVVLVAGGLTEPIPMAVLAGIAVYVGFNILDWSFIQRAHKVSFSGMAVMYGVMLLTVFVDLIVAVGLGVFISNIIIIERLSREQARQVKAISDADEDDVPLTDSERGLLDRANGKVLFFYLSGPMIFSVSKAISRQHSSISDYDVMILDLTDVPMIDVTVGLALENAIKDALDANCAVYLLCPNERTREQLEKFHVIDLVPNDNMYQFRYEALNAAVAHVEADQYQRITA

SEQ ID NO: 71383 - protein, 130 aa, Anaplasma phagocytophilum HZ
MSYSDAVLNRCKAPQNVGSLPKDDISVGTGLVGAPSCGDVMKLQIRVDENGKIVDAKFKTFGCGAAIAASELATERIMGKTIDEASLLKNTVLAKELSLPPVKIHCSILAEDAVKAAINDYRKKQEAVGN

SEQ ID NO: 71384 - protein, 123 aa, Zea mays
MAGRLTAAGSRILGGGGARAAASALRHRAGMGLPVGRHIVPDKPLPVNDELVWDNGTPFPEPCIDRLAPHIGKYEALAWLCGGLGFFAALGMAAVVNDKASNIPYTPKVYPYDNLRAELGDRP

SEQ ID NO: 71385 - protein, 369 aa, Picrophilus torridus DSM 9790
MHKDEIRARFIGLDRINHLAACSKSPMLKTVKNDLEDYINDVINLGNPWDLWTDKVNYARRLFAKIINADPGDVAVLYSVSSALNAIMSSFNFKNNNIVTSDLEFPTTNFILQAYKKYGIKIKTIKNDNGIIKSSNYDEYIDENTIMVTAVHVSSLNGFKQDIDEISKMAHEHGSYIYVDDYQSLGSLKIDVKKSKIDFLASGTLKWLLGVSGIAFLYVNPEIVNDLRPANIGWFSQKYPFQFGSESINYAHGAGRFENGTWSIPSVYAAIGGMECILDYNDIEGENKRLFSYTLDELDKNNIKTLTPEQSANIVAIPLKNPQEAESILKRRYNIITSARSNSLRISPHFYNTFEEIEAAVKIIKNEFL

SEQ ID NO: 71386 - protein, 488 aa, Ralstonia metallidurans CH34
MRRQRKAKIVATLGPASTDIAVIRQLFDAGADVFRLNFSHGTHEDHRARYDAVRQVEAETGRPIAILADLQGPKLRIGTFAAGKVAVSAGDTFVLDSDPTPGDAKRVYLPHPELFKAANAGQSLLIDDGKVRLNIESVASGSITTRVANNGTLSDRKGVNVPDAVIPIPALTEKDRKDLAFALELGADWIALSFVQRPSDILEARELIGTRAGVLSKIEKPAALQQLEEIVRVSDAVMVARGDLGVELPPERVPGVQKRILRICRQLGKPIVIATQMLESMIDSPVPTRAEASDVASAIYDGADAVMLSAESANGRHPVAAVSIMNRIITEVENDPLYRNMIDAQHEAPLSTRQDAICAALREVTQIIGAKATVTYTSSGATALRAARERPCAPIVSITPNLEIARRLAITWGVHSTVSPDVQSVDEMVEAAARAALVEGYAAPGDQITIAAGMPFGQGGTTNLLRVAEVGTEVAGLDIGKVPAAEAV

SEQ ID NO: 71387 - protein, 200 aa, Prochlorococcus marinus str. MIT 9303
MPIGTPSVPYRLPGSQMERWVDIYTRLGVERILFLGQEVSDGVANSLVAQMLYLDSEDSTKPIYLYINSPGGSVTAGLAIYDTMKYVKSDVVTICVGLAASMGAFLLTAGTKGKRLALPHSRIMIHQPLGGTNQRQASDIEIEAREILRIKDMLNHSMAELTGQTFEKIEKDTDRDYFLSAAEAKDYGLIDRVIAHPNEA

SEQ ID NO: 71388 - protein, 329 aa, Populus alba
PPPSTSFFSVAIVLLGMMLPQSKAQLSATFYANTCPNVSSIVSNVVQQAFLSDSRIGASLIRLHFHDCFVDGCDASILLDNSSSILSEKLAAPNVNSIRGFGVVDSIKTALESSCPGVVTCADILALAAESSVSQSGGPSWSVLLGRGDSLTANQAGANTSIPSPFEGLSNITAKFSAVGLNTNDLVALLGAHTFGRAQCRTFSNRLYNFSNTGSPDPTLNTTYLTTLQQICPQNGSGTALANLDPTTSDTFDNNYFTNLQNNQGLLQSDQELFSTSGAATVTLVNNFSSNQTAFFQSFVQSIINMGNISPLTGSSGEIRSDCKKVNGS

SEQ ID NO: 71389 - protein, 637 aa, Yarrowia lipolytica CLIB122
MNCPTRDPDPKGVPGFNQQPPQFDNELNNNKSFNKNNSGAESGKKLSAKGLANAMGDSDLAGGQNTRSASRPSRRSRPGHQNRGLSESSLGIQLRRSTSSLNNMSDNSSNSDDSNESTPLTASGSADPNKKPLSTWGNMMRILSKYGKFVGPGIMVSVAYMDPGNYSTAVSAGAMYQYKLLFIIFVSNLFAVFLQVLCVKLGSVTGLDLAENCRQHLPPWLSVSIYVMAEIAIIATDLAEVVGTAISLNILFGLPLFMGVLVTVVDVLIVLMAYRPNGPMRIVRYFEYGVAGLVAVVVVCFAFELAALDNLDIPLVLEGFLPSKELLETNGLYLSCGILGATVMPHSLYLGSGLVQPRLREYDEDNGYAIPEDARFGDDDEDLKYKPSIHAIKYAMKYSIAELVISLFTVAIFINSAILIVAGSTLNGSPDAYDADLFSIYDMLRTILSPAAGTVFALALLASGQSAGIVCTLSGQMVSEGFLRWSFKPWIRRLITRSIAIVPCLFVTLFVGRKGLADVLNASQVVLSLLLPMVSAPLIYFTGSKKIMKVAANAAVVHTRPRSNSNGTLTPADRSSNGYGMVEDEASTDDESICIPEYVDMSNSATTQFIAYLVFGMVSALNLFLIISIAMGADVPL

SEQ ID NO: 71390 - protein, 328 aa, Escherichia coli O157:H7 EDL933
  misc_feature (121)..(121): Xaa can be any naturally occurring amino acid
MGQLIDGVWHDTWYDTKSTGGKFQRSASAFRNWLTADGAPGPTGTGGFIAEKDRYHLYVSLACPWAHRTLIMRKLKGLEPFISVSVVNPLMLENGWTFDDSFPGATGDTLYQHEFLYQLYXHADPHYSGRVTVPVLWDKKNHTIVSNESAEIIRMFNTAFDALGAKAGDYYPPALQTKIDELNGWIYDTVNNGVYKAGFATSQQAYDEAVEKVFESLARLEQILGQHRYLTGNQLTEADIRLWTTLVRFDPVYVTHFKCDKHRISDYLNLYGFLRDIYQMPGIAETVNFDHIRNHYFRSHKTINPTRIISIGPWQDLDEPHGRDVRLG

SEQ ID NO: 71391 - protein, 808 aa, Arabidopsis thaliana
MTSIIGAALPYKSPEKAIASSSYSAENDSSPVDAVIFAGTSLVLGTACRYLFNGTRVPYTVVLLVIGIFLGSLGLICLLIKLYSSVSISWKILEKYGTKHNLGKLGHGIRIWNGINPDLLLAVFLPVLLFESSFSMDVHQIKRCMGQMVLLAGPGVLISTFCLGALIKLTFPYNWDWKTSLLLGGLLGATDPVAVVALLKELGASKKMTTLIDGESLMNDGVSVVVFQLFFKMVMGHNSDWGSIIKFLVQNSFGAVGIGLAFGIASVFWLKFIFNDTVAQITVTLSASYFAYYTAQEWAGVSGILTVMILGMFFAAFARTAFKGDSHQSLHHFWEMAAYIANTLVFMLSGVIIAESVLSGQTISYKGVSSQFIILRPDFFFILFLEDVKGGNSWSFLFLLYLYVQLSRCVVVGVLYPLLCRSGYGLDWKESIILTWSGLRAVLQFLFLTGGIVFLTLVVNGSTTQLLLHLLRMDTLTATKKRILEYTKFEMMKTALKAFENLGDDEELGSADWPTVIRHISSLKDLEGRQVNPHDGYEAGSLDPTNIMDIRIRFLNGISQCVVNSSHCQTSVVPKVAIDSRLLPVSGVQAAYWEMLDDGRITQCTANVLMQSVDEALDLVSTSSLSDWRGLEPRVHFPNYYKFLQSKIIPHKLVTHLIVERLESACYISSAFLRAHRIARQQLHIFLGNSNIASTVINESEVEGEEAKQFLEDVRDSFPQVLSVLKTRQVTHYVLNHLNGYIKNLEKVGLLEGKEVSHLHDVVQSDLKKLLRHPPSLKLPNVDDLITSNPLLKDRSSFRSLAIGETDA

SEQ ID NO: 71392 - protein, 247 aa, Brassica napus
  misc_feature (207)..(207): Xaa can be any naturally occurring amino acid
MAEEEMVADEAVTAPPRKVLLISAGASHSVALLTGDVVCSWGRGEDGQLGHGDAEDRPSPTQLSALDDHQIVSVTCGADHTVAYSQSRMEVYSWGWGDFGRLGHGNSSDLFTPLPIKALHGVRIKQIACGDSHCLAVTMEGEVQSWGRNQNGQLGLGDTEDSLVPQKIQAFEGIRIKMVAAGAEHTAAVTEDGDLYGWGWGRYGNLXGLGDRNDRLVPERVTSAGAEKMSMVACGWRHTISVSYPGA

SEQ ID NO: 71393 - protein, 464 aa, Desulfitobacterium hafniense Y51
MRCCMLTVEKIGGTSMSQFEDVLKNIIGEPDSQRFSFGRVFVVSAYAGVTNKLLEDKKTKAPGIYRHFVNGEDCEEALNVLLQDLLKVNERFVNIGLDYEAAKEFLGSRIQQTKSYLHSMHEIIASGYVDRENIFSAARELLASLGEAHSAFNSVNILQNRGIPARLVDLTGLRDSSQLTIDERIAKAFRGVDPFKEIVIVTGYTKGKEGIMRQFERGYSEITFSRIATHLHAEEAIIHKEFHLSSADPKIVGVEKAIPVGRTNYDVADQLADIGMEAIHPNASKPLEMAGINLRLKNTFEPDHPGTLISKDYIGPVAKIEIIAGSDKVVVVEIHDSLMVGEAGYDKQIMEMFMNYSVSYIMKATNANSISLVIWEHDLNEALMAELKGAYQTVTILPAAIVCVIGSNIAVPNILARATSSLAKNHINVNCVSQSLRQVNMQFVIDRDKYTSAIYHLNEDLCVG

SEQ ID NO: 71394 - protein, 383 aa, Zea mays
GRPGRVLCPFWISNLIFTGGRDSVVRMWKMEEGLLIDTSRALGGTIRAIAADSRLLVSGGTNAYIQCWRAVEGNGQLFHISGSGTDQNAEFRLWGHEGPVTCLALDSLRIYSGSWDMTVRVWDRDQMECVQKFMHADWVWDLALRGNTVASTAGRDAYVWDIRAGELTSLISNAHVGSAYSIAWTHLPDVLFTGGEDGAIRLFNVSDVCDDEGDIKPVATWVPHSGPVHSLAFEYPWLVSASSDGRIALIDLRKLLSSKSSSKGLRVKRVDGSAIEPPQRMLHGVGCDLFSIAIGADRIVCAGEDGSVRVWNFSEALEIERRAQALRSLRQENRIRRRKSQAEMNTNTRRPDQCSIAMKKNQLKGDKSATWHNKRAINEKAKS

SEQ ID NO: 71395 - protein, 612 aa, Vitis vinifera
MNEEEASLFDMLWLLLASVIFVPIFQKIPGGSPVLGYLAAGILIGPYGLSIIRHVHGTKAIAEFGVVFLLFNIGLELSVERLSSMKKYVFGLGTAQVLVTAVVVGLVTHFISGQPGPAAIVIGNGLALSSTAVVLQVLQERGESTSRHGRATFSVLLFQDLAVVVLLILIPLISPNSSKGGIGFQAIAEALGLAAVKALVAIAAIIAGGRLLLRPIYKQIAENQNAEIFSANTLLVILGTSLLTARAGLSMALGAFLAGLLLAETEFSLQVESDIAPYRGLLLGLFFMTVGMSIDPKLLISNFPVIMGTLGLLIGGKALLVALVGKLFGISIISAIRVGLLLAPGGEFAFVAFGEAVNQGIMSPQLSSLLFLVVGISMALTPWLAAGGQLIASRFEQHDVRSLLPVESETDDLQDHIIICGFGRVGQIIAQLLSERLIPFVALDVRSDRVAMGRALDLPVYFGDAGSREVLHKVGAERACAAAITLDTPGANYRTVWALSKYFPNVKTFVRAHDVDHGLNLEKAGATAVVPETLEPSLQLAAAVLAQAKLPTSEIAATINEFRSRHLSELTELCEASGSSLGYGFSRIASKSKPQPPDSSDENQITEGTLAV

SEQ ID NO: 71396 - protein, 310 aa, Mycobacterium sp. MCS
MTGALDPQIADLIEGLDRGFPPVQTMTGAQARATIRSRFIAPAEPEPVAAVEDRSVGEIPIRIYHPAGAGPLPVLVYAHGGGFVFCDLDSHDGLCRDIANQTAAIVVSVGYRLAPEHPWPAAAEDVYAVTRWVADNCTALGADPGRIAVGGDSAGGNLAAVTALIARDRGGPSLVAQLLVYPMVTPDFTTESYRLFGSGYYNPAEALRWYWDQYVPNDFDRTHPYVSPLHADLSGLPPAVVVIAGHDPLRDEGVRFGEALSAAGVPTVVRRFDGGIHGFMTMPSLELAQTARAQLCQDAVALLTGVPAGG

SEQ ID NO: 71397 - protein, 360 aa, Streptococcus thermophilus LMG 18311
MRKNIVFFCFVRKNIKGDRMMKKQKIAVLGPGSWGTALAQVLNDNGHEVRIWGNIPEQIDEINEKHTNTRYFKDVILDENIKAYKELSEALDSVNAILFVVPTKVTRLVAKQVAELLDHKVVVMHASKGLEPGTHERLSTILEEEIPSEMRSEIVVVSGPSHAEETIVRDITLITAASKDLETARYVQGIFSNSYFRLYTNSDVIGVETAGALKNIIAVGAGALHGMGYGDNAKAAVITRGLAEITRLGVKLGADPLTYSGLSGVGDLIVTGTSIHSRNWRAGDALGRGEKLEDIERNMGMVIEGISTTKVAYEIAQELGVYMPITTAIYKSIYEGADIKESILNMMSNELRSENEWDKK

SEQ ID NO: 71398 - protein, 500 aa, Moritella sp. PE36
MNKNIDIAVIGLGVMGANMALNLAERGFSVAAFDINESRRTDIIKRHQPLTAAKLIAVADLAELINQLEVPRRIVLSVPAGPVVDIICNDLIAAGLEANDIVVDTGNSQWRDSIARADTYAGKFSFFTCAISGGEVGARFGPSLMPSGDKAAWERLKPMWQAMSAKVDPETGVEIARTHVDQPLPEGEPCAEYIGPIGSGHFVKMVHNGIEYADMQMIAEVVQFMRQILGMSAVEVGEVFSEWNKGKLQSYLIEITGNILKVVDEATGKPMVDVIMDQAGQKGTGNWTAREALELGVPANAIAESVFARCLSTQKSIRQVGATKLAGPTVTIEDRNVWLEKLADALYCSKICSYAQGFELMSAAQKEHNWTLDYVAIAKIWRAGCVIRAHFLDDIAKAYQAEPELLNLMLADRFTNTLAESQMAWREVLAKAIMQGMPMPSISAAMSYYDCYREADSSASLIQAMRDYFGGHTYRRKDQDASQSFHYDWHFGTGEHKAQH

SEQ ID NO: 71399 - protein, 346 aa, Mycobacterium sp. MCS
MIADVDSPSEPRTVRLTVTDVIEESHDARSLVFAVADGARFDYRPGQFLTLRVPGEQGGAVARCYSLASSPHTDAAPKVTIKRVDGGYGSNWLCDNVVAGQVIEALPPSGVFTPGDLDRDLVLWAGGSGITPVMSILKSALAVGSGRVVLVYANRDERSVIFAAELRDLTARHPDRLTVVHWLESVQGLPRQDQIATLARRFTGGEAYLCGPAPFMAAVQAALAEAGVPRDAVHTEVFRSLTGDPFAEVAPVPVDGDAADLQVELDGGKHSLRWPRQATLVDAMIAAGLDVPYSCREGQCGSCAATLLRGRVDMPDTEILEPEDIEAGTILGCQARPASDEIHIEF

SEQ ID NO: 71400 - protein, 121 aa, Staphylococcus epidermidis ATCC 12228
MNDIIFLNGMRFYGYHGVLAAENDIGQIFVVDITLKVDLSYAGQSDDVKDTVNYGEVYKDVKSIVEGPRSCLIEHLAERIAKHINSHYNRVMETKVRITKENPPIPGHYDGVGIEIVREND

SEQ ID NO: 71401 - protein, 310 aa, Staphylococcus epidermidis ATCC 12228
MAQKPVDYVTQIIGNTPVVKLRNVVDDDAADIYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEIHELTTGPELVEQFEGRQIDAFLAGVGTGGTLSGVGKVLKKEYPNVEIVAIEPEASPVLSGGEPGPHKLQGLGAGFVPDTLNTEVYDSIIKVGNDTAMDMARRVAREEGILAGISSGAAIYAAIQKAKELGKGKTVVTVLPSNGERYLSTPLYSFDN

SEQ ID NO: 71402 - protein, 440 aa, Synechococcus elongatus PCC 6301
MGVERDMDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDADGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 71403 - protein, 325 aa, Nostoc punctiforme PCC 73102
MSNSRVLCLGEILFDCLADQLGLKLEEVKSWTPYPGGAPANVACALVKLGTTAGFIGAVGEDEPGNALVKLLQDVGVDTTGVQRHPTAPTRQVYVTRDLAGDRTFAGFGQYDTAEFADTRLQAKQLPDALFQEADFLVLGTLELAYPESEQAIYRALELAEHYDLKIVLDINWRPVFWDEPKIAHQKIPELFKRVDFLKLSKEEAEWLFETADPGAITYRLASIEGVLVTDGENGCTYCLGENEGKLPSFSIPVVDTTGAGDSFLAGFIHQLSHYGIHSLRDAETAKRIVTYASAVGALTTIKPGAIASQPTDAEVEAFLASHQL

SEQ ID NO: 71404 - protein, 181 aa, Zea mays
  misc_feature (153)..(153): Xaa can be any naturally occurring amino acid
MGKSEPECVNSSNPAHECNDYCLNKIAEAKRRLLEEQPDSWKGPPEDRTVHPDCINASNPYHDCSEYCFKKIADTNAAAERGELEKPAGGSGKSGVTPEQADGDDDSERQEDAAAAEDGYPQMTGKQKKLFELQLKMNEARKANQQAMVAEKXRMEPRGESRGVSKEKWLEDRKRRLGSCL

SEQ ID NO: 71405 - protein, 1398 aa, Bacillus clausii KSM-K16
MEVFPIQKKLMLAGSSASIVALVASALPLQSAYASSITVKETHYNSSFDAVVDRQMGLSARPQTDKNGRWENASRSDVAYYMNANNFKQGTSSYLQFLNLSSSAGLSAGTINSQLLSDKGILQGQGQAFINASKLYGVNEIYLISHALLETGNGKSQLATGVQVNGKTVYNMYGIGAYDGNAVSAGAQYAYNQGWFTPEDAIIGGARFVSSNYFARGQNTLYKMRWNPANPGTYQYATDVGWAVKQTHHMSNLYSLVDDYEMTFDVPVYKNQPTGDAGNDKLEQLPTGTFGTTTARLNVRTGPGTSHSIVTTLDKDTKVELLAKQGNWYQIAVDNTTGFVSGDYLKLDKPSEDNVEDSDQELISYGETTARLNLRSQPNTSSNVLTTLALGQKLEILKKEGNWYRVRAGHQSGWVSADYVKISSNGVDKESPSLGSATTTARLNLRSGAGTNHSIITTLTKGQKVELLKKQGGWYQVKAGNRTGWVSADYLNVNGSGNVDNAPSSGSATTTARLNLRSGAGTNHSIITTLTKGQKVELLKKQGGWYQVKAGNRTGWVSADYLNVNGSGNVDNAPSSGSATTTARLNLRSGAGTNHSIITTLAKGQKVELLKKQGGWYQVKAGNRTGWVSVDYLNVSGSGNVDNTPSSGSATTTARLNLRSGAGTNHSIITTLAKGQKVELLKKQGGWYQVKAGNRTGWVSVDYLNVSGSGNVDNAPSNGSATTTARLNLRSGAGTNHSIITTLAKGQKVELLKKQGGWYQVKAGNRTGWVSVDYLNVSGSGNVDNAPSNGSATTTARLNLRSGAGTNHSIITTLAKGQKVELLKKQGGWYQVKAGNRTGWVSVDYLNVSGSGNVDNAPSNGSATTTARLNLRSGAGTNHSIITTLAKGQKVELLKKQGGWYQVKAGNRTGWVSADYLNVSNNQAKTESVETVIDRGTTTARLNLRVDPNTSSKIITTLNNGQQLDILKKQGSWYYVKVGSQTGWVSSQYVKLTEAKPTVQVMARTFSFAPIAPEVETNEEANESVNEENDVADLENSPSEKQQPIDEVEKEEDKQDVSPDKERDTDEHAEEPSIDENDTVPHSDEANDQTVEEDDHVADENEQASETTDTENDAENEESNLPASEEAPSEENDSTDESSLEEPQEPETDPSTDEQEPETDASADEQEPETDANTDEQEPETDASTDEQEPETDASADEQEPKTDASTDEQEPETDASTDEQEPETDASADEQEPETDANTDEQEPETDASADEQDLAEQVAEEEHGDADGTSEDQESPVSDTAENNEADENSEPVQEEETDVADDEAEALPEEAEGPSEQDEEPSEATEEQQTTVGQKIQLTENTLLFSEASSDSEQLLELFEDDTIEILEEGTDFVKVKANGVEGWIAVEALAAVLP

SEQ ID NO: 71406 - protein, 543 aa, Candida albicans SC5314
MIYELRDFIPFIEFILNQDNKILDTPIYGELWIIGPLIQKSSNLRFTSTKDFLDYIIQFNIISGYSLEFSKDLNNNIDIKHLPKLISINFKGVLMLQSRLKGKQTFSQISNSKNHKLPTNLLQILEMSSKRDILPYTSTNSSLSSDLSFDVEFLQELINKPTARTILNKQKASLKTPEKPFHSICSDHNHINLLATVGLNKKEYSHFGSKQTIPVDVIHQRILKCRNILSNDVYKCVQERIHFLPIINNHTDLNLGDCSYLDTCHKLKSCRYLHYYTLTPMKKELSHSSKEEQQQRQIKLKGLEYTIGDCFSESFREPLPPQWINCDVRCLPFSILGKFAAIISDPAWDIHMSLPYGTCKDDELLSLPMHELQDEGIIMLWVTGRSIEIGRRALLKWGYQIYDEMIWIKLNQLRRTIVTGRTGHWLNHSKEHLLVGLKGNPIWINKRIDTDVVVSPTRETSRKPDEFYDIVERLVGTHSRKLEIFGRDHNTRPGWLTIGNQLQGVSLFEPELKYKYELYKQTTTGTTATTSISMSTSGSGGKY

SEQ ID NO: 71407 - protein, 294 aa, Bacillus clausii KSM-K16
MKPIKKAIIPAAGLGTRFLPATKAMPKEMLPIVDKPTIQYIVEEAIESGIEDIIIVTGKGKRAIEDHFDHAFELEENLAKKEKFELLEAVQQAGKVDIHYIRQKEPKGLGHAVWCARKFIGNEPFAVLLGDDIVQHEKPCLKQLIEQYEEKQASIIGVQQVPREETNRYGIIDPANQEGRLYGVSRFVEKPKVEEAPSNLAILGRYLLTPEIFAHLEKQETGAGGEIQLTDAIQKLNEEQQVYAYDFEGKRYDVGEKLGFVLTTLEFAIQREELKPALIKKMKEYLELENMLKQ

SEQ ID NO: 71408 - protein, 313 aa, Triticum aestivum
MAATAAASSSSPAGGASSPAHAPGGGGGGGGGGGGVPYHRSRFGDTTLTKVFVGGLAWETPSAGLHDHFREYGEILEAVVITDRETGRSKGYGFVTFRDPEAAQQAVQNPNPMIAGRRANCNIASMGPPRPSPQRGRAPRGPDQQHSGPQPYMGGRMHHQQQMPTPPHAMFYTPSPYGYWYPPDYQYQQAFYNQMQQYYSQQYGQTSPSTSPYPYMGYMTSGQNPRAGFSPLQHQAARPPFFQQQTEGSFQAAPSLPPNFRLQLPPRAISRQSDDVSGSQPTQTVSEAEATNTDNQEASAPVERSNSEENTSN

SEQ ID NO: 71409 - protein, 614 aa, Acinetobacter sp. ADP1
MSLLLQITIFLGAALLLVPLGKHLGIATVLGYLFTGILLGPSILNIASDANAILHMADFGVILLMFLIGLELQPQRLWQLRHSIFVMGSLQVVLTGIVLIAVIILLFKLDIASGFVLGFALALSSTAFVLQLLAEKQQLSTTYGQQSFSILLFQDIAAIPLLAMIPLLTGTSSTHHGIAYFAAIIATFTGLFLFSRYIMRPFFRFVAKSGATELITAVGLFIVLGVVMLMDLLGISTTLGAFLTGVLLADSEFRHELEASIAPFKGLLLGLFFMTVGMTTQVSLLLDMPWLIIGGALGLILIKGIVLTAISRYFKYSWQNSLLLAACLAQGGEFAFVILKVAQKEGVLAQAMTDPVILIVTVSMVMTPICYWLIQKQILPLFSKEHPPEYDAIPQHEHPMIIAGFGRFGQIIARNARLNHIGFTAIDNNLQQIDFVRRYGGTLYYGDITQPDILRAAGIEKAKVFILAIDDVEDSMNVARHIRLNYPQITLMVRARDRYQVHLLRDLGVEHIWRETYLSSLGMAYRALCELGIPEQQAYDNIELFRDYDEKLLTQQQNIYNDEQKVFETHRNALAELEHLFESDERHQTKRNSEVNLKRGLENHRIDVTRDDPL

SEQ ID NO: 71410 - protein, 312 aa, Yarrowia lipolytica CLIB122
MPSVVKSSDASVAVALHPLPLLNISNFYTRAVATSTEFAGALLGTQDGRQVSIDTSFEFKIEDGVIDKELVTRRLAQFQQVMPELHFVGWFYVSKDHTSPTDEVTHLQKQLMEFDEAPLVLLIQPGSDSQQLPLHVYEPIIDSGETKYREATVVIETGEAERVAVEDLVRETSQHAASERVRQHLVSQHAAVKIFNGRVKTVLDYVKGVNEGSIVPDQRLLRSLRSILSQLSASSNSELKDSLQESQALTAAFLATVFQGTQLTASLKAQGLLMDRPAKKSLRRRRGEARDFMPQRAKKWDGDTDDDFEILV

SEQ ID NO: 71411 - protein, 516 aa, Magnaporthe grisea 70-15
MDTHSYTSPETFSEIHKTLNATFASGKTKSIEWRKWQLKQLWWLVHDNEQLIIEALAQDLGRHEMESRAADLSGLKSDILEHIKHVEEWAATEPVKGAGVLFGTLGGAHIRKEPLGVALIIGAWNFPVILALQPVIAAIAAGCCAIIKPSELAGASERVIVELANRYLDGSAIRVVKGGPKETAEFLEYRFDQIFFTGSTKIAKFVAAAAAKHLTPTVLELGGQCPAVVTKTADVDLAAKRIAYVKFLNAGQICLSVNHVFVDPAVHDQFVDSLKRWTVEFGASGQMCNIINERNYDRLSGMLEKTQGKVLCGEKGSRETKKLPGTVVDQVTMSDSLLSEELFGPICPVITATPNEAIAAINSNDQKEIDHVLSNTISGGVTINDALMHAAVPNAPFGGVGDSGMGYYHGRHGFEVFTHKRTVLALPRWLEGVMSFRYPTYDVKHAGKMAVKNKLGFQRGETMADQRVGGFKAGAALRRAFVWAAVIGAGLYWIDDIRSAKLAVLGFVRRLVGGEL

SEQ ID NO: 71412 - protein, 317 aa, Chlamydomonas reinhardtii
GYNQSAEFFLSNYRLGKTLGIGSFGKVKVAEHVLTGHKVAIKILNRRKIQQMEMEEKVRREIKILRLFMHPHIIRLYEVIETPSDIYVVMEYVKVRRGWGVWEGGGRVCAYGGGYCHRNMVVHRDLKPENLLLDAKMNVKIADFGLSNIMRDGHFLKTSCGSPNYAAPEVISGKLYAGPEVDVWSCGVILYALLCGSLPFDDENIPNLFKKIKGGIYNLPSHLSPGARDLIPRMLLVDPLKRITIPEIRQHPWFNMHLPRYLAVMQAEPVVGVPRIDEEILEEVVRLGFDRDGLLDSLRSRAANKATVTYYLMTDNR

SEQ ID NO: 71413 - protein, 289 aa, Brassica napus
  misc_feature (220)..(220): Xaa can be any naturally occurring amino acid
MCVLSLLLCLVLPCLLFFFFFVKTRSNSGGSGRATLPPGPPKLPVVGNIFQVGYSPHRSLTALSKIYGPIMGLKLGSLTTIVISSPEAAKEALKTQDHHLSSRTFNDPVRVFDHHEYSFAWGPPSARWRFLRKITTMHLLSTQRLNAMEPLRMKKVEELMSFINKCCEREEAVDIARAFFVTALNIISNALFSTDFATHDSKSSHEYHNTVISLMYVTGXPNVGDYFPFLRFLDLQGTRKEATLCTQRLFNVFQEFIIARMAKRSSQTERKDVSSFDMLDTLLDLTQEN

SEQ ID NO: 71414 - protein, 275 aa, Glycine max
  misc_feature (36)..(36): Xaa can be any naturally occurring amino acid
QTRNVIGDRGLEVLGRCCKRLKRLRIERGDDDQGMXEDEEGTVSHRGLIALSQGCSELEYMAVYVSDITNASLEHIGTHLKNLCDFRLVLLDHEEKITDLPLDNGVRALLRGCDKLKRFALYLRRGGLTDVAPGYIGQYSPNVRWMLLGYVGETDAGLLEFSKGCPSLQKLEMRGCSFFSEYALAIAATQLNSLRYLWVQGYSASASGRDLLAMARPYWNIELIPSRSVVVSNQQEDPVVVEHLAHILAYYSLAGPRTDFPDTVIPLDPGTYVDT

SEQ ID NO: 71415 - protein, 751 aa, Candida albicans SC5314
MASTISSKPQLKVLGIDVESIRVLLKVIIFISIAGAAISSRLFSVIRFESIIHEFDPWFNFRATKYLVTHSFYEFLNWFDDRTWYPLGRVTGGTLYPGLMVTSGAIWHILRDWFALPVDIRNICVLLAPVFSGLTAICTYFLTKEMKDSSAGLLAAIFMGIAPGYISRSVAGSYDNEAIAITLLMATFYFWIKSMKMGSVFYATLTALFYFYMVSAWGGYVFITNLIPLHVFVLIFMGRYNAKLYTAYTTWYALGTLASMQIPFVGFLPIRSNDHMAALGVFGLLQLVAFGDYVKSKVPTKQFKSFLIVSIVLVVGLGIGGLFGLTAMGWIAPWTGRFYSLWDTNYAKIHIPIIASVSEHQPTAWPAFFFDTSMLIWLFPAGIYLCFQELKDEHVFIIIYSVLCSYFAGVMVRLMLTLTPVICVAAAIALSKLFDVYLDIVDLFTEKVGKYDDDVSDESKSSTKKSSSRFPIAGYLSKVLVLSTFTFYLFYFVLHCTWVTSNAYSSPSVVLASRNPDGSQHIIDDYREAYYWLRMNTPEDAKVMAWWDYGYQIGGMADRTTLVDNNTWNNTHIATVGKAMSSPEDVSYEILRQHDVDYVLVIFGGLLGYSGDDINKFLWMVRIAEGIWPDEIKERDYFTDRGEYKVDKDASSAMKNSLMYKLSYHRFTELFGGRDGVDRVRNQQIPANEVPKLNVVEEAFTSENWIVRIYKVKDLDNVGRDLHQATAFEESSSGTSKRNRSIKRPKLEVRE

SEQ ID NO: 71416 - protein, 417 aa, Clostridium acetobutylicum ATCC 824
MRKINIFKGKHNPQRTAIDFFKYVGPGLLVTVGFIDPGNWASNVSAGSDYGYSLLWIVTLSTIMLIILQHNAAHLGIVTGDCLSEAVSKKFKPWLTNIILYSAIGAAISTAMAELLGGAIALNMLFRLPIKIGTLIMLSLVIWMLFSSSYKKLERWIIGFVSIIGLSFIFELLLVKVNWQVAAVSFVSPSFPKNSMPIIMSVLGAVVMPHNLFLHSEIIQSRQWNVEKEDVIKRQLRYEFLDTIISMIVGFAINSAMVLLAASTFFKMHVSVSELSQAQALLKPLLGGSASVVFALALLFSGIASTVTAGMAGGSIFAGIYKEPYDIEDSHTQIGVIITMVLAAVIIFFIKDPFKGLIYSQMILSIQLPITIFTQIYLTSSKKVMGKFSNSLLDRVLLGIIAVIVTALNIALLVSYF

SEQ ID NO: 71417 - protein, 159 aa, Zea mays
FRFIRAPTSCYNLRGGGSEAARREVQDDEQQQWRHDDEAALTEFLSSLMDYTPTIPDELVEHYLGRSGFHCPDLRLTRLVAVATQKFLSDIASDSLQHCKARVAAPIKDNKSKQPKDRRLVLTMDDLSKALREHGVNLKHAEYFADSPSAGMAPSTREE

SEQ ID NO: 71418 - protein, 165 aa, Prunus persica
WAFGGMIFVLVYCTAGISGGHINPAVTFGLFLARKVSLPRAVLYIVAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDRW

SEQ ID NO: 71419 - protein, 256 aa, Hordeum vulgare subsp. vulgare
  misc_feature (2)..(2): Xaa can be any naturally occurring amino acid
  misc_feature (7)..(7): Xaa can be any naturally occurring amino acid
PXTLPVXMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLSIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 71420 - protein, 165 aa, Prunus persica
WAFGGMIFVLVYCTAGISGGHINPAVTFGLFLARKVSLARAILYMVAQSLGAICGVGLVKAFQNAYFTKYGGGANGLADGYSQGTGLAAEIIGTFVLVYTVFSATDPKRNARDSHVPVLAPLPIGFAVFIVHLATIPITGTGINPARSLGAAVIYNNDKAWDDHW

SEQ ID NO: 71421 - protein, 520 aa, Phlebia radiata
MHTFLRSTALVVAGLSARALASIGPVTDFHIVNAAVSPDGFSRQAVLAEGVFPGPLIAGNKGDNFQINVIDELTNATMLKTTTIHWHGFFQHGTNWADGPAFINQCPIASGDSFLYNFQVPDQAGTFWYHSHLSTQYCDGLRGPFVVYDPADPYLDQYDVDDDSTVITLADWYHTAARLGSPFPAADTTLINGLGRCGEAGCPVSDLAVISVTKGKRYRFRLVSISCDSFFTFSIDGHSLNVIEVDATNHQPLTVDELTIYAGQRYSFILTADQDVDNYWIRANPGIGITTGFAGGINSAILRYDGADVVEPTTTQATSPVVLSESNLAPLTNAAAPGLPEVGGVDLALNFNLTFDGPSLKFQINGVTFVPPTVPVLLQILSGAQSAADLLPSGSVYALPSNATIELSLPAGALGGPHPFHLHGHTFSVVRPAGSTTYNYVNPVQRDVVSIGNTGDNVTIRFDTNNPGPWFLHCHIDWHLEAGFAVVFAEDIPDVASINPVPQDWSNLCPIYNALDASDH

SEQ ID NO: 71422 - protein, 494 aa, Bacillus thuringiensis serovar konkukian str. 97-27
MESMTFVLFGATGDLAKRKIYPALYNLYRDQKLPKQISVIGLGRREVSHVDFQKRIKESIETFSRHREEGTPELEDFLDNFRYCPLDVSKPEDYERLLQVVREREEELHIKGNRMFYLSVAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMEALRKVKKEDVQNHIIRGQYGAGEINGGQVVAYKEEPGVNPSSNIDTFVAARLWIDNPFWTGVPFYIRTGKRMKEKSTRIVIEFKNTLKQQYQDSNPNAAPNLLIIEISPGENVSLQLNSKNPLKNGEIEPIRINFTCEQADVGVPEAYERLIHDAVSGDATFFAHWREVELSWEWVQPILEAFEENLLPLHEYESGSHGPEASNELLQESGFKWWLDQETKK

SEQ ID NO: 71423 - protein, 510 aa, Francisella tularensis subsp. tularensis SCHU S4
MKKEYDIIIIGGGATGFGCAIEAVSRGYKTLLLEASDFGKGTSSKSTKLIHGGLRYLENFDFALVKEGLEERFSFLHNAPHLTHKQSYLIPTRSYFETIKYTIGVKLYEFLSGKYKIGKSYNLNKHQTLAELPNIEASKLKKSLVYYDGQFDDTRLLISLMKTFEAKGGVALNYHKVEKIFSSTDSKLDTVKVVDTLSGEQKEFTAKHIINATGTFSDKTISLANQQDAHKYVSVAQGTHIVFDREKFPTEHAILIPETEDGRVLFILPWHDHLIVGTTDIKKEVPSLEPRADKSEIDFILETFNQYAKDKATIVDIKSVYCGQRPLVTPKKAKNSAKISRKHEIVESKDGLITVVGGKWTIFRRMGQDTLDYIETKKIAQKISKTSDQLLIDAIELKDTYPLKVYGKNAEDIKTIQNELDNFELLARGLPYYQAEVVYHVRHEKAKTIEDVLARRTRAAFLDIKASIDAAPKVAELMAKELGKDEVWQNQQIDSFIEFSKNFNVEELYK

SEQ ID NO: 71424 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLLALPIDKIDPTHSYVKDIDDLSKHTLDKIKHFFETYKDLEPNKWVKVKKFEN

SEQ ID NO: 71425 - protein, 100 aa, Zea mays
ILRPGGTRDHDERRRRCQATAVVPVQSTGKMVNAIKGLFISCDVPMAQFIVNLNASMPPSERFIVHMLDPTNMFVQPHVAHMIRSKIGEFRDQNSYEKPQ

SEQ ID NO: 71426 - protein, 400 aa, Clostridium perfringens str. 13
MIGVIGVKRNVDIAIREKLALYPKKHKKYVGELLNSFKEVVILNTCNRTEIYFNCTEEISEDEIFDKIFNVFNWNDDLKKYMFLSKEKRAVTHLMEVICGFHSRILGEDQILGQIKDAYKTAISDNSISSELQKMFEIAIACGKKFKTECKMFEVPVSSVSISINSALLKGCRKFMVLGYGEIGKLAIKHLLSHKVECIYLIVRDKSKASDLEGEIVEVLDFNEKNQVINEVDCIVSCTAAPHTVVRNEDIKTEGDIIHIYDLAVPRDVDKELSEKERVILKDIDEISKIDDKNKKIRKERMEEYKHIVEESIEEFLNWLKIREVSSKIRNIKIRENEICSERIKTFSNKGNGENAKLAERMIKSTADAYVNRAIELLKSEALKGSDSSCAEIIEKIFLT

SEQ ID NO: 71427 - protein, 149 aa, Methanosarcina mazei
MEQTYVMVKPDGVQRGLVGEVISRIEKRGLKIVALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIANYSRVDEVCLYE

SEQ ID NO: 71428 - protein, 332 aa, Musa acuminata
MAKSAEEQLCEAAVEGDCAKIDDLLSAGADPTYFDASGMTPLMYAARHGHADSARRLLSAGAPWNALSPSNISAGDLAMEHAHQEAFDVLLNAGIQAELVLGTIARVAERNGEKEGGGLNYLEDRVSFSEDKLMDSESKAVMMEWERPLMEAHARAVCGGGGKVLNVGFGMGLVDEAIQRYGPVEHTIVEAHPEVYERMLRSGWGKKENVKIVFGRWQDVLPQLESYDGIFFDTYGEYYEDLRQFHQHLPRLLKPGGVYSYFNGLCGDNAFFHVVYCQLVALELGNLGYSTQFIPLPVKDCLTEEVWEGVKRKYWQLDTYYLPVCQPLSDSE

SEQ ID NO: 71429 - protein, 757 aa, Musa acuminata
MEPLRSSSLMLLLLVICCSSTAAVAAAKKRTYIVHMAKSQMPPAFAEHRHWYDASLRSVSDTAEILYAYDTVAHGFSARLTPAEARAMERRPGVLGVMAEARYELHTTRTPEFLGLDRTEGFIPQSNTTSDVVVGVLDTGVWPERKSYDDAGLGPVPASWKGACEEGKDFKAANACNRKLVGARFFSQGYEARMGPINLTRESRSPRDNDGHGTHTSSTVAGSAVPDVDFLGYAAGTARGMSTRARIAVYKVCWLGGCFGSDILAAMDKAIEDGCGVLSLSLGGGMSDYYRDNIAVGAFSAMAMGVVVSCSAGNAGPGASTLSNVAPWITTVGAGTLDRDFPANVLLSNGKNYTGVSLYSGKPLPSSPLPFIYAGNATNTTNGNLCMTGTLLPDKVAGKIVLCDRGINARVQKGSVVRDAGGAGMILANTAANGEELVADAHLLPATAVGEIAGDAIKSYLFSDPNPTATIAFRGTKVGVKPSPVVAAFSSRGPSAITPDILKPDLIAPGVNILAAWTGSVGPTGQAADPRRTEFNIISGTSMSCPHVSGLLALLKGAHPDWSPGAIKSALMTTAYAAYPGDGGILDVATGRAATPFDFGAGHVDPPKALDPGLVYDLTTEDYLDFLCALNYTPLQIARLSRLTNYTCDRQKAYEVSDLNYPSFAVAFATASTTVKHTRTLTNVGAPGTYKATVSAPEGVKVVVEPTALTFSALGEKKNYTVTFSTASQPSGSTAFGRLEWSDAQHVVASPLAFSWT

SEQ ID NO: 71430 - protein, 297 aa, Brucella melitensis 16M
MSSIRKIRKAVFPVAGLGTRFLPATKSIPKEMLTVVDKPVIQYVVDEAREAGIEHLIFVTGRNKAVIEDYFDAQVELYSTLAERGKTEELNRLQDLQPQPGTTSFTRQQVPLGLGHAVWCARELVGNEPFALLLPDMVMQSKKGCLAEMVELYEQTGGNIIAVQECDPEEAHKYGIVGKGGAVGNGFEITRMVEKPAKGTAPSNLYINGRYILQPEIFGLLSKQEKGAGNEIQLTDAMLKLADQQKFYGFDYRGLTFDCGSKAGFIEANVAFALWREDIRPSVEGSIGHLLKTIQPA

SEQ ID NO: 71431 - protein, 195 aa, Lactobacillus johnsonii NCC 533
MEYPQLDLENVKGPKAVIKTNHGDIKVQLFEKDAPMTVENFVRLAKKGYYDNTTFHRVISDFMIQGGDPKGDGTGGESIWGHPFEDEFSNKLFNLRGALSMANSGPNTNGSQFFIVQNKNVPKRMIKEMDAAGYPKEIVKAYKQGGTPWLDGRHTVFGQVIDGMDVVDEIAKVPRDKANDKPKEDVIIKNIQIED

SEQ ID NO: 71432 - protein, 101 aa, Taraxacum officinale
SETNEFVGERVAYALSQGLKVIACVGETLEQREAGTTMEVVAARTKAIADKISSWDNVVLAYEPVWAIGTGKVASPAQAQEVHAGLRKWFCDNVSAEVSAS

SEQ ID NO: 71433 - protein, 465 aa, Chromobacterium violaceum ATCC 12472
MSQGKIVQIIGAVIDVEFPRDAMPKVYDALKLVDADLTLEVQQQLGDGVVRTIAMGSSDGLKRGMAVANTGAPISVPVGAATLGRIMDVLGNPVDEAGPVATDARRAIHQAAPKFDELSAAADILETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEHFRDEKDENGKGRDVLLFVDNIYRYTLAGTEVSALLGRMPSAVGYQPTLAEEMGRLQERITSTKDGSITSIQAVYVPADDLTDPSPATTFAHLDATVVLSRDIASLGIYPAVDPLDSTSRQLDPLVVGDEHYTVARGVQSTLQRYKELRDIIAILGMDELSEEDKLVVARARKIQRFLSQPFHVAEVFTGSPGKYVPLRETIKGFKAILAGEYDHLPEQAFYMVGAIEEAAEKAKTLN

SEQ ID NO: 71434 - protein, 172 aa, Phaseolus vulgaris
MPNPKVFFDMTIGGQPAGRIVFELYADVTPRTAENFRALCTGEKGVGRSGKPVHFKGSIFHRVIPNFMCQGGDFTAGNGTGGESIYGAKFADENFVKKHTGPGILSMANAGPGTNGSQFFICTTKTEWLDGKHVVFGQVVEGLDVVKDIEKVGSGSGKTARPVAIADCGQLS

SEQ ID NO: 71435 - protein, 539 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGGGATQLIMPLVYDVIRKCGATPFTAWRLAYFVPGIMHIAVGILVLTAGQDLPDGNLRSLRKQQQQQQQGDGGDASCCRRDSFSRVLWHAVANYRTWVFVFVYGYSMGVQLTTNNIIAEFYYDQFELDIRVAGIIAACFGMANLVSRPLGGVLSDLGARYWGMRARLWNIWILQTAGGAFCFWLGRASELPASVTAMVLFSFCAQAACGATFGVIPFVSRRSLGVISGLTGAGGNVGAGLTQLLFFTTSSYSTRKGIENMGIMAMACTLPLVLVHFPQWGSMLLPPSADADEERYYASEWSEDEKSVGRHSASLKFAENSRSERGKRNAVAVLATAAATPEHVV

SEQ ID NO: 71436 - protein, 159 aa, Prunus dulcis
PGRCKVNNGGCWHDARDGHAFSACTDNGEVQCQCPHGFKGDGVKSCEDVDECKEKKACQCPECTCKNTWGSYDCSCSGNLLYIKDHDTCISKAASGGKSAWAAVWVILIGLAMAGGGAYLVYKYRLRSYMDSEIRAIMAQYMPLDSQAEVPNHVNDERA

SEQ ID NO: 71437 - protein, 125 aa, Francisella tularensis subsp. tularensis SCHU S4
MAITKEDILNAVAEMSVMDVCDLVKMMEDKFGVSAAAAVAVAAGPVAGPAEAAEEKTEFDVVLVDAGSNKIAAIKAVRGATGLGLKEAKDAVEGTPFTVKEAASKEEAEVLKKQLEEAGAKVELK

SEQ ID NO: 71438 - protein, 187 aa, Acinetobacter sp. ADP1
MSLINTEIKPFQATAYQNGQFIDISEADLKGKWSVVFFYPADFTFVCPTELEDLADQYAEFQKLGVDIYSVSTDTHFTHKAWHDTSDAIGKIQYAMIGDPTWTISKNFEVLIEAEGLADRGTFVIDPEGKIQIVEINAGGIGRDAQELLRKVKAAVYVYNHPGEVCPAKWKEGDATLAPSIDLVGKI

SEQ ID NO: 71439 - protein, 303 aa, Rhodopseudomonas palustris CGA009
MSVALRYLDSAADDAIRLAARLGVPSYLITQHRFPDGEIAVNVGPKAEITILYLPLDQPNDKLVTILFAAEALRREGCNRLVLLAPYLCYMRQDVAFHPGDAISQKAMGRLLAGLVDRVITVDPHLHRTPRLGDVFPGITADELSAMPAIAAALRGTLAPDTVVVGPDSESQQWVDALAKLIGTRSAVAQKIRHGDRSVEIAFGDASAIAGRPALLVDDIVSSGGTLIACTRALLGAGATSVDAVITHALFPPAMLRDFAAAGIRSIRSTHTVPHPTNAITLDDLFVEALRDEIGTTFKETRA

SEQ ID NO: 71440 - protein, 403 aa, Mesorhizobium loti MAFF303099
MEEFHKVRRLPPYVFEQVNRLKASARSRGADIIDLGMGNPDLPTPKAIVDKLCEVVRDPRTHRYSSSRGIPGLRRAQAAYYQRRFGVKLNPDTQVVATLGSKEGFANMAQAITAPGDVILCPNPTYPIHAFGFIMSGGVIRSLQVEPDDGFIPALERGVRHSIPKPLALILNYPSNPTALVASLDFYKDVVAFAKKNDIIILSDLAYSEIYFDGNPPPSVLQVPGAIDVCVEFTSMSKTFSMPGWRMGFAVGNERLISALTRVKSYLDYGAFTPIQVAAAHALNGDEIAEVREVYHKRRDVMVDSFGRAGWNIPAPAASMFAWAPIPEPFKHLGSLEFSKLLIEHADVAVAPGVGFGEHGDDFVRLALVENEHRIRQAARNIKRFLSTSAKQPNNVVPLSAHR

SEQ ID NO: 71441 - protein, 242 aa, Arabidopsis thaliana
MPPGAKKRKALKKKQQEQEATGVATNNKGFNGHGHDEHGSQDERDSDGNLSSPGSQGNEEFGTRDPSPPPLSSLGKDIVKEKAEDADFTGGQVAKGEDVIEVGRGRTDHEENGVNKQLNSCPENFTQTSREADSTSSLEISPALDSVKPMGSSVSKVVMSDKSKQVESSTDSDSLQQKSDEKEEILSPRSAEETNKEIKNVKEYEVPECSKEKSLLPSGPPVFRTSWLSCCGLFDVMAGSER

SEQ ID NO: 71442 - protein, 625 aa, Arabidopsis thaliana
MKNKTNLGLSVFFFFICLVSVTSDLEADRRALIALRDGVHGRPLLWNLTAPPCTWGGVQCESGRVTALRLPGVGLSGPLPIAIGNLTKLETLSFRFNALNGPLPPDFANLTLLRYLYLQGNAFSGEIPSFLFTLPNIIRINLAQNNFLGRIPDNVNSATRLATLYLQDNQLTGPIPEIKIKLQQFNVSSNQLNGSIPDPLSGMPKTAFLGNLLCGKPLDACPVNGTGNGTVTPGGKGKSDKLSAGAIVGIVIGCFVLLLVLFLIVFCLCRKKKKEQVVQSRSIEAAPVPTSSAAVAKESNGPPAVVANGASENGVSKNPAAVSKDLTFFVKSFGEFDLDGLLKASAEVLGKGTFGSSYKASFDHGLVVAVKRLRDVVVPEKEFREKLQVLGSISHANLVTLIAYYFSRDEKLVVFEYMSRGSLSALLHGNKGSGRSPLNWETRANIALGAARAISYLHSRDATTSHGNIKSSNILLSESFEAKVSDYCLAPMISPTSTPNRIDGYRAPEVTDARKISQKADVYSFGVLILELLTGKSPTHQQLHEEGVDLPRWVSSITEQQSPSDVFDPELTRYQSDSNENMIRLLNIGISCTTQYPDSRPTMPEVTRLIEEVSRSPASPGPLSD

SEQ ID NO: 71443 - protein, 630 aa, Moritella sp. PE36
MKHALHSANLPRRKFVKGLVAGGVIVGLYPLLQPARAGSLNTPPNKAPVLSGTEFDLVVAESQVNFTGKIRLATTINGSIPAPTLHMREGDTVTIRVTNHLKEHTSIHWHGIILPYQMDGVPGISFAGIAPGETFTYQFKVEQSGTYWYHSHSGMQEMTGMYGAIVIEPAAEDSIQADREHVILLSDWTDENPAQVFAKLKTQGDYYNFNQPTVFDFFQDASENGLQAAVQSRQMWNRMRMSPSDLADLSAQTLTYLMNGTTPAGNWTGLFKPGERVRLRFINGASNSFYDVRIPGLALTVVQADGINVEPVTVDEFRFGPGETYDVIVEPSADTYTLFAQSMDRTGYARGTLTTQAGLNTDVPTLDKPESLTMTDMMGAMGSTGNVGAMGNMEQMNGMEHGSMSGMDHSSMPGMQHSGMVDMGKMTGMDHSSMPGMMTNMDHSAMSNMTSKLATASEQVRHAKTEYGPSVDMRVDMPRTNLDDPGVGLRNNGRRVLTLADLKTLGGPMDPRTAEREIELHLTGNMERYTWSLDGLEFGSSTPIHFNYGERVRIILHNDTMMTHPMHLHGMWSEVENPDGSFQVRRHTIPVQPAQRISFLVTVDARGRWAWHCHLMFHMDAGMFREVVVS

SEQ ID NO: 71444 - protein, 441 aa, Zea mays
MQWFGHFAVTGESTHRKGAKALSQFAFVNRDRCWEELEWKGKHGQSPAVVATKPHYFRDLDVLETVENFLEYVPDFWSSDELANSIKDGEILQIDEEYFVDQFLYLMYEENSKDAWHVVEDFLMDEQFSSLCQHLLIHLDEERLLGFLNSLGKLINPTMQCKELTFPCCWLEVLLSGHYDHISLDDLVFLNCVIAKGRQLWRLMNDEEQHEEWGQMEELLKGGNHLTDADHFALMKELVETELPGVLKWVGIQSWIIFCELSKECKSGDSCESFFSHNKIEFHKADDYSLVRNYGFSISHMPDIDVEDLTRSSHKRRKRNRRKRHRYESDEDKFDELLELGSSDGKNGVESQRGSWRLSTDGFSASWDIMHSGIAERCMRSRTTLFSWDAEGIEYGPGISLKPIWTLELVVENSGDARKYESLLTLPVILRKRWLLKQLKK

SEQ ID NO: 71445 - protein, 373 aa, Pseudomonas putida KT2440
MAFNTIEELLEDYRQGKMVLLVDDEDRENEGDLLIAAERCDAQAINFMAREARGLICLTLTDDHCQRLGLEQMVPANGSVFSTAFTVSIEAATGVTTGISAADRARTVAAAMAPNARPEDLVQPGHIFPLRAREGGVLTRAGHTEAGCDLARLAGFSPASVIVEVLNDDGTMARRPDLEVFAARHGIKIGTIADLIHYRLSTEQTVKRIGERELPTVHGTFRLVTYEDRIEGGVHMAMVMGDIRREQPTLVRVHVIDPLRDLVGAEYAGPANWTLWAALQKVAEEGTGVVVILANHESSQALLERVPQLTHPVRPYQRGQSKVYSEVGTGAQILQDLGVGKLRHLGPPLKYAGLAGYELEVVQSIPFDPGMDG

SEQ ID NO: 71446 - protein, 72 aa, Taraxacum officinale
EDLSSQLQTQAAQQFRMPDMGSVMGKTDISPAAAQADEEEEEEVDETGVEIRDIDLVMTQAGVSRPKAVKAL

SEQ ID NO: 71447 - protein, 422 aa, Acidovorax sp. JS42
MALIVHKYGGTSMGSTERIRNVAKRVAKWARAGHQMVVVPSAMSGETNRLLGLAKELTPSRITSAYHRELDMLAATGEQASSALLAIALQAEGMESVSYAGWQVPVRTDSSYTKARIESIDDKRVRADLDAGKVVIVTGFQGIDEGGNITTLGRGGSDTSAVAIAAAMKAHECLIYTDVDGVYTTDPRVVPEARRLTTLSFEEMLEMASLGSKVLQIRSVEFAGKYKVPLRVLSSFTSWDIDINEEAKSGTLITFEEDEQMEKAVVSGIAFTRDEAKISVIGVPDTPGIAYQILGAVADANIDVDVIIQNMGKEGKTDFSFTVNRNDYQRTIDLLKDKVLPQLGAEEIVGDAKIAKVSIVGIGMRSHVGVASKMFRALSEEGINIKMISTSEIKTSVVIDEKYVELAVRTLHKAFELDQAAA

SEQ ID NO: 71448 - protein, 351 aa, Lactobacillus johnsonii NCC 533
MKRYLILEDGTAFSGHGFGAPITATGELGIQTSNFGYQEAISDPANFGKILAFTTPMIGGSGINAIDYESIDPSVRGIIANDIAFHISANPTFQDLNDFLKEKRIPAIYGVDTRALVQKLKNKRVIKASIMDTDDAHAFDQIKALVLPKNKTAQISTTHPYAAPNIGKTVAVIDLGLKHSLLRSLSLREINSVVLPYNASIYDIINLRADAIVISNGPSGVEEVAPFLKPVFDKFYGKLPILGIGLGFLAISNYLDLELLDLIPAYNGSNFPVIEQTNNRIWQTAMNIDQLVVPDSLSLNLSRKYFDLRSELLAGYSIKKDKVLATAFNPEGSPGNFDAASIYDQFLNMME

SEQ ID NO: 71449 - protein, 164 aa, Glycine max
  misc_feature (84)..(84): Xaa can be any naturally occurring amino acid
  misc_feature (115)..(115): Xaa can be any naturally occurring amino acid
  misc_feature (147)..(147): Xaa can be any naturally occurring amino acid
MSAAVCSTTPHLEEELKNKATYNKKKNNVGGESDQPPYNDGANSDVAEETEPEEDDDSKLESNKDLDLGPQFTLKEQLEKDRNXKDPEVKILSLIITSPDEPDLTLPIPCTTDAXKRSFMLKEGSKWQMKCTLTVCTNIGSGLKYTXVGWKTGVRVDSRKKMLG

SEQ ID NO: 71450 - protein, 272 aa, Triticum aestivum
MAAAEPSGSSQPGAPGRWSLHGKTALVTGGTRGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLCQLAHPLLKASGLGSIVFISSVCGLVAVFSGTLYAMTKGAINQLTKNLACEWAKDGIRTNSVAPWYITTSLTEGLLANKEFEASVVSRTPLGRVGEPGEVSSLVAFLCMPGSTYITGQTISVDGGMTVNGLYPA

SEQ ID NO: 71451 - protein, 323 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANDEDMPGESMDHTSFIRQWSDYTI

SEQ ID NO: 71452 - protein, 469 aa, Burkholderia xenovorans LB400
MSKQAIGVVGLAVMGRNLALNIESRGHAVSVFNRSREKTDELIAEYPDRKLVPAFTLEEFVESLEKPRRILLMVKAGEGTDATINQLKPLLDKGDILIDGGNTHFTDTIRRNQDLAKSGLHFIGTGVSGGEEGALKGPSIMPGGQRDAYDLVAPILTEIAAKAPDGEPCVAYMGPDGAGHFVKMVHNGIEYGDMQLIAESYAVLKQVVGLSNEELGKVYTEWNQGELDSYLIEITSKIFSKKDEETGKDLVDVILDRAAQKGTGKWTSQNALDLGAPLPLITEAVFARVLSSLKTQRVAASKVLEGPAARPLGAEREAFIESVRRALYFSKVISYAQGFAQLRAASEEYKWDLDYGTIAKIFRAGCIIRARFLQKITDAYTKDKAIANLLLDPYFRDIAKNYQSALREVVIAAINAGVPVPAFASAIAYFDAYRSERLPANLVQAQRDFFGAHTFERIDKPGSFHANWS

SEQ ID NO: 71453 - protein, 216 aa, Zea mays
GVLEERGMPAGLLETVNVDKKVLVDRVRQALYASKICSYAQGMNLLRAKSVEKGWNLNLAELARIWKGGCIIRARFLDRIKRGYDRNPELANLIVAREFAREMVQRQTAWRWVVARAVEAGISPPGMTVSLSYFDTYRSSGWPANLIQAQRDLFGPHPYERIDCPGSFPPEWTKRGGGGNGAPIWGIGWYEKGCFLLWGIFFWGLFFVLLWLSLCF

SEQ ID NO: 71454 - protein, 287 aa, Hordeum vulgare subsp. vulgare
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSPNGVFEGPVVMDSEMFRLDLFPEMDLGSYYMSLAEALLMDPPPTATIIHAYEDNGDGGADVRLWSYSVDM

SEQ ID NO: 71455 - protein, 480 aa, Bifidobacterium longum DJO10A
MRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADVIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMIYTDKVLKDAGKVADGDKIVILSSAQGEHQPGRTDSIYVHTVGACD

SEQ ID NO: 71456 - protein, 503 aa, Triticum aestivum
MGSNEGGGCDGKPVVVVPEIKYTKLFINGEFVDAASGKTFETRDPRTGDVLAHIAEADKADVDLAVEAAREAFEHGKWPRMSGYERSRAMNKLADLMEQHIEELAALDGADAGKLLLLGKIIDIPSAVQMLRYYAGAADKIHGESLRVSGKYQGYTLKEPIGVVGIIIPWNFPSLMFFLKISPALAAGCTVVVKPAEQTPLSALYYAHLAKLAGIPDGVINVVPGFGPTAGAAIASHMDVDSVAFTGSGEVGRLIMEASARSNLKTVSLELGGKSPLIIFDDADVDMAVELSRLAIFFNKGEVCVAGSRVYVQEGIYDEFVKRAVVAAQNWKVGDPFDVATNMGPQVDKEQFERVLRYIEHGKSEGATLLTGGKPASDKGYYIEPTIFADVKEDMKIAQDEIFGPVMSLMKFKTVDEAIEKANCTKYGLAAGIITKNLDIANRVSRSVRAGTVWVNCYFAFDPEAPFGGYKMSGFGRDQGMMAIDKYMQVKSVITAVPDSPWY

SEQ ID NO: 71457 - protein, 355 aa, Clostridium tetani E88
MLYALILAGGKGTRLYPLSREDKPKQFLKIINNKSFLKSTVDRIKTLVNMENIYIVTNEVYLEKIYEELPELNKENIFLEPENKETATCIGLSAVKLLKKDKDAVMMVLPSDHHIQDEKVFIDTMKQAVETVEKKRGLVTVGVKPIRPETGYGYIEAGERVQGSIATYKVERFVEKPNVEVAKDLIMKGNYLWNSGMFVWRADIYLREMEKYLPKMYKSMMNIYSSLGTEEEEEVIRQEYNLIDGISVDFGIMQKTRKAYVIKCEFTWDDIGSFMSLSRFLKNFRGNNVEGNTFLEQSNNCIVFSKEKLIIGFGINDLIIVDSGDVMLIMDKNKDQEIKHLVDELKCSKEFNKFT

SEQ ID NO: 71458 - protein, 418 aa, Frankia sp. CcI3
MILGSGSAWDTACVQLANAARHLGLDDGMHDLLRTPRRAITVSVPLQRDDGQLTVLTGYRVQHNLARGPGKGGIRFHPTTDLDEVKALAMWMTWKCALMGIPYGGAKGGIAVEPAMLSLPERERLTRRYAAELVPLIGPEKDIPAPDVGTDEQTMAWIMDTYSAHTGYTTTGVVTGKPLSIGGSAGRAGATSLGVQLSVFAALRETGRDPHAMTIAVQGFGKVGALAAQYLHDAGCTVVAVSDVKGGIYNPQGLNPAALIRHLAGGAETVVGYPGTDTITNDELLELDVDVLVPAALEGVITVENVDRVRAPIIVEGANGPVTAEADQVLDDRGVLVVPDILANGGGVAVSYFEWVQDIQAYFWSEDEVSDRLRALMDRAYREVSLLATTQKISMRNAAHVIGVGRVADAHRTRGLYP

SEQ ID NO: 71459 - protein, 297 aa, Shigella flexneri
MTNLKAVIPVAGLGMHMLPATKAIPKEMLPTADKPMIQYIVDEIVAAGIKEILLVTHASKNAVENHFDTSYELESLLEQRVKRQLLAEVQSICPPGVIIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGSKFRKGIEKLLSE

SEQ ID NO: 71460 - protein, 226 aa, Zea mays
  misc_feature (24)..(24): Xaa can be any naturally occurring amino acid
  misc_feature (35)..(35): Xaa can be any naturally occurring amino acid
  misc_feature (69)..(69): Xaa can be any naturally occurring amino acid
  misc_feature (83)..(83): Xaa can be any naturally occurring amino acid
KGTGIWTGQQGVGLWGQGPKIAGXLDVRYLSGWKXEGLQTNGVVKEEGMPAGLLEAVYVDKRVLVDRVXRQALYASKVCSYAXGMSLLRAKSVEKGWNLNLAELARIWKGGCIIRARFLDRIESAYDRNPELANLIVDREFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 71461 - protein, 169 aa, Brassica napus
  misc_feature (153)..(153): Xaa can be any naturally occurring amino acid
MSSGIGNLVKIILKNFDVIAGPIISLLYPLYASVRAIESGAHGDDKQWLTYWALYSLIKLFELTFYGLIEWIPIWPYAKLALISWLVLPGLSGAAYVYENYVRSFLLRPHSVNIWYVPAKKDEDDLPAAAGKFTPVNDSGEPTEKRASSGDTXAAKYVGHSAFDDTYVY

SEQ ID NO: 71462 - protein, 328 aa, Triticum aestivum
MMGGFVSRILLLVFGYAYPAYECYKTVELNKPEIEQLIFWCQYWILVALMTVMERFGDLTISWLPFYSEAKLLFFIYLWYPRTKGTTYIYGTFFKPYISQHENEIDRNLLELRARASDVVVVYVQKVAAVGQNTFFDVLKYVASQSPSQKSKQQRPQEPQQPQQQQSQPQPQVQQQQPQRQAQPVMRRAASIAARQAAMAQQAQETKPVSPKIKRQASAKGGPAASVKPAAAAASTAKPDEKTKKSEAKPAAELVPAPATEAVVPRPEPKAQPAPEAEVSDDMAIDEADVAVEGAEEVDPALEETVMEETIRVTRAKLRRRAAAEAGA

SEQ ID NO: 71463 - protein, 219 aa, Vitis vinifera
MASSDNLASVDPWVFRHTFADSWISEAFARDTETLTKALQKSISNHPDNVACDTISPFLNDLLKPETAQTPSVSGVSGSDHETAPKRRTAIPGAAGGKITKRKSRASKRSQTTFITADPANFRQMVQQVTGVRFGNSQLPVNPILKPEPKRPGNRLLGCLPTLDTSEFLLDHHHQQVMGPATATQGAMTFQPVVADGGATGLEFETFPSFPTLESWKVM

SEQ ID NO: 71464 - protein, 338 aa, Arabidopsis thaliana
MQIGQALAAAKEGESQMIVMMGNNLSLTSIILNGDPSIEHKGKLTCLDEQVKISQFYHCEGLLLCILKDDSRFVVCNPYLEQTRWIEPRYSHRPYGMDRFSYALGYVNTDSCRSYKLLRFIDYYYNAPEKQFFWYEVYDFDSDLWTTLDVTPHWRIAFCNTGVPFKGNTYWCAAERNVDVDEVLANRLICFDFTSERFGPLLPLPFSEEKLAVLLQHDESNPYELDLWITTKIETEEVLWSKFLRVETAGFNSYVPFISGSFFIDEEKKVAFGFDERNRQRVIVIGEAGYLRGLDLVGDFGDQSCKPDLCSYVPSLVQIKQPEGGEREEESEYGEASI

SEQ ID NO: 71465 - protein, 275 aa, Mesorhizobium loti MAFF303099
MVTYLDAATAPLRNTGQIRLYGEDGFAGMRKACDLTARCLDALVPMVGPGVTTDAIDRFVFEFGMDHGALPATLNYRGYTKSSCTSINHVVCHGIPDNKPLKDGDIVNIDVTYILDGWHGDSSRMYPVGTIKRAAERLLEVTHECLMRGIAAVRPGARTGAIGAAIQTFAEAERCSVVRDFCGHGVGQLFHDAPNILHYGSANEGVEMRPGMIFTIEPMINLGRPHVKVLSDGWTAVTRDRSLSAQYEHTIGVTDTGCEIFTLSPNNLDRPGLPA

SEQ ID NO: 71466 - protein, 176 aa, Triticum aestivum
  misc_feature (19)..(19): Xaa can be any naturally occurring amino acid
MPPTVMALSATSVGPFQGXLKSTPGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 71467 - protein, 684 aa, Oryza sativa Japonica Group
MAGVVTRAVAAAVLVVVVVVAAAELVAAEPPPSERSALLAFLAATPHERRLGWNSSTSACGWVGVTCDAGNATVVQVRLPGVGLIGAIPPGTLGRLTNLQVLSLRSNRILGGIPDDVLQLPQLRLLFLQNNLLSGAIPPAVSKLAALERLVLSSNNLSGPIPFTLNNLTSLRALRLDGNKLSGNIPSISIQSLVVFNVSDNNLNGSIPASLARFPAEDFAGNLQLCGSPLPPCKSFFPSPSPSPGVSPADVPGAASSSKKRRLSGAAIAGIVVGAVVLALLLLVAAVLCAVSKRRRGASEGPKSTTAAAAGAGAAAARGVPPPGSGEGTGMTSSSKEDMGGASGSAAAAVAAVAAEPSRLVFVGKGAGYSFDLEDLLRASAEVLGKGSVGTSYKAVLEEGTTVVVKRLKDVAVARREFDAHMDALGKVEHRNVLPVRAYYFSKDEKLLVFDYLPNGSLSAMLHGSRGSGKTPLDWDARMRSALSAARGLAHLHTVHSLVHGNVKSSNVLLRPDADAAALSDFCLHPIFAPSSARPGAGGYRAPEVVDTRRPTYKADVYSLGVLLLELLTGKSPTHASLEGDGTLDLPRWVQSVVREEWTAEVFDVELVRLGASAEEEMVALLQVAMACVATVPDARPDAPDVVRMIEEIGGGHGRTTTEESEEGVRGTSEEERSRGTPPAAPTP

SEQ ID NO: 71468 - protein, 345 aa, Ralstonia eutropha JMP134
MKPILRIIDRARAAPRRIVLCEGEDPRILQAAERAAREGIAQVILVGNAARITDAAANQGIDLPRMTIVDPATSALTPSFAQALYAMRQKKGMTLDQARQAVLDPLCFANLMVRQGHADGSVAGAVHTTANVVRNAIQLIGLAPGFRLVSSFFLMMLCEPFHALKGGLIFSDCGLVVDPDAEELSEIAMAASDSARSLLNEDPRVAMLTFSTCGSAKHAAVDKVVAATERVRAQRPGLAIDGDVQLDAAIVAEIAERKIPHSQVGGHANVLVFPNLEAGNIGYKLAERLGGAKAIGPMLQGLRRPANDLSRGCSAEDVFHVIAVTVVQAQAASAQQPSSGEQAAA

SEQ ID NO: 71469 - protein, 107 aa, Triticum aestivum
RPFNIFKFFNLSHKYDVRKHVIRREVPSKKEGKKPKSKAPKIQRLITPRRLQHKRALRAAKLHRAEANKEAETQYKKLLASRLKEQRDKRTAILKKRRLSSKSQSEA

SEQ ID NO: 71470 - protein, 333 aa, Triticum aestivum
  misc_feature (245)..(245): Xaa can be any naturally occurring amino acid
  misc_feature (262)..(262): Xaa can be any naturally occurring amino acid
  misc_feature (278)..(278): Xaa can be any naturally occurring amino acid
MAGGGELVVSFGEMLVDFVPTVAGVSLAEAPAFLKAPGGAPANVSIAVARLGGEAAFVGKLGDDEFGRMLAAILRDNGVDDGAVVFDAGARTALAFVTLRADGEREFMFYRNPSADMLLTADELNVDVIKRAAVFHYGSISLIAEPCRSAHLRAMEVAKEAGALLSYDPNLREALWPSLEEARTKILSIWDQADIVKVSEVELEFLTGINSVEDDVAMKLWRPTFKLMLVTLGDQGCKYYTKDFXGTVPSYKVQQVDTTGAXGDAFMGSLLRKIVQDXSALQDKTNLRGHKFANHVEHHATKKGHPSCQGNSVAMKLNRSLFAMELSDRQQMP

SEQ ID NO: 71471 - protein, 268 aa, Aspergillus nidulans FGSC A4
MAGVLFSPEKDIPNLSGKVILITGGTAGLGAAAAIHLAKHSPSHIYISGRNAKSADAVIQQTQKSGTKVSFLACDLASLDSIKKAADTILAQESRLDLLMCNAGIMAVPPGKTSDGYEVQFGTNHLGHALLIQKCLPLLQQTAALPGADVRVVILTSLGFRMHPSAGIVFSDLKSEQNFPAFGSWIRYGQSKLANILYARELARRYPSITSVSVHPGVVGTGLVENLGWAKRTFVYVTNLWKLMKPEEGKLEERAALRAGWDPVVQVG

SEQ ID NO: 71472 - protein, 497 aa, Brucella melitensis 16M
MCLKRHIGEGAATRIRAQCDYAFTNIRGACMNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVPGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGGRASVVMVFIFFAFVLWALTQEPDTLAAMKVTPLWFVLLGIAYWVMKLKQKQS

SEQ ID NO: 71473 - protein, 192 aa, Moritella sp. PE36
MTTLVSKEGQSVPQVTFPIRQGDAWVNRTTEELFANKTVIVFSLPGAFTPTCSSSHLPRYNELASVFSAHGVDDILCVSVNDTFVMNAWKDDQEAENITFIPDGNGEFSAGMGMLVDKSDIGFGKRSWRYSMLVKNGVVAKMFIEADEPGDPFKVSDADTMLGMWHQNIKCKNQSPYLPNRAARSAQKQNKP

SEQ ID NO: 71474 - protein, 132 aa, Musa acuminata
MILFALANGKPTVVEFYADWCEVCRELAPQIFQVEQQFRNQVNFVMLNVDNTKWEQELDEFGVEGIPHFAFLDKDGNEEGNVVGRLPKQYFLENVAALVNGEPTIPHARVVGQFSSAEARKVHQVVDPRSHG

SEQ ID NO: 71475 - protein, 191 aa, Musa acuminata
MARVASSHFGLLRELPPPRLDPSDLPRRLRQATVLRLRSTRPLRLPKMACLAESKPVEPPPIESPPESSAGGGQGRVGRGGGLGPEIDEREVEMDENTAQPGAVKEGSQDASVSQSANFVEFPNKEINRRVALASTLAAVGLFISARLDFGVSLKDLSAAAIPYEEVGSSCFLMFCASCPCLITFLSPMKC

SEQ ID NO: 71476 - protein, 451 aa, Pseudomonas putida KT2440
MAFDFDLFVIGAGSGGVRAARFAAGFGAKVAVAESRYLGGTCVNVGCVPKKLLVYGAHVADELEQAAGFGWTLEEGHFDWGTLIANKNREIERLNGIYRNLLVNSGVTLLQGHARLTGANEVEVDGQRYTAEHILIATGGWPQVPDIPGKELAITSNEAFYLKDLPRRVLVVGGGYIAVEFAGIFQGLGADTTLLYRGDLFLRGFDGSVRTHLKQELEKRGLDLQFNADIQRIDKLEDGRLKATLKDGRELVADCVFYATGRRPMLDNLGLENTGVELDERGYIRVDEQYQTTAPSILAIGDVIGRVQLTPVALAEGMAVARRLFKPEQYRPVDYQNIPTAVFSQPPIGTVGLTEEQALEAGHKVQVFESRFRAMKLTLTDIQEKTLMKLVVDAETDKVLGCHMVGPDAGEIIQGLGIALKAGATKQQFDETIGVHPTAAEEFVTMRTVTR

SEQ ID NO: 71477 - protein, 279 aa, Pseudomonas putida KT2440
MIKKCLFPAAGYGTRFLPATKAMPKEMLPVVNKPLIQYGVEEALDAGLNEISIVTGRGKRALEDHFDISYELENQIKGTDKEKYLVGIRRLLNECSFSYTRQTEMKGLGHAILTGRPLIGDEPFAVVLADDLCVNPEGDGVLTQMVKLYKQYRCSIVAIQEVDPQETNKYGVIAGEMIRDDIFRVTNMVEKPAPEDAPSNLAIIGRYILTPDIFDIIANTKPGKGGEIQITDALLQQAKDGCVIAYKFKGKRFDCGGAEGYIDATNFCFENYYKTGKAY

SEQ ID NO: 71478 - protein, 268 aa, Physcomitrella patens subsp. patens
MDRYQRVEKPRPEIPISENEIRITTQGKMRNYITYATTLLQDKGASAIVLKAMGRAINKAVTIAEIIKRRIAGLHQNTSIGSTDITDLWEPLEEGLLPLETTRHVSMITITLSTKELENSTGYQPPLLADQVKPLAEFEYEGDGSPRGGRGRGRGRGRGRGRGRGANETANSEYNGGLDGGWVRGRGRGRGRGRGEYRGRGREQDAGGFDEPNADGPLRDQGNGFSQDMSYSDRGRGRGRGRGQGRGQGRGFRTDGPSQDQSQAGAAQ

SEQ ID NO: 71479 - protein, 115 aa, Brassica napus
MENRSEMVNRSQQSLFLIGSPDETDKIKRAETSQQAGAIAGAKAAAVAAVASAIPTLAAVRVFPWAKVNLNYTAQALIISSASIAAFFITADKTILQGARRNTEAQMKKVQQESK

SEQ ID NO: 71480 - protein, 496 aa, Nicotiana tabacum
MVLSKTASESDVSVHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLEKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVLAYTMPPNAQHVTVLRVVIREDFSRTLAERLVIDIEKVFHGVDTLPARVNAKLAVAEANGSGVHKKTDREVQLEITTAWLKFVADKKKKTNGVC

SEQ ID NO: 71481 - protein, 315 aa, Haemophilus somnus 2336
MPDIKLFAGNATPELAKQISERLYISLGDATVGRFSDGEIQVQINENVRGCDVFIIQSTCAPTNDNLMELVVMVDALRRASAGRITAVIPYFGYARQDRRVRSARVPITAKVVADFLSSVGVDRVLTCDLHAEQIQGFFDVPVDNVFGSPVLIHDMLKKTDLENPIVVSPDIGGVVRARAIAKLLNDTDMAIIDKRRPKANVAQVMHIIGDVAGRDCILVDDMIDTGGTLCKAAEALKERGAKRVFAYATHAVFSGAAAKNLANEALDEIVVTDTIPFTPEIKALGKVRVLTLSGMLAESIRRISNEESISAMFN

SEQ ID NO: 71482 - protein, 461 aa, Arabidopsis thaliana
RFLFFYESAIATRSMVKFENGYSVETVFDGSKLGIEPYSIEVLPNGELLILDSENSNIYKISSSLSLYSRPRLVTGSPEGYPGHVDGRLRDAKLNHPKGLTVDDRGNIYVADTVNNAIRKISEGGVTTIAGGKTVRNGGHVDGPSEDAKFSNDFDVVYVGSSCSLLVIDRGNKAIREIQLHFDDCAYQYGSGFPLGIAVLVAAGFFGYMLALLQRRVGSIVSSHNDQEMFEADPDQKPMKHSRPSLIPAGDEQLEKQEETFVVSLGKLVSNAWESVMEILRKKQTGTSFQQYHGTTKQSAAFSTSTPWPIQESFVIRDEDGPPPVEPRNPTPRKTYAFMSKDAEKMQQLRQSRAFYSSWDAEFPNQQQQQQKQHQKHQHQQQQQQQHRRHYSSIPHTYYEQDSEKSNEIVFGAVQEQSSKRVAKPKPKPIESGDQMNNNTQQNLHYRSHSVSYPYGYYPNT

SEQ ID NO: 71483 - protein, 249 aa, Glycine max
  misc_feature (214)..(214): Xaa can be any naturally occurring amino acid
MKFNIANPTTGCQKKLEIDDDLKLRAFWDKRISQEVLGDALGEEFKGYVFKITGGCDKQGFPMKQGVLTPGRVRLLLHRGTPCFRGYGRRNGERRRKSVRGCIVSPDLSVLNLVIVKKGESDLPGLTDVEKPRMRGPKRASKIRKLFNLSKEDDVRKYVNTYRRTFITKAGKKVSKAPKIQRLVTPLTLQRKRARIADKKKRIAKAKSEAAEYXKLLASRLKEQRDRRSESLAKRRSKLSSAAKPTASA

SEQ ID NO: 71484 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 71485 - protein, 508 aa, Glycine max
  misc_feature (177)..(177): Xaa can be any naturally occurring amino acid
  misc_feature (312)..(312): Xaa can be any naturally occurring amino acid
  misc_feature (314)..(315): Xaa can be any naturally occurring amino acid
  misc_feature (373)..(373): Xaa can be any naturally occurring amino acid
MLSRFTRLFSAPSNVARLVNGVQPRFSTTTVQDAPKIEEEPRFLEMVHQYFDIAGTFTDIPKDKLEVYKQCSAVFKVRLPLVRDNGKMEFIPAYRAQHKHHRLPVKGGTRYSEHIDLQEVEALSCLMTLKCAVVELPYGGGKGGIKIDPSKYSARELEDLTRRYTLELARKNFIGAXIDVPGPDMGTGAREMSWMKDTYTVFYGHNDINATACVTGKPLSQGGIKGRVESTGLGVFFGVREFLKDVELMKKYGIDSTNGYEGKTIIVQGFGNVGYFASKFMCEQGAKLIGVVDVEGSIYNPDGIDPDKLLEXRXXKGTLLDFPGSESYKDDSAFYKPCDFAIPAAVEKSINKLNAGRLQCKVLAEAANGPTTXAAEDILTKRGILVLPDILLNAGGVTVSYFEWLKNLDHMRPGRLVKRWEEKSKQNLLKIIADKTGTDLKLTAEDAKLLRGASELDIVYSGLEEVMCAAVEETVATSKKLNVPFRLASYVNAILKVHKVYEESGFAL

SEQ ID NO: 71486 - protein, 152 aa, Zea mays
MRSATLLTICTLSALLLVARGSEKPSAAPPPVVAVGVAAASDLIRSGGHRYLDVRTEEEFRSGHVEDSLNVPYLFFTSQGREKNPKFIAQVAAGFDKEDNIVVGCKSGVRSELACADLMAAGFRNVKNIEGGYTAWVESGLAVKKSQAQDEL

SEQ ID NO: 71487 - protein, 293 aa, Hordeum vulgare subsp. vulgare
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSAHGVFEGPVVMDSEMFRLDLFPEMDLGSYYMSLAEALLMDPPPTATIIHAYEDNGDGGADVRLWSYSVDM

SEQ ID NO: 71488 - protein, 425 aa, Frankia sp. CcI3
MTLAPERATSPTLEVANPAVSLSCRHCGATYPLSPTHVCVECFAPLEIAYDPDLLARVTRESIERGPANLWRYVGLLPAGHDPARRVSLGAGWTPLRPAPRLAAELGMKTLYIKDDSANPTHSFKDRVVSVALTAARELGFTTVACASTGNLAQSVAAHAAGAGLRSVVLVPHDLEAGKTVSTGVYGGTLVAIQGNYDDVNRLCSELAGEYEWAFVNVNVRPFYAEGSKTLGYEVAEQLGWRLPEQVVVPIASGSLLTKIDKAFGELGRLGLVEPTPYRVFGAQAAGCNPVAAAFARGVETVAPVRPATIAKSLSIGNPADGPYALDVARRTGGAITDVTDEEIIDGIRLLARAEGVFGETAGGVTVATLRRLLREGLLDPAAETVLYNTGDGLKTLDPLVETGGPTATIKPSLRAFEAAGLGDD

SEQ ID NO: 71489 - protein, 194 aa, Bixa orellana
GQAYEAMNNAGYLDANLVVVLNDNKQVSLPTATLDGPATPVGALSSALTKLQASTKFRKLREAAKNITKQIGGQAHEVAAKVDEYARGMISASGSTLFEELGLYYIGPVDGHNIEDLVTIFEKVKAMPAPGPVLIHLVTEKGKGYPPAEAAADKMHGVVKFDPTTGQQFKTKSSTLSYTQYFAESLIREAEVDD

SEQ ID NO: 71490 - protein, 565 aa, Zea mays
MSEAEAAGSLSRRRMEDEEGAAAMEADAAHSGRGEAEDEEVESSDYTSEDEGTEDYRRGGYHAVRVGDSFKQGAYVVQYKLGWGHFSTVWLAWDTVHSRYVALKVQKSAQHYTEAAMDEVKILKQIADGDPDDSKCVVKLLDHFKHSGPNGNHVCMVFEFLGDNLLTLIKYTDYRGIPLPMVKEICRHVLIGLDYLHRTLSIIHTDLKPENILLVSTIDPTKDPRKSGVPLVPPSMRTDEPPPKVPAQSGNGGLTKNQKKKIRKKAKRAVAATSEGSSAVASADTDGSDDRGDLGTTNEGSPRQDGAKKRVTRDRRGSKGAKKMMAMKADLKCKLVDFGNACWTYKQFTNDIQTRQYRCPEVILGSKYSTSADMWSFACICFELATGDVLFDPHSGDNFDRDEDHLALMMELLGMMPRKIALGGRYSRDFFNRYGDLRHIRRLRFWPLNKVLMEKYEFTEINANGMADFLVPILDFVPEKRPTAAQLLQHPWLDVGPLRQQPKTRPESARSPGDGVSEKQKKEKEEREAMAVELGNIAIDGASSSRMANDPQSSTNKTTATSSKK

SEQ ID NO: 71491 - protein, 68 aa, Zea mays
MSTTVSRASLDQKLALAKRCSREATLAGAKAAAVATIASAIPTLASVRMLPWVKGNINPTGQALIVST

SEQ ID NO: 71492 - protein, 416 aa, Francisella tularensis subsp. tularensis SCHU S4
MNMALISLAIDYKKSPIEVRSEFALSGLDVSMLYRSILAIDNVVHAVILSTCNRTEVYLEISDLRVVDDILVWWQGYVRNPNYKIKDYFKLRQGTEVIMHLMKLACGLESMVLGEPQILGQVKDSYTLSKKNHAIGKELDRVFQKVFATAKRVRSETRIGHCPVSVAFSAITLAKRQLDNISSKNVLIIGAGQTGELLFRHVTALAPKQIMLANRTIEKAQKITSAFRNASAHYLSELPQLIKKADIIIAAVNVLEYIVTCKYVGDKPRVFIDISIPQALDPKLGELEQNVYYCVDDINAVIEDNKDKRKYESSKAQKIIVKSLEEYLEKEKAIISNSAIKELFQKADGLVDLSLEKSLAKIRNGKDAEEIIKRFAYEIKKKVLHYPVVGMKEASKQGRSDCLVCMKRMFGLNVEK

SEQ ID NO: 71493 - protein, 316 aa, Oryza sativa Japonica Group
MASPMHARRAKLKSQLVSAKAKLKHHVTPRRLLLLSAAAASAFLLLLTLRTLSAAAANTSSPAPVVVHRSQQQQRDDQCDRVPAGVAEALVHYATSNATAWGRGRRRSAEEVAATARAVSRRAPCNLLVFGLGHGAALWAALNHGGRTVFLEEDDALVSGASPASLAIEAYRVAYLASAADADELLALRDSEHCTGAAATQLSPGHFDRSPCKLAVRGLPAAFYEAEWDVIVVDAHAPPPPTTTAMMGAIYTAAVAARARRPAAETETDVVVHDVDKPVQDRFSTAFLCGGYLKEGVGNLRRFAIPSHKEGMPFCP

SEQ ID NO: 71494 - protein, 481 aa, Xanthomonas axonopodis pv. citri str. 306
MRVMHADLDVCAEDIAAVFAAQQPVAAAWRSSTAAQRRERLRALRSALLARRQALYAAFAGDFGKPALEVELSELLPVVDEIAAAIAGLPRWMRPRKVSPTLLTLGTHAQIGYQPKGRCLIIGPWNYPVATVLGPLVSALAAGNTATLKPSEFTPQVNAVLRELLAEAFDPSEVAMVQGGVATAQRLLACPFDHVFFTGSPAVGRQVMAAAAAQLASVTLELGGKSPAIVDRSANLERAAQVLVWGKLVNAGQTCIAPDTLFVHREVRTALLQRCRELLAQRYGGSAAAVAASPDLARMIHVGHAARLAALIDEARAAGAELVAGGEHDVGQRFIAPTVLADVPEHARIAQEEIFGPVLPVVTFDHLDTVLAGLDAAAKPLALYLWSNDAAQVARVLARSSSGSVVVNHCLQQFMHTGLPFGGIGQSGIGSAHGVHGFKAFSHERAVLRGGRLLTARAFFPPYRGWQHRVATALTAWLARR

SEQ ID NO: 71495 - protein, 490 aa, Escherichia coli
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 71496 - protein, 198 aa, Triticum aestivum
MASMHVLRESEAEGATPTITHTTIYKSEKFSMVLFFLPTNAVIPLHNHPGMTVFNKLLIGSMHAKSYDWADPDDPANESDASSADGQLRLAQLVVDDVFTAPCDTSVLFPTAGGNMHRFRAVAPSAFLDILGPPYSIEEDRDCTYYTDIPYSEHHMTSNELIGNEQEGRRLAWLKEVEMPRDLKMCSVRYGGPPISGR

SEQ ID NO: 71497 - protein, 197 aa, Brassica napus
  misc_feature (179)..(179): Xaa can be any naturally occurring amino acid
MAKRKHRKLFPILASETNKTFDCSIGICDPVCPYNCYQEPDYYTISPQLPPWSSPPTIRPQSPSISAVYQPSQDSSSSLGAITIIAVTGAVLAILLTGFFLVAKYVTKSVNRVNLESYQSQRDGHDGAIDEEFQDTEQVDHPIWLIRTTGLQQSIINSITICSYKRGDGLIERTDCPVXVNEFEEDESLRWCKCTMR

SEQ ID NO: 71498 - protein, 341 aa, Burkholderia xenovorans LB400
MKIKFVPVLLASALAFGSAFAASPASQPTPDRVTSGFLKALNSGKGPAINTLPPAQARQVLVDAQNGVKVDLSGIDVSNRTIEQDGVSVPLTIVRPHGASGTPPVFMFFHGGGWILGDFPTHERLVRDLVVQSGAVAVFVNYTPSPEARYPVAINQAYAATKWVAAHGDEIGVDGSRLAVVGNSVGGNMAAVVSLMAKDRQGPAIRFQGLMWPVTDNNFNDGSYNQFQEGHFLTRPMMKWFWDAYTKDPKQRNEIYASPLRATTEQLKGLPPALIQVAGSDVLRDEGEAYGRKLDAAGDEVATVRYDGTIHDFGLLNALAEDAPTKAATRQLANELKQRLQ

SEQ ID NO: 71499 - protein, 636 aa, Desulfitobacterium hafniense Y51
MIACSVNKVTKMYGGNTIFSNISLEIQENERVGLVGPNGSGKTTLFKLLAGQEDPDAGQVHWKKGSKTGYLTQIPDFEDGLTASDVLMIAYRELLEMEETMRELETAMSMEEEHPRLDKLMEHYGLLLNQFTLQGGYEIQANLEKIAQGLNIGDLLPRSFATLSGGEKTKVGLALTLLKNPDFLLLDEPTNHLDLFAVKWLGSFLKTYNGTVLVISHDRFFLDEVVTKILDLADGELYHYHTNYTGYVKEKEERLLKEFHDYEEQQKQIKKMKETIKRLREWANRAYPSGEGLYRQAKNIERALEHMEKLSRPQLNRKKMNLEMEASERSGKDVVLLQDVAKAFSGNQPLFTNVNLHLAFGQRAAIVGENGTGKSTLIKLILGELSPDQGEVRIGSNVKIGYLSQQVFSDTKEKTVIDLFREDIPMTEGEARNTLARFLFYGPMVYKKVSQLSGGERMRLRLAQLMYQDNNLLILDEPTNHLDMDSLQVLEDALENYDGTLLAVSHDRYFLNKLFHKVYWLEAGAVHCFEGNFSYAEEKMGTAHHQNERVHNEEVQLKREKPTVKQGGSDSLPTRDKITPDYRLEKLESELKNLEEQISSLDLQLREIVDLAQLQQVYAEKEGLEKRWLEIFELLE

SEQ ID NO: 71500 - protein, 532 aa, Coprinopsis cinerea okayama7#130
MPDYNARVASNPYVVGSFACIGGGLFGLDISSMSGVLNNQHYLQAFGHPGPSAQGAIVASMPAGSLLGALTVTQLADRIGRKKTIILAGLIWIVGSVLQCAAQNRAMLVVGRIISGFSVGLSSAVVPIYQSEITYPSIRGRMVSLQQWSITWGILLQYFVQFGCSYIDGVASWRIPWGLQMIPAMVLSAGMTIFPESPRWLFDHGREDEALQVLADLHGNGDKTNELVVLEYEEIKEQVEYERTQGAKSYLDLLKPGNPRRVMLGCSLQMWSQLTGMNVMMYYIIYVFEGAGLTGRRSNLIADSVQYVLNVLMTVPAIIYIDKWGRRPMLLAGTLFMGFFLYLVGGLQGRFGHWGDIEGKRVWVITDNPSATKAVVVCSYLFVCSFAVTMGPVSWTYPAEIYSLKIRGKAVALATASNWTFNTALAFAVPPGLDTIAWKTYFIFGTFNFACFIHVLFMFPETVGRSLEEIEEIFGKGHVFTAWRIGRDVGRGKVAELSAQRAQRKEAKETENQEKEKEKAGSVEEKHEHEVA

SEQ ID NO: 71501 - protein, 260 aa, Chromobacterium violaceum ATCC 12472
MQLNGKVALITGAASGIGKEIALVYARAGAAVAIADINLDAARKTADEIVSAGGKAIGVAMDVTSEDAVNQGTQQVVDAFGQLDILVSNAGIQIVNPIVNYSFADWKKMQAIHVDGAFLTTKAALRHMYQDKRGGVVIYMGSVHSHEASALKSAYVAAKHALLGLARVLAKEGAPYNVRSHVICPGFVRTPLVDKQIPEQAKELGISEEEVVKRVMLGNTVDGVFTTVDDVAQTALFLAAFPSAALTGQSFVVSHGWFMQ

SEQ ID NO: 71502 - protein, 321 aa, Lactobacillus johnsonii NCC 533
MKKTARAHTNIALIKYWGKADQALKTPLMSSLSMTLDAFYTDTTFEHDSSLTEDTFILNDQKQSVEDSKRVFNYIHLLQEKFGVNDHFTIRSTNHVPTSAGLASSASAFAALATSFVASYGLDLSKKELSRLARLGSGSATRSVYGGFVEWKKGFDDESSYAAPIDENPDLDLSLLAIEVNTKQKKISSTKGMQLAQTSPFYQPWLARNEEEIAEIKQAIQNNDFTRIGELSELSANEMHACNLTAKEPFTYFEPETIKIIKLVEDLRKNGIECYYTIDAGPNVKILCTLRNRKDIISAVQKTLTNVKIVVASFGPGVTLL

SEQ ID NO: 71503 - protein, 495 aa, Bacillus licheniformis ATCC 14580
MSSLTMQVSKKLESFLQGTKKLYINGEFVASASNKTFETPNPATGETLATLYEAGPEDVDKAVKAAREAFDRGEWRTMNPAERSRLMYKLADLMEEHKTELAQLETLDNGKPISETTAGDIPLSIEHMRYYAGWATKITGQTIPVNGPYFNYTRHEPVGVVGQIIPWNFPLLMAMWKMGAALAAGCTVVLKPAEQTPLSALYLAELIDEAGFPKGVINIIPGFGETAGEALTDHALVDKLAFTGSTEIGKKIMEKAAKSVKRVTLELGGKSPNIILPDADLKKAIPGALTGVMFNQGQVCCAGSRVFIHKDQYDKVVDEMAAYSKSLRQGAGLHEDTQMGPLVSKEQHERVLSYIEKGRQEGAKIAAGGTCPYEQGYFVSPTVFTNVEDEMTIAKEEIFGPVLAAIPYETVDEVIERANRSEYGLAAGVWTENLKNAHYIADRLQAGTVWVNCYNAFDAASPFGGYKQSGLGREMGSYALDNYTEVKSVWIHTGE

SEQ ID NO: 71504 - protein, 181 aa, Synechococcus elongatus PCC 6301
MAVFEGSFVNASQFRLAVVIGRFNDLVCEKLLAGCQDCLKRHGVDPDPQGTQVDYAWVPGSFEIPLVARQLALTGRYDAIICLGAVIRGQTPHFDYVASEVAKGVAATSLQTGIPIAFGVLTVDNLQQALERAGIKSNLGWNYALSALEMASLMHQIRSTTGEVPRQTLPLAAAPSNFAGT

SEQ ID NO: 71505 - protein, 238 aa, Zea mays
MRGMVSFAVWALFAALLSQQLFASVASVRFEDAKTYYLSPPSGSHGTPPSHTPPSSNCGSPPYDPSPSTPSHPSPPSHTPTPSTPSHTPTPHTPSHTPTPHTPPCNCGSPPSHPSTPSHPSTPSHPTPSHPPSGGYYSSPPPRTPVVVTPPSPIVDPGTPIIGGSPPTPIIDPGTPGTPFIPAPFPPITGTCDYWRNHPTLIWGLLGWWGTVGGAFGTVSIPSSIPGFDPHMNLLQAI

SEQ ID NO: 71506 - protein, 267 aa, Chromobacterium violaceum ATCC 12472
MKMPKLGVGTFRLKDQQAEESVSMGLELGYRHIDTAQIYRNEADVGRAIAKSGVPRDELYVTTKIWIDQFAQGKLIPSLRESLDKLGLDSVDMTLIHWPSPNDEVPVAVYMNQLAEAKHLGLTREIGVSNFTIAHLRQAMDVVGADAIGTHQLEVHPYLQNLKVRAFCREHGIALTGYMPLAYGRAVGDPTLQAIGQKHGATAAQVALAWQLQQDIAVIPSSTKRANLAANLDALKLRLDADDMARIAALEDGGRIADPDFAPAWDA

SEQ ID NO: 71507 - protein, 347 aa, Arabidopsis thaliana
MEFVKVLGKGTYGSVELFSHKQNDGSLLYNAVKIMDSENYGSIDQEFRILSELRGCPCIVQLCGNSLVQGIDCNGKKVYMMSMEYAAAGTLTNFIKRNRTKLSDSVIKDFTRMILQGLVSIHNHGYVHCDLKPDNILLFPLYDKDTWNCSYELKISDFGISTRAGDKSGCWRVDEPWVGTSIYMSPESVSDGTTVEKTLDLWSLGCIVLKMYTGKRPWLGFEKDVKSLLLNQKAPEIPETLPCDARLFLEKCFSRKPEERGSASELLLHPFLTGDEKKGSSVAGGERTGMVLRLRKPPPISKDIPTKPRKLKVISQKPQQLKKVSNKPLKVKIVPPRPPRSDFVPVL

SEQ ID NO: 71508 - protein, 155 aa, Frankia sp. CcI3
MTGSAAEVASQSRATSLDRITLSGLRARGYHGVLAAERDLGQEFVVDATLWLDLSSAAFHDDVTRTVHYGELAETLAGIVTGEPVNLIETLADRLVRACLRDGRVMRAEVTVHKPAAPIAVPFADVAVTIVRNRVDGVESVTAPAAAAGVVTDGG

SEQ ID NO: 71509 - protein, 313 aa, Triticum aestivum
  misc_feature (233)..(233): Xaa can be any naturally occurring amino acid
  misc_feature (296)..(296): Xaa can be any naturally occurring amino acid
GGGRSRTSGSPGLQEFGTRPRAEFGTRRNLLNKCLFQASTIKSIKARQIFDSRGNPTVEADVITENGLFRAAVPSGASTGKYEALELRDGDKKNYMGKSVLTAVNNVNTVLAQGLKGWDVTKQQEIDKLMVEKLDGTQNEYGWSKHKLGANAILAVSLAVARAGAASKNVPLYQHLRSLTKINTNKDKFVLPCPSLNVINGGKHGGNGIAMQEFMILPTGAKNFSHAMQVGTXVYHHLMKIIKKKHGLNATNVGDEGGFAPNVPDGIEALELLREAIQQAGHTSIVEIGMDCAASXFWNESSKKYDLHFRDEK

SEQ ID NO: 71510 - protein, 311 aa, Rhizobium leguminosarum bv. viciae 3841
MTQLDESAKRALAWPGDPQTPVESCTPALARQQYLDSFADIQRPLEDVVETLERHAGAIRLKIWRGRAAPRQGAPALLYLHGGGFVIGAPETHEDICRTLANMAGAVVVSPDYRLAPEHPFPAAIDDCAAALVWMTEQADALGIDPLRVVVAGDSAGGNLAAVVALLARDGQVPAVIGQVLIYPVTDQLQTSDSYSRYEEDFGLTAAAMKWFRDHYLPDAASRSDWRASPLNAASLAGVAPALVILAGYDVLFDEGAAYAERLGTEAKATTRTWPGQIHGFVSKRRAIPEGQEALEAIATAWRAMDPALAR

SEQ ID NO: 71511 - protein, 389 aa, Arabidopsis thaliana
MGKSKKKVLNKSLITHPSTSDDTLQLFDPTSSPTKEKVNWNNVLGISDYLSKQATRVKTLWTGETPKAESVKETMESYFKALLGFLLCCHGSTLGAGPTLSSIVHGSVKQIVDSSFRLFQGSVSLYDGSYEKGEKPSISQLSGAVLEACSSFKKVPTTNLIAIGSAISQVSVIMKDVLNEMKKVKPACPSSEGEASGDDFSPEQIEVAKMVADIVYEAMTVIIVIRVITRMMEKENSNENSVFVESLEKLLKLCQRSGVVIEELGTCVYHPPLKIDKITQTVKILEGNLDEVEAQVEYMKRSSNAFPGVCRKLRDAIKLMEVGLEKRKDLNQILISRQNTLYNALQISEQPSKQDTIGSMFGFLCIYMRNRHVSYKLKTASPFPKFIFR

SEQ ID NO: 71512 - protein, 446 aa, Geobacter sulfurreducens PCA
MNIEKGFDKIVKTLRVMITDQPGYLGRLTTAIGSEGGNIGDIRLISSGLTHNIREITVYVDNDQHLEMILKAVAAVEGVIVEEVIDRVQQVHEGGKIAVRSRVEIKTIGDVRKIYTPGVASICRQIQQKPRLADTYTAIGNTVAIVTNGTAILGLGDIGPVAGMPVMEGKAVLFDHLVGISGVPILLRSKNVDHIVDTIWHLAPTFGAIKLEDIAAPDCFEIERRLVEMLDIPVMHDDQHGTAVVVLASLLNATRFTGTRLQNATIGIIGLGAAGTGIAKLLMAYGVKKVVGTDLNPGAMEMLQTLGGEPTNLAGVMERAQVVIATTGCPGLIKPDMVKQGQVILALSNPDAEIKPQDAMTAGASFAADGKSINNALAFPGIFRGALDARASRINNRMLIAAAKAIASHAEEGELVPGILNRNVHLAVAEAVARAAAETGVIKPRN

SEQ ID NO: 71513 - protein, 472 aa, Bacillus thuringiensis serovar konkukian str. 97-27
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGTEMKDHPFKMPFAPVTNYLTIAFLIMVLIGMWFNDDTRISLVVGIVFLAIVTISFYAFGIGKRPPLDVPNDQEISSK

SEQ ID NO: 71514 - protein, 340 aa, Brassica napus
  misc_feature (263)..(263): Xaa can be any naturally occurring amino acid
  misc_feature (282)..(282): Xaa can be any naturally occurring amino acid
MATMARSFLQAISKDEAVAPPLRVVQIEGLAVLKIIKHCKEFAPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLRERNFSWMDIFEEIPIKVSNSALVSAFMTELETDAPVSQGDYDRLHSSTTPFLENNMEFLIKCMDDLSMEQQKFQYYYRNLSRQQAQRQAXWLQKEEDRENLARRSAGEXEPLPRGDPSNPIFKPIPEPSRLESFLITNQVGDPRGRINGVAGQNFSRLYLTKALHEN

SEQ ID NO: 71515 - protein, 428 aa, Clostridium perfringens str. 13
MNNNFRELFIGVDEEITIYNGKKIVPINLDNAATTPALKEGLKCVSDMLHVYSSIGRGKGYKANFCNEFYENSRKKILEFFNVKNTEDYTVIYVKNATEGLNLLAHSLGNKKDYIISTRMEHHANDLPWRENSNILYAEVDELGLLKKEKIEELIKKHKGKVKYLTITGASNVTGYLNPINEIAKMAHDNGIKIIVDAAQLVAHKPINIGGTGNNDHIDFLVFSAHKMYAPFGTGVIIALKELIKDKDPLLKGGGAVDLVSDNKVFLDSEPERFEAGTPNIIGVCSLLSSIKVIKSIGFDKIELLEENLKKTLLDGLKGMPDIITYGDSNYKNRIGVVVFNVKDIHHDVISERLANLRGISIRNGTFCAHPYVRRLLNLKDEEFSKYAYSNKPRPGMLRVSLGLYNTKEEIEEFLNTLEIVKEKDFRL

SEQ ID NO: 71516 - protein, 643 aa, Clostridium perfringens str. 13
MIILSCRHLTKSFGIDEILRDITFNINEGDKVGLIGPNGEGKSTLFKILTKQLDYDSGELFLDKNKTLGYLSQNLSLDSENTIYDEMLSVFSSLTELEDKIKTLEEKLNEPYDASNEEYHNKLIKDYTLSQELYENRGGYTFRGEISRVLKGLGFLEEDFNNQIINLSGGQKTRLALCKLLLRKPDLLLLDEPTNHLDLEAIEWLEEYLNGYKGTVFVISHDRFFLDSVTNTTFELIGGKIHCYNASYTKFLELRKKDIEARLKAYNLQQAEIKRQEEIIEKFRSFNREKSVRAAESRQKALDKMDRLEAPEVIKEASKISFETLVKSGNDVLHIENLKKSYDSLLFENVNLDLKRGEKVALIGENGRGKTTLFKIIMGMLKQDSGSVSLGKNVFTGYYDQEQSNLNLHKTIIDEVWDDFPNLTTTEVRNYLASFLFTGDDVFKEISLLSGGEKCKINLLKLMLSKANLLLLDEPTNHLDIMSREALEDAILSYDGTLIVISHDRYFLNKVINKIVELQENGLKTYLGNYNYYMDKKANPNRYEDIDEEINQGKTKTQIKEERKKKKSAEKSARALRAQLRDVEKLIPQKEEELEKLQGMLCTEEVYSNPEESVRVNKEINSVQEEIDSLYATWEELSESLEE

SEQ ID NO: 71517 - protein, 132 aa, Zea mays
YEPRVVHQFLDLAYRYVGDVLGDAQVYADHAGKAQIDADDVRLAIQAKVNFSFSQPPPREVLLELARSRNRMPLPKSIAPPGSIPLPPEQDQRSNEQQHTPQHGQRVSFQLNAVAAAAAKRPRMTVDQLNIG

SEQ ID NO: 71518 - protein, 180 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 71519 - protein, 429 aa, Zea mays
MGAADKWLLPLVSVSFVSLLLFLSALSGFSASSALFARLPPPSYVRRGAAAPPSFAYLLAGGRGDGRKLLRLLLAVYHPRNRYLLHLSADAPASERAELAVAVARAAPAARAFGNVDVVGRPTAGTPMGSSGLAATLRAAAAMLRLDAEWDWFITLSAADYPLLTQDDLIHVFSSVPRHLNFIDHTSDIGWKESQRVQPVIVDAGIYLAGRNQFFQATEKRDTPDGFKFFTGICLNLHFVFHPVDEKWFLNTCTPFLLGSPWVILNRHFVEYCVFGWENLPRTLLMYFTNVMLPLEGYFHSVACNSDFHNFTVNNDLRYVVWDDPPQMEPHFLNVTHYDELVGTGVPFARKFKEDEPLLDMIDDKVLRRWRHRPVPGAWCTGKRRWFSDPCSQWSNVNIVRPGPQAEKFRTYINQIMEESKSSNNSCKQ

SEQ ID NO: 71520 - protein, 338 aa, Glycine max
MGKVKIGINGFGRIGRLVARVALQRDDVELVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 71521 - protein, 367 aa, Novosphingobium aromaticivorans DSM 12444
MKTRAMVCHAPGAPLVEEELDLAPPGPGEVLIEIMASGLCHTDLSQLEGVAAPYPFPIVVGHEGAGVVREVGPGVTSLRVGDHVVPLGIGECGECGNCRSGLTNLCEAFLADMASQPTPFSLGGKRVSAYSGVGSLAQFIVTAERNVALIRKDVPFELACTVGCCVATGVGAVLHTADVGEGATVAVFGLGGIGLNVVQGARLAGASRIIGVDINPLRDAQGRRFGMTDFIDARNADPVDAIRALTGGGCDFAFECAGNIKLMQQAFESTRIGWGCTVVLGVPPDGAALSLVPFQLQLGRRVQGSFMGNMKGRSQLPGLLDHYAEGRLNLDDLVTHRLPMREVNNGFALMKRGEALRTVVSFARNES

SEQ ID NO: 71522 - protein, 417 aa, Zea mays
MAARAADENRRPGVGRPRAMRPRKSRRDEKKTALPSSRPMTRKFVASLASKGQPECQPTGADPEPGVDQRKEPIGDGIIDIDVELDEPVDDSDCDVDMGDETENKDIMNQDESLMDIDSADSGNPLAATEYVEELYKFYRENEAKSCVNPDYMSSQQDINAKMRAILIDWLIEVHYKFELMDETLFLTVNVIDRFLEKEVVPRKKLQLVGITALLLACKYEEVSVPVVEDLVLISDRAYTKGQILEMASTQSCFLGCTLDHDDIHIHIEKLILNTLQFNMSVPTPYVFMKRFLKAADADKQLELVSFFMLELCLVEYQMLNYRPSHLAAAAVYTAQCAINRCQQWTKVCESHSRYTGDQLLECSRMMVDFHQKAGTGKLTGVHRKYSTYKFGCAAKILPAQFMLELGGTAPPPSGAI

SEQ ID NO: 71523 - protein, 278 aa, uncultured Thermotogales bacterium
MTYNLLEGSGWMLKIYQVDSFTAVPFGGNPAGVCLLDEEIDERLYPRIASEMNLSETAFVRPGDEKNTYGLRWFTPKVEVKMCGHATLATAWIHFTELGVKGEISYETLSGKLGVRYVDGKIEMNFPSDNPYRVRIDEMLGRITGVEGECYYSSLTEKLLYIISSKSKLENLSFDFSLLETCDFGYTVKGLIVSSPGDEKFDFYSRYFAPWVGIDEDPVTGSAHTVLGPFWSEKLGRKNLRACQLSSRRGELDLELLPNSRILILGKAVTVIRGTISI

SEQ ID NO: 71524 - protein, 336 aa, Pseudomonas putida KT2440
MKAAVVAPGRRVDVIEKSLRPLEHGEALLKMQCCGVCHTDLHVKNGDFGDKTGVVLGHEGIGVVQEVGPGVTSLKPGDRASVAWFYQGCGHCEYCNSGNETLCRDVKNSGYTVDGGMAEACIVKADYSVKVPDGLDSAAASSITCAGVTTYKAVKISNVRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 71525 - protein, 751 aa, Aspergillus nidulans FGSC A4
MLSHYTGYKPGDVPGNLPDPYYWWEAGAMFNALIDYWFYTGDSRWNNITSQALIWQAGESGSFMPANQTRTEGNDDQGFWAFAAMSAAERNFPMPRDKHETPGPDWLAMAQATFNTQAWRWDAQNCGGGLRWQIFTWNAGYMYKNTISNGCFFNLAARLARYTGNQTYADWATKVWNWTHAVGFMTDDYSFYDGASIDGNCTNFDHVQWTYNAGVYLLGAAAMYNYTNGDPLWKQRTEGIINAAHIFFADSPSSKDIMYERACESINTCKVDQRAFKGFLARWMAQSTQFAPFTYDMVMPKLRSSALAAAKTCTGGSDGAECSLKWTEQKYTGGPAGGDVGIQMAALEVLQSTLIQKVEPPVTRKEGGLSMGDPAGGSEPPVPTPALLVREIETGDRFSRTRQGSMGSITPLEIPTHCKAGVIYNPGPNFTVKVEDVPVPQPGADDILIRLNVTGLCQSDLHYMLDDLGISMSTFGVRSPGHEGAGVVVKVGENVKNFKVGDRAGIKPMMDTCGACTSCWSDKETYCAGAVHTGLMYVVSPARYATPIPEGIPDEIAAPIMCKSRLQAGDWAVFPGGGSQGGVGIQGVQLASAMGMRPIVVDTGEEKKNLALKMGAEAFIDFKTVPDAAAAVVEIADGIGGHGVFVTAQAAYPTALAYLGTRIGGDLMCIGIAPAGTMSIPVDPNLLLFRNTRIQGTLVGSRHDTIKALDFARRGKLKQICEVWPVERLPEAVDRLRKGLVAGRMVVDFNQ

SEQ ID NO: 71526 - protein, 337 aa, Moritella sp. PE36
MTIKVAINGYGRIGRNVLRAFYEGGKEQDLEIVAINDLGDSRINAHLTKYDTAHGRFPGTVDFDAEALIINGDRILTFSERNPKDLPWGELGVDVVLECTGIFTSKEACQAHLDGGAKKVLISAPGKNVDATIVYGVNHDIITADMTVVSNASCTTNCLAPIAKLLNDSVGIVNGMMTTIHAYTNDQRLSDVYHTDLYRARAAAMNMIPTSTGAAAAVGLVVPELQGKFQGMAVRVPTINVSLVDLTFEAGRDTTPEEINQIITDAVAADPILARALAVNNEPLVSIDFNHDAHTSNFDATQTKVQGKLVKVMSWYDNEWGFSNRMLDNAVLLMSAK

SEQ ID NO: 71527 - protein, 511 aa, Zea mays
MATKGGNARGVPVGVLLVAALLLCSLAPASASSYPARVVSGFLSNAASAVVKRLWSLKSTTKIAASGGKSMVKYEGGYTVETVFDGSKLGIEPYSVEVTQGGELLVMDSMNSNIYRMALPLSRYSRPKLVAGSPEGFPGHVDGKLREARMNHPKGFTVDDRGNIYVADAMNMAIRKISDTGVTTIAGGKSGRGGHVDGPSDEAKLSTDFEVRYIGSSCSLLVIDRGNQAIREIQLHFDDCVYQYEAGFPLGVALLLAAAFFGYMLALLQRRVLGMYSNGDEQDHESPVKAKLTSIPPPYQKPLKPYVHPLLIPNDDEPVKQEEEEGLFTSIGKLVGGAKSSIAEIIGAAFSRKKRVNVHHHQLGRPTSWPAQESYAIPRDETPPPLDTRAPTPRKNYAFMSKEPEKIHHIRHGRPQLHGWTGEAAPQQQQPQQVRHQQYVQHHRQYSAGPQTYYEPSCDATKEIVFGAVQEGDTSRRPVEIKAVNHGDAAPYEQNGLRFRSSYSVRYNGNN

SEQ ID NO: 71528 - protein, 520 aa, Agaricus bisporus
MRLSNALVLVAACISSVVAKTRTFDFDLVNTRLAPDGFERDTVVINGEFPGTLIQVNKGDSVRIPLHNKLTSPTMRRSVSIHWHGFFQARTSGQDGPSFVNQCPQPPNTTFTYEFSVAEQSGTFWYHSHLSTQYCDGLRGAFIVYDPRDPLRHLYDVDDESTVITLAEWYHILAPDATNEFFSSGIIPVQDSGLINGKGRFNGGPLTPFAVVNVRRGKRYRLRVIAISCRPFFTFSVDNHSLVFMEADGVEHDPVEVQNVDIYAAQRVSVILHANQPIDNYWIRAPMTGGNPDRNPNLNISLTLAILRYHGARHVEPTTVNVPGHKLLDQEMHPIRQEGPGKLGDGPPDKHITLNIAQPNAPFFDINGISYISPTVPVLLQILSGAKRPEDVLPSEQIFFVPKNSLIEVNIPGEGAHPFHLHGHNFDVVLASNDDTFNFKNPPRRDVYPINGGNTTFRFFTDNPGAWFLHCHIDWHLEAGLAIVFAEAPEDNVSGPQSQITPQDWLDLCPEYNAIEPEFQ

SEQ ID NO: 71529 - protein, 576 aa, Triticum aestivum
MRALFAWCALLLACGGVMHCAEAAKARHLKWEVSHMFWSPDCEEKVLIGINGQFPGPTIRAKAGDTIVVELKNGLHTEGVVIHWHGVRQIGTPWADGTAAISQCAINPEETFTYRFVVDKPGTYFYHGHYGMQRAAGLYGSLIVDVADGEEEPFKYDGELNLLLSDWYHESIYNQMVGLSSSPMRWIGEPQSLLINGRGQFNCSLAAAHTPGTKQCTAGGNRHCAPVILPVEPNKTYRLRIASTTSLASLNLAIGKHKLTVVEADGNYVAPFVVDDMDIYSGDSYSVLLTTDQDPSSNYWVSIGVRGRTPKTAPALALLNYRPNRGFKLPAIAPPVTPAWNDTAHSKAFTTQIKARAGTPPPPATSDRRIELLNTQNKLDGHIKWSINNVSLVLPATPYLGSLKLGLKTALAAARPADTFGRAYDVTRPPHNPNTTTGDNVYVLRHNTTVDVVLQNANALQHNVSEVHPWHLHGHDFWVLGYGEGAYRGDAADAARLNLVNPPLRNTAVIFPYGWTALRFVADNPGVWAFHCHIEPHLHMGMGVIFAEAIDRVGKVPKEAVSCGATATALMNGDHL

SEQ ID NO: 71530 - protein, 520 aa, Agaricus bisporus
MRFSNAFVLVAACISSVLADTKTFNFDLVNTRLAPDGFERDTVVINGEFPGTLVQVNKGDSVRIPVNNKLTSSTMRRSVSIHWHGFFQARTSGQDGPAFVNQCPQPPNTTFTYEFSVADESGTFWYHSHLSTQYCDGLRGAFVVYDPEDPLGHLYDVDDETTVITLAEWYHVLAPDINNEFFSSGIIPVQDSGLINGKGRFNGGPETPFAVVNVEQGKRYRFRVIAISCRPFFTFSVDNHNLTFMEADSVEHDPVEIQNVDIYAAQRVSVILNANQPVDNYWMRAPMTGGNPDRNPNLNISLTLAILRYKGAPEVEPTTVNVPGHKLLDQEMHPIAQEGPGKLGDGPPDKHITLNIAQPNAPFFDINGISYISPTVPVLLQILSGAKRPEDVLPSEQIFFVPKNSLIEVNIPGEGAHPFHLHGHNFDVVLASNDDTFNFVNPPRRDVYPINGGNTTFRFFTDNPGAWFLHCHIDWHLEAGLAIVFAEAPEDNVSGPQSQITPQDWLDLCPEYNAIEPEFQ

SEQ ID NO: 71531 - protein, 142 aa, Clostridium acetobutylicum ATCC 824
MKISEVMTKNVVSVSGEENIKRAAELMRDHDIGAIPVCNSDKVIGVVTDRDIVLRTVAEGSDASSENVRSIMTSTPVVASPDMDAREATKIMSEKQVRRLPVARDGKLVGMVSLGDFAVEGSTDNCAEKALSGISSPCCPKI

SEQ ID NO: 71532 - protein, 590 aa, Geobacter sulfurreducens PCA
MRLTPSSLLPEWLRSYRPADLLPDLAAGAVVAVILAPQGMAYALLAGLPPIMGLYAATVPLLAYALAGSSRHLSVGPVAIVSLLVHVACSKVAHAGSASYVSAALQLALLTGVLQLLLGTVRAGFMVNFLSRAAIGGFTSAAALLISLSQFKNLLGISGDGGESALELAAGVVRNIGTLHLLTSVMGLAAICMLLLLQRFAPRFPAPLAAIVLGIPLTALLHLDQAGVRTVGDLPHGLPPLSLPPFAADQILTLLPAAVTIALIGYLESFAVAGLIADREKYPIYPNRELVGLGIANVAAAFFSGYPVTGGFSRTAVNHRAGARTGLAGMITATLIGIILLHFTHLFHYLPKTILAAIVIVAVAGLVEAAEARYLFRVKPSDGYTFVLTFLVTLGFGVEAGIVAGVIFSLLVFIWRSAHPHIAELGWLEEEGVFRNIRRYPHAVVPRGMLLVRVDASLYFANMAFVGDWLRATLAERADVRQIIFDLSGVNDMDAVALAALEVIIEGHGERGIVVAFAGMKGPVRDLAQRAGWQERYGNLISFLSLNQAVRQMSTEDMILAGLHSKERESETCSVPATRPTGSTNHGDPA

SEQ ID NO: 71533 - protein, 308 aa, Nostoc punctiforme PCC 73102
MAVSVVKKLDKLTTTELSAWVQQAKIQAKQGRVLDRIPQLALADPDWFAVHVCCESGKNISFGDTACIFPLMSVIKTFSLLYLLEHFGAETVFSWVGVEPSDAPFNSLEQLVSDRGRPRNPMINSGAITLADKLPGKDATQRTLLFCQWLNQLAGCQLSLDEVMLASVRLTRSTANEAITNYLTETGYLENLEIALDTYEQICCISGRIKDLALLGKLLACDGLVNPQNRRIVNAVMLTCGLYEASAEFAVRIGLPMKSGIGGGLVAIVPGEGAIACYSPGLDNIGNPVAGLVFVEAFSQKLELSIFG

SEQ ID NO: 71534 - protein, 522 aa, Yarrowia lipolytica CLIB122
MLRRITLNQFKGGLRRLSTLTPVKNEPLTLPNGAKYEQPVGLFINGEFVKSQSGKRFETENPTTETPIISVYEAGEADANAAVEAAKNAFKNWGFKTAPSERGVLLNKLADLIERDLDLISAIETTDNGKVFAQAQGDVALVVKVLRYYAGFADKIGGDLVQTNDGFFNYTRKEPLGVCGQIIPWNFPLLMWAWKIAPALTTGNTVVLKTAESTPLSALYACKLSQEAGFPKGVLNVVSGYGPVGGVLSAHPDIKKIAFTGSTATGKQVAKTALTSNLKKTTMELGGKSPNIIFDDANLEDALSAAALGIFFNSGEVCCAGSRLFVQAGVYDQVVEAFKKKAESVKVGDPFDPNSLQGPQQNKNQFKKILGYIEQGQKEGAHLLCGGSAQAGPNKGYFIQPTVFTDVNNDMSIVREEIFGPVLTITKFNTVDEVIDMANDSEYGLAAGIHTTDINKAHYVAENIASGTIWVNCYNAFHEAVPFGGYKQSGFGKEMGRDGLENYLQTKAVRVKLDERKWADKQ

SEQ ID NO: 71535 - protein, 168 aa, Triticum aestivum
MAPTVMASLDSSVAPFQGLKSTDGLPVSRRSNGASLGSVSNGGRIRCMQVWPIEGVKKFETLSYLPPVSTEALLKQVDYLIRSKWVPSLESSKVGFIFREHNASPGYYDGRYWTMWKLSMCGCTDASQVINEVEEVKKEYPDAYVRIIGCDNMRQVQCVSFIAFKPPG

SEQ ID NO: 71536 - protein, 513 aa, Bacillus thuringiensis serovar konkukian str. 97-27
MFKKITIVGLSVVLFLPSIYGGSKVYADTINNGTLMQYFEWYAPSDGNHWNRLRTDAENLAQKGITSVWIPPAYKGTTQNDVGYGAYDLYDLGEFNQKGTVRTKYGTKAQLKSAIEALHKQNIDVYGDVVMNHKGGADYTETVTAVEVDRNNRNVEVSGDYEISAWTGFNFPGRGDNYSNFKWKWYHFDGTDWDEGRKLNRIYKFRGIGKAWDWEVSSENGNYDYLMYADLDFDHPDVANEMKNWGTWYANELNLDGFRLDAVKHIDHEYLRDWVNHVRQQTRKEMFTVAEYWQNDIHTLNNYLAKVNYNQSVFDAPLHYNFHYASKGNGNYDMRNILNGTVMQNHPALAVTLVENHDSQPGQSLESVVSAWFKPLAYGFILTRAEGYPSVFYGDYYGTSGNSSYEIPALKDKIDPILTARKNFAYGTQRDYLDHPDVIGWTREGDSVHANSGLATLISDGPGGSKWMDVGKNNAGEVWHDMTGNQTNTVTINKDGWGQFHVSGGSVSIYVQQ

SEQ ID NO: 71537 - protein, 551 aa, Clostridium perfringens str. 13
MYKPKLISLLDDKENGFSKEQFFKDLIAGIIVAIIALPLSIALGISSGVSPEKGLITAIIAGFIISLLGGSRVQIGGPTGAFVVIVFGIIQNHGVDGLIIATFMAGIILVLFGLLRFGSLIKYIPYPITVGFTSGIAVTLFSTQVKDFLGLSMTKTSSEFIPKWEAYISHMNTTNLYTLAIGLLALIILIFWPKINKKIPGSLIALIVTTLVVFIFNLPVATIGSQFGKISSNIPMPHIPNLNLNTLKALIGPAFTIALLGGIESLLSAVVSDGMIGDKHNSNAELIAQGIANMGSSLFGGIPATGAIARTAANVKNGGRTPISGIVHSITLLLIMLVFMPLAKFIPLTTLSAILIIVSYNMSEWRTFKAILKAPKSDIAILLTTFFLTVLFDLVIAIGIGMVVSMCLFMRRVATSIEVNELNESDCSDKSNIDTDMENLKVGENVLVYDIRGHLFFGAVDTFMNTMKEINDDAKVLVLRMRHTKTLDVTGYKQIKNIALSCKSRNMTLIISELQEQPKKVMRLMGFIDTLGEDHFATNFDEALEKANSLI

SEQ ID NO: 71538 - protein, 132 aa, Helicobacter pylori
SNIKYELDKESGALMVDRVLYGAQNYPANYGFVPNTLGSDGDPVDALVLSDVAFQAGSIVKARLVGVLNMEDESGVDEKLLALPIDKIDPTHSYVKDIDDLSKHTLDKIKHFFETYKDLEPNKWVKVKGFEN

SEQ ID NO: 71539 - protein, 295 aa, Elaeis guineensis
MTYMFKYDTVHGKWKHHYIKVKDSKTLLFGEKQVTVFGIRNPEEIPWGETGAEYVVESTGVFTDKEKASAHLKGGAKKVIISAASKDVPMFVVGVNEHEYKSDIDIVSNASCTTNCLADLAKAINDKFGIIEGLMSTVHSITATQKTVDGPTSKDWRGGRAASFNIIPSSTGAAKAVGKVLPALNGKLTGMAFRVPTVDVSVVDLTVRIEKSATYADIKAAIKEESEGRLKGILGYTEDDLVSTDFIGDSRSSIFDAKAGIALNDHFVKMVAWYDNEWGYSSRVVDLIRAMDSKK

SEQ ID NO: 71540 - protein, 302 aa, Oryza sativa Indica Group
MTSGAAAAAAAAGRTPTWKERENNKRRERRRRAIAAKIFTGLRALGNYNLPKHCDNNEVLKALCREAGWVVEDDGTTYRKGCKPPPSSAGGASVGMSPCSSTQLLSAPSSSFPSPVPSYHASPASSSFPSPSRIDNPSASCLLPFLRGLPNLPPLRVSSSAPVTPPLSSPTASRPPKIRKPDWDVDPFRHPFFAVSAPASPTRGRRLEHPDTIPECDESDVSTVDSGRWISFQMATTAPTSPTYNLVNPGASTSNSMEIEGTAGRGGAEFEFDKGRVTPWEGERIHEVAAEELELTLGVGAK

SEQ ID NO: 71541 - protein, 132 aa, Helicobacter pylori
SNIKYELDKKSGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 71542 - protein, 109 aa, Arabidopsis thaliana
MGNRRQQNLFVIASPDEIAKIHRAETSKQAGAIAGAKAAAVAAVASAIPTVAAVRMFPWAKANLNYTAQALIISSASIAAFFITADKTILQGARRNTEAQLKKVQQDSK

SEQ ID NO: 71543 - protein, 391 aa, Klebsiella pneumoniae subsp. pneumoniae MGH 78578
MPDFTASPLVDALEENLFSLLEKLAAEVNTEALPLIDLSSGSPDQPTPPEVIDSLQSAIHRRENHGYPSFWGKPQVREAIARFYRRQYDVELDPHSEVAVFQGSHIGIGGIPRALLSPGQYLISTDPCYPIYRSAALQSQAAFYGLPLRAENHFLPDFNDLPREVADKAGLVVLNYPHNPTGALATPALFASALQFARRHQVPILHDFAYAAIGSAASDAPLSLFSQPDAKAWGVETYTFSKTFNMAGWRFGFAVGNASIIRAFKKLHTHSYSTVFGAIQDAAIAALNLPAERIAQLTAVYHQRREWVLRRLAALRWPARDAQGTFFLWLGVPPGYRSQEFTRLLLQEANILVAPGTGFGAGGEGFIRISLTAGDEALSNALDRLARLALF

SEQ ID NO: 71544 - protein, 779 aa, Moritella sp. PE36
MNDVERVGGKNASLGEMISNLAGAGVQVPGGYATTADAFNQFLEQSGVNDKIYALLDDLNVDDIAALTKAGATIRQWVIDTPFQPELEAAIAQSYEVLAGEAGEQASFAVRSSATAEDMPDASFAGQQETFLNVRGYDNIIVAIKHVFASLFNDRAISYRVHSGYDHRGVALSAGIQRMVRSDEASSGVMFSIDTESGFEDVVFITSSYGLGEMVVQGAVNPDEFYVHKPTLAKGKPAVVRRNIGSKLIQMIYSADEGHGKQVQIVDVEASKSRQFSITDEEVMELAKQAVIIEKHYGHAMDIEWAKDAIDGKIYIVQARPETVRSREDKQVMVRFHLDAKSAVVTEGRAIGGKIGAGPAKVISSIAQMDEVKEGDVLVTDMTDPDWEPIMKRASAIVTNRGGRTCHAAIIAREMGIPAVVGCGNATDLIKNGQELTVSCAEGDTGFIYEGILPFRETSSVVANLPEIPVKVMMNVGNPDRAFDFAALPNEGVGLARLEFIINRMIGIHPKALLNFDKQSPELQAEINEMIAGYASPVEFYIAKLQEGISTLAAAFYPKKVIVRMSDFKSNEYANLVGGEFFEPEEENPMLGFRGASRYISEDFRDCFALETEAIKRVRNDMDLTNVEIMIPFVRTLSEAASVIDLLAEHDLKRGENGLRVIMMCELPSNALLADKFLQYFDGFSIGSNDLTQLTLGLDRDSGIISHLFDERNEAVKVLLSMAIKAAKKAGKYVGICGQGPSDHDDFAAWLVEQGIDSVSLNPDTVLSTWLYLADKHAK

SEQ ID NO: 71545 - protein, 511 aa, Oryza sativa
MAANQVANHDTHSLWLLNSAYIALLPKKTDALRVGDYRPISLIHAFRKLFSKLLANRLAPKLQQMVSTNQSAFIKGRNIQDNFLFVNNMVREFQSSKIPAILLKLDIAKAFDTISWPYLLDRLRYLGFGDRWIGWIISILATSSSKILLNGKAGNNFLHGRGLRQGDPLLPMIFILAIDPLQKLLAIVQEAGLLQPLHKWTARFNMALYADDAVVFLRPDKRELQTIQMILQNFGLATGMVREFILLWHQIQQVELHEGIDDAIVWRWTPNGSYSANSAYRIQFVGGIQDNRSDFFWKAKVYNDECEIAPEHEREEAPRTAKKLSWWALSFSLSNVWCKFYRKSQAWNSTASFSDVDEKNRKGGDAEDDFTHSRPDHVFRGVHRAIICGKVGQVPVQKILRNGHTVTVFTVGTGGMFDQRTVGAENLPMPAQWHRISVHNEQLGAFAVQNSAVYVEGDIETRVYNDRINDQVKNIPEICVRRDGKIQLMQSGDSNVGKSLEELTDDDTVLI

SEQ ID NO: 71546 - protein, 218 aa, Musa acuminata
MDENSLCYHQANFCQYVVNSCVVAGVYGDCGGAWVDEDYPPDPETESAKSRLAAEKGWLDLGHELGVTVNVFRLGGIYGPGRSALDTIIKGQSLSEAQKKRESRLFTARVHVADVYQAIKASMEILSSGRIYNVVDDDPAPRQEVFAFAQSLLEERWAGTVCKLDNNDMKPHKSLARCEKRVSNARLKEELGVSLLYPMYRLGLRNILESWDSVPKEP

SEQ ID NO: 71547 - protein, 527 aa, Trametes versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDANASLYDVDDDTTVITLADWYHTAAKLGPAFPAGPDSVLINGLGRFSGDGGGATNLTVITVTQGKRYRFRLVSISCDPNFTFSIDGHNMTIIEVGGVNHEALDVDSIQIFAGQRYSFILNANQSIDNYWIRAIPNTGTTDTTGGVNSAILRYDTAEEIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 71548 - protein, 616 aa, Musa acuminata
MQPGGSSYRIDDHDERKERRSDIENSEDERRTRIGSLKKKAINASTRFRHSLRKKNRRKSDSRVISVSIEDIRNIEELEAVDAFRQSLILDELLPAKHDDYHMMLRFLKARKFDVEKAKHMWDEMLQWRKDYGTDTIIEDFEYSELNEVLQYYPHGYHGVDKEGRPVYIERLGKVDPSKLMQVTTMERYLRYHVKEFERSFLIKFPACSIAAKKHIDSSTTILDVQGVSLKNFSKTARELIQRLQKIDNDNYPETLHRMFIVNAGSGFRLLWNTVKSFLDPKTTSKIHVLGARYQNKLFEIIEPSELPEFLGGCCTCAEQGGCLRSEKGPWKDPNILKMVLNGEAQCARQIVTVSNGEKKIIAYAKPQYPTIRGSDTSTAESGSEAEDITSPRPVRNHISHPCLTPVHEEAKMVKAASFSSGFPESDEYVPMVDKAVDGGWKKEISNKRLYASKGQCSDPETHKSPQGVRAQIIQFLVTIIVYLFTLVCSVSSCVSKRLHNEVFERDQHDPMFSVDPMVKEEYRHPSPAPAFTEADLLSRLLIRLGELEEKVNILQAKPSEMPSEKDELLNAAVCRVDALEAELIATKKALHEALMRQDELLAYIDRQEEAKMRVS

SEQ ID NO: 71549 - protein, 519 aa, Trametes versicolor
MGLQRFSFFVTLALVARSLAAIGPVASLVVANAPVSPDGFLRDAIVVNGVVPSPLITGKKGDRFQLNVDDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTTSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 71550 - protein, 286 aa, Vitis vinifera
MATASLGSSTLQSQINGFGVNKLQRSSLFQPTSFTFSRRKFSSTVKASARVDKFSKSDIIVSPSILSANFAKLGEQVKAVELAGCDWIHVDVMDGRFVPNITIGPLIVGALRPVTDLPLDVHLMIVEPEQRVPDFIKAGADIVSVHCEQSSTIHLHRTINQIKSLGAKAGVVLNPATPLSTIEYVLDVVDLVLIMSVNPGFGGQSFIESQVKKISDLRRICAEKGVNPWIEVDGGVGPANAYKVIEAGANALVAGSAVFGAKDYAEGMDSVNLNESERDVSFFIHK

SEQ ID NO: 71551 - protein, 520 aa, Trametes versicolor
MGRFSSLCALTAVIHSFGRVSAAIGPVTDLTISNADVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFALPSNSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNTTTPSTAWEDLCPTYNALDSSDL

SEQ ID NO: 71552 - protein, 529 aa, Pleurotus ostreatus
MFPGARILATLTLALHLLHGTHAAIGPTGDMYIVNEDVSPDGFTRSAVVARSDPTTNGTSETLTGVLVQGNKGDNFQLNVLNQLSDTTMLKTTSIHWHGFFQSGSTWADGPAFVNQCPIASGNSFLYDFNVPDQAGTFWYHSHLSTQYCDGLRGPFIVYDPSDPHLSLYDVDNADTIITLEDWYHVVAPQNAVLPTADSTLINGKGRFAGGPTSALAVINVESNKRYRFRLISMSCDPNFTFSIDGHSLQVIEADAVNIVPIVVDSIQIFAGQRYSFVLNANQTVDNYWIRADPNLGSTGFDGGINSAILRYAGATEDDPTTTSSTSTPLEETNLVPLENPGAPGPAVPGGADININLAMAFDVTNFELTINGSPFKAPTAPVLLQILSGATTAASLLPSGSIYSLEANKVVEISIPALAVGGPHPFHLHGHTFDVIRSAGSTTYNFDTPARRDVVNTGTDANDNVTIRFVTDNPGPWFLHCHIDWHLEIGLAVVFAEDVTSITAPPAAWDDLCPIYDALSDSDKGGIA

SEQ ID NO: 71553 - protein, 533 aa, Pleurotus ostreatus
MFPGARILATLTLALHLLHGAHAAIGPAGNMYIVNEDVSPDGFARSAVVARSVPATDPTPATASIPGVLVQGNKGDNFQLNVVNQLSDTTMLKTTSIHWHGFFQAGSSWADGPAFVTQCPVASGDSFLYNFNVPDQAGTFWYHSHLSTQYCDGLRGPFVVYDPSDPHLSLYDIDNADTVITLEDWYHIVAPQNAAIPTPDSTLINGKGRYAGGPTSPLAIINVESNKRYRFRLVSMSCDPNFTFSIDGHSLLVIEADAVNIVPITVDSIQIFAGQRYSFVLTANQAVDNYWIRANPNLGSTGFVGGINSAILRYAGATEDDPTTTSSTSTPLLETNLVPLENPGAPGPPVPGGADININLAMAFDFTTFELTINGVPFLPPTAPVLLQILSGASTAASLLPSGSIYELEANKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDDLCPIYNALSDNDKGGIVPS

SEQ ID NO: 71554 - protein, 405 aa, Moritella sp. PE36
MYSIEKSHKLDNVCYDIRGPVLKEANRLEEEGHRVIKLNIGNPAPFGFEAPEEIVKDVIHNLPSSQGYCDSKGLYSARKAVMQHYQQKGLLNISIDNIYLGNGVSELIMMSMQALLNNGDEVLVPSPDYPLWTAAITLSGGKATHYICDEESDWYPDLDDIKAKITPNTKGIVLINPNNPTGAVYNKEFLLEVVEVARQHNLIIFSDEIYDKILYDGVEHVPMCTLAQDILIVTFNGLSKAYRIAGFRSGWLVLSGATHLAKDYIAGLEMLASMRLCSNVPMQHAIQTALGGYQSINELILPGGRLLEQRDLAWKMLNDIPGITCVKPKGALYLFPKIDMEMFNIKDDQKFALDLLQQEKLLIVQGTGFNWSRPDHFRVVFLPRVEELTIAINKLANFLSTYRQA

SEQ ID NO: 71555 - protein, 408 aa, Clostridium acetobutylicum ATCC 824
MKKKFSRLLFIFSIVGPGLITANAGNDAGGVTTYSVIGSKYGYSMLWGLFAIGIGLAVVQEMNARMAVVTGKGLSDLIRERYGVKLAFFAMLVLMIANLGVCIADFAGIAASLQLFNINKYISVPILAIMIWIIMTKGNYSKAEKVFLLLTLTFFGYVITAFMLKPNWSNVFSHISNPGGTLSKNYWLDLIGMVGTTITPYMQFYLQSSIVDKGISLKEYGYEKLDVYLGTVWGILTALFITICTSETLFKAHMAISSAQDAAAALKPLAGQYSFVLFGVGLFGASFLACCIIPLSTSYAVCEAFGFESGLDNKIKEAPVFFGLFFFMIITSVIIVLMPNISLISIILFTQQLAGVLCPVVLIFMIKLVNDKEIMGKHTNNRLQNFIAKFTIGLIIILTILAFAGNFV

SEQ ID NO: 71556 - protein, 107 aa, Coprinopsis cinerea okayama7#130
MHTFNTSPPVDELTRAQNELNQVKSIMVQNVEQILSRGERIELLVDKTDVMAGQATAFRRGARAARRQMWWKNTRILIISCFVALFLLYLLAAQFCGAGLNHCTAPH

SEQ ID NO: 71557 - protein, 186 aa, Clostridium acetobutylicum ATCC 824
MFKSIRYDINRVLQNDPAARNGLEVFLLYPCIHALIWYRIAHVFYKHKMFFIARLLSQIVRAFTGIEIHPGATIGKGLFIDHGMGVVIGETAEIGDNVVMYHGSTLGGTGKETGKRHPTVGNNVFIGSGAKVLGPIKLGDGCKIGANAVVLKDVPSNSTAVGIPAKVILPSSKKEKVIDFNDYCNK

SEQ ID NO: 71558 - protein, 359 aa, Helicobacter pylori
MKVLSYLKIFYLFLLIGAIMQANENMGSQHQKTDERVIYLAGGCFWGLEAYMERIYGVIDASSGYANGKTSSTNYEKLHESDHAESVKVIYDPKKISLDKLLRYYFKVVDPVSVNKQGNDVGRQYRTGIYYVNSTDKEVIDNALKALQKEVKGKIAIEVEPLKNYVRAEKYHQDYLKKHPGGYCHIDLKKADEVIVDSDKYTKPSDEVLKKKLTKLQYEVTQNKHTEKPFENEYYNKEEEGIYVDITTGEPLFSSADKYDSGCGWPSFSKPINKDVVKYEDDESLNRKRIEVLSRIGKAHLGHVFNDGPKELGGLRYCINSAALRFIPLKDMEKEGYGEFIPYIKRGELKKYIQDKKTH

SEQ ID NO: 71559 - protein, 85 aa, Musa acuminata AAA Group
YIISGPVVAMVWAGKNVVVTGRKIIGATNPADSAPGTIRGDLAIEIGRNVIHGSDSIESASKEIALWFPEGVAEWQSNLHPWIYE

SEQ ID NO: 71560 - protein, 137 aa, Acidovorax sp. JS42
MTYPIQKTEDEWQALLQAKGAEPAAYQVTRHAATERPFSGKYEGHWADGSYHCVCCGAKLFDSDTKFDAGCGWPSFSLAVPGAIREIEDRSHGMVRTETVCAQCGAHLGHVFPDGPAPSGLRYCMNSASLDFEPPAP

SEQ ID NO: 71561 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFSGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 71562 - protein, 136 aa, Glycine max
MNQNPQSSEGRNDDDSALSDFLASLMDYTPTIPDELVEHYLAKSGFQCPDVRLTRLVAVATQKFVAEVAGDALQHCKARQATIPKDKRDKQQKDKRLVLTMEDLSKALREYGVNLKHQEYFADSPSTGMDPATREE

SEQ ID NO: 71563 - protein, 495 aa, Acidovorax sp. JS42
MTFAPTPDATPVAPLVPAWQPGFAALGSAFFTPLRPTPLPQPHWVGTSAEVGALLGLPEAWQQRDDALQAFTGNTLLPGSQPLASVYSGHQFGVWAGQLGDGRAILLGETATGQEVQLKGSGRTPYSRMGDGRAVLRSSIREFLCSEAMHALGIPTTRALCVTGSPAPVQREEVETAAVVTRVAPSFIRFGHFEHFAARGQEAELRALADYVIDRYYPDCRRSQEWEGNAYAALLHAVSERTAALLAQWQAVGFCHGVMNTDNMSILGLTMDYGPFQFLDAFDPGHICNHSDVRGRYAFDRQPSVAYWNLLCLAQALLPLIGEVDTARAALQSYEGSFGRQFLARIRAKLGLQQAREGDAALVDGLLRLLAADRVDYPIFWRRLSGAVATEDFEPVRDLFLDRAALDAWLLQYKELLALDGWALAADLMHKTNPRFVLRNHLGEQAIRAAKLGDFSELQTLQRLLARPFDDHPGHEAYAGFPPDWASSISISCSS

SEQ ID NO: 71564 - protein, 213 aa, Yarrowia lipolytica CLIB122
MQVFEWAFGKRQTPQEKLRKHQRALERTQRELDRERVKLEGQEKKLIADIKKSAKAGQTGACKVMAKDLVRTRSYIQKFYQMKTQLQAISLRIQTVRSNEQMMQSMKGATRLLQGMNKSMNLPQLTRIAMEFERENDIMDQRQEMMDDSIDDAMEDDEVESEDIVNQVLDEIGIDLGQSMGAVPDGIQGQQERVAVAEGGDDDLEARLGALRR

SEQ ID NO: 71565 - protein, 477 aa, Rhodopseudomonas palustris CGA009
MRRLRRIKILATLGPASSDSAMIRKLFEAGADVFRINMSHTPHDKMRELVKTIRNVESSYGRPIGILVDLQGPKLRLGSFANGPIQLNNGSNFVLDSIKEPGDETRVYLPHPEILAALKVGDALLLDDGKVRLICEETQGDRAVTRVVIGGKMSDRKGVSLPDTDLPMSAMTNKDRADLEAACETGIDWVALSFVQRAEDVVEAKRMIRGRAAVMAKIEKPQAIDRLEDILDVSDALMVARGDLGVEMPLERVPSLQKQMTRMARRAGKPVVVATQMLESMISSPVPTRAEVSDVATAVYEGADAIMLSAESAAGKYPVEAVSTMNRIGEEVERDVTYRTVVTAQRPDPEATAGDAIAGAARQIAETLDLSAIICWTSSGSTALRVARERPKVPVVAITPSLHTGRKLSAVWGVHCVVAEDAKDQDDMVERAGRIAFRDGFAKSGQRVIIVAGVPLGTPGATNMVRIAYVGPSDADV

SEQ ID NO: 71566 - protein, 341 aa, Zea mays
  misc_feature (91)..(91): Xaa can be any naturally occurring amino acid
  misc_feature (104)..(104): Xaa can be any naturally occurring amino acid
  misc_feature (220)..(220): Xaa can be any naturally occurring amino acid
  misc_feature (270)..(270): Xaa can be any naturally occurring amino acid
MAKIKIGINGFGRIGRLVARVALQSDDVELVAVNDPFISTDYMTYMFKYDTVHGQWKHHEVKVKDSKTLLFGEKEVAVFGCRNPEEIPWGXSVGAEYVVESTGXVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKXAVGKVLPVLNGKLTGMSFRVPTVDVSVVDLTVRLEKSATYDEIKAAVKAXEAEGSLKGILGYVEEDLVSTDFQGDSRSSIFDAKAGIALNGNFVKLVSWYDNEWGYSTRVVDLIRHMNSTN

SEQ ID NO: 71567 - protein, 513 aa, Francisella tularensis subsp. tularensis SCHU S4
MKTIMIKTTSSSGEDYYKNIFSAICDKDGFMTKTDILDILVESGISNDDPRITKLIAKLNKFCDIDKIDFDTFQEITFENIGLIEKAINKGFIIPNFKDFKKEIEAIYNETKKNETGRNANYIPQLARVDPNLFAVAFCSVDGQIITLGDYLQPYCVQSTAKTITYCIATEENGEDKVHQHVGREPSGITFNAIALNKYDLPHNPMINSGAIMMCSLIKPEWNLADRFEYITNVWQDLAGGEPIGFDNAVYHSEKETADRNYALAHFMKEVGAFPEGTNIHTALDFYFQTCSIQVNAKKMAKIMASIANGGVCPFTSKKIFSPTTIRNCLSMMYSCGMYDFSGEYAFSVGLPAKSGVSGALAIAIPNVGGFAIFSPRLDPNHNSVRGVEFSKRLIEKFSFHNYDHITHCDKINPVENRMVVESNLTFELIWAASAGDLSEIKRAVALGVDINKGDYDKRTALHLAAAEGHEDIVKYLIRKGADINAIDRWGKKPLDDAIMNNNISIIELLDRT

SEQ ID NO: 71568 - protein, 314 aa, Chlamydomonas reinhardtii
MEVDGTRQSASGLEWKLHPLVLINISDHHTRTRANTPGATAPGVPAPAVMGCLLGSQSGRSVDIRNSFEVRYAAGPDGTLDIDITYLLKKQEQYKQVFKNLDVVGWYATGAAITEGHRLAHRKISEVVESPVFLLLDPAVDHTRKDLPVSLYETELHLSPETGAPGMVFVKSPYSIETSDAERIGVDQVGRGTGWVGCVGGGVCVCTLSAQLVSLHSAIKMLLERLRVIHGAMGKVAGADGAAAEAAYPHSLLRQVSSLVHSLPACNTDAFNREYLTEYNDTLLTLYLASMRRGTHAANEMVDKFCLAYDKAGR

SEQ ID NO: 71569 - protein, 1464 aa, Coccidioides immitis RS
MSLVGNFGANDNRGAESAKDGVSSVVTREEEVHQLARQFTEQSTYSTTVQNRFAADPGSALDPNGDNFNARAWCKAMLRMHTEDNQAHPLRTLGVAFSNLNVHGFSSDADYQKSVGNVWLETLSLARKFISQRQRKIKILQSLDGLVEAGEMLAVLGPPGSGCSTFLKTIAGETYGLIVDKTSNINYQGVSAKQMANEFRGEGIYTAEVDVHFPKLTVGDTLFFAARARVPRHIPGGATVNQYATHMRDVIMAIFGISHTKNTIVGNDFVRGVSGGERKRVSIAEACLSMAPLQCWDNSTRGLDSANAIEFCKTLRMQTDINDTTACVSLYQAPQAAYDNFDKVLVLYEGRQIYFGRTTTAKQYFLDMGFACPDRQTDADFLTSMTSHLERVVQPGYEARVPRTPDEFAARWKASAERAQLVKDIEAYNAKFALGGEYLDKFKQSRRAQQAKAQRVSSPYTLSYVQQVKLCLWRGFKRLKPDPSITISSLVGNSIMALVIASIFYDLKADTNSFFQRSALLFFAVLMNAFGSGLEMLTLYAQRGIVEKHSRYALYHPSAEAFASMLMDLPYKTLNTITYNLVLYFMTNLRREPGAFFFFVFTSFILTLTMSMFFRSIASLTRTLVQALVPAAILILGLSMYTGFTIPTQYMLGWARWIAYINPISYGFESLMINEFHNRDFACVNYVPSGPGYAGIGPNNHVCSTVGSVPGQPYVNGDSYIESSYGYTASHKWRNVGIIFAFMFILMIVYLVATELVTEKKPKGEILVFRRGHKALKKSKSEDDVESGSGRSVVVEKSQSDDIAIIERQTAIFQWKDVCYDIKVGKEHRRILDHVDGWVKPGTLTALMGVSGAGKTTLLDVLATRTTMGVITGEILVDGKPRDESFQRKTGYAQQQDLHLNTSTVREALTFSALLRQPAHVPRQEKIDYVTEVIKLLEMTEYADAIIGVPGDGLNVEQRKRLTIGVELAARPALLLFLDEPTSGLDSQTSWAILDLLDKLKKNGQAILCTIHQPSAILFQRFDRLLFLQAGGRIVYYGDIGENSQILIDYFVRNGGPPCPPAANPAEWMLDVIGAAPGSHTDIDWYDTWRNSPEYRRVQEHLAKLKLESSQQVGLARTLSGQKREDKASYREFAAPFGAQLCEVQTRVFQQIWRSPTYIYSKTALCVSSSLFVGFSLFNTPNTIQGLQNQMFAIFMLLTLFGQLIQQIMPHFVAQRALYEARERLSKTYSWKAFMISNIVVELPWNSLMSVLMFICWYYPIGLNHNAEPTDSVTLRGVQMWLFIWTFLLFSSTFAHFMIAAFETAENAGNTGNLLFMLCLLFCGVLATPNQLPGFWIFMYRVSPFTYLVSGMLSVGISNTEVTCAPNEYLRFDPLNGTCGEYMEAYKATMGGYIENELATSNCNFCPISDTNVFLSSVSANYSDVWRNFGIMWVYIIFNIFAACALYWWVRVPKAKKPVAAKTN

SEQ ID NO: 71570 - protein, 366 aa, Brassica napus
MTMAAATFAKRLIGSRSSSCAATSVTRAFCSSTTPITATMFPGDGIGPEIAESVKQVFTTAGVPINWEEHYVSTEIDPRTQSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKLNEQAEQIHRAIINTIAEGKYRTADLGGSSTTTDFTKAICDHL

SEQ ID NO: 71571 - protein, 464 aa, Bordetella bronchiseptica RB50
MHRNTTRCTIALPGGSILKLQSLDDFLRRVAARDPQQAEFMQAVQEVMLSLWPFIEKHPHYAEHALLERLVEPERVIQFRVCWTDDQGQAQVNRAFRIQHSSAIGPFKGGMRFHPTVNLSVLKFLAFEQTLKNALTTLPMGGGKGGSDFDPKGKSDAEVMRFCQALMLELHRHLGPDTDVPAGDIGVGAREVGFMAGMMKKLSNSAASVFTGKGLCFGGSLIRPEATGYGTVYFAQEMLQRAGLSFDGMRVSVSGSGNVAQYAIEKAMALGAKVVTISDSCGTVIDEAGFTHEKLLALMHIKNDLRGRLDTYASQFGLRYEAGVRPWHVPVDVALPCATQNELDENDARTLIRNGVKCVAEGANMPATLDAAKAFIAAEVLYAPGKASNAGGVAVSGLEMSQNSARLPWTREQVDARLHAIMRDIHENCVRHGHGAGNYVNYVDGANIAGFVKVADAMRQQGLY

SEQ ID NO: 71572 - protein, 459 aa, Klebsiella pneumoniae subsp. pneumoniae MGH 78578
MTTQQEHQLKRGLKNRHIQLIALGGAVGTGLFLGIAQTIRMAGPSVLLGYAIAGVIAFFIMRQLGEMVVEEPVAGSFSHFANRYWGPFAGFMSGWNYWVLYVLVSMAELTAVGIYIQYWWPEVPTWLSAAIFFVVINAINLTHVKVYGELEFWFSIVKVAAIISMIAFGCYLLFSGHGGPAATVANLWQDGGFFPNGITGLVMAMAVIMFSFGGLELVGITAAEADEPHKTIPKATNQVIYRILLFYVGSLAVLLSLYPWRNVVEGGSPFVLIFHAIDSNIVANALNLVVLTAALSVYNSCVYCNSRMLFGLAQQGNAPRALLRVNHRGIPLTALAVSAVATALCVVINYVMPGKAFALLMALVVAALVINWAMICITHLKFRRAMQRAGKVTAFQSFAYPLTNWLCLLFLAAILGVMYLTPDIRISVCLIPVWLLILAAGYLLRRKSAPAPVAALEER

SEQ ID NO: 71573 - protein, 139 aa, Glycine max
  misc_feature (77)..(77): Xaa can be any naturally occurring amino acid
  misc_feature (91)..(91): Xaa can be any naturally occurring amino acid
  misc_feature (97)..(97): Xaa can be any naturally occurring amino acid
MAQKAQKNDTEFKVPEPIINPCTTTTTTTTSISEPSRFFDATTPATSSRSPKRSLPLDEESQTDQTTSSEPKRAVNXRCSGCRRRVGLTGXRCRCGXDLFCAEHRYSDRHDCSYDYKAAGREAIARENPVVKAAKIVKV

SEQ ID NO: 71574 - protein, 352 aa, Bacillus anthracis str. A2012
MSSMLTQEQIMNALKHVEDPELHKSIVELNMVRNIQMNGTEVKLEVVLTIQGCPLKAKIQQDIEESLYAIGASKVDLTFGSMTKEERADLTEKLKKNTRTETGMPNMLRPDSGVQFLTVTSGKGGVGKSTVTINLATALARMGKKVGILDADIYGFSIPAMMETNQKPTMIDQTAIPVVSHGVKIMSMGFFTEGNNPVMWRGPMLNKWIQNFLANTHWGELDYLLLDLPPGTGDVAIDVAAMIPQAKEIIVTTPHNVASFVASRVGVMAKHTKHEILGIVENMAYFEEQDGSKNYLFGKGGGEMLAEQLQTEVIAQVPFAKREENNGSSVYDEDSLVGEVFTSLAEDIIYKG

SEQ ID NO: 71575 - protein, 414 aa, Yersinia pestis CO92
MEQPSPVTRQSFDEWIVPTYAPADFIVVRGEGSTLWDQQGKSYIDFAGGIAVNALGHGHPAVRAALIEQADKVWHLGNGYTNEPVLRLAKQLIDATFAEKVFFCNSGAEANEAALKLARKYALDNFANKAGQQGEKNQIVAFRNAFHGRTLFTVSAGGQPKYSQDFAPLPGGIHHGIFNDLASAEHLITDQTCAVIVEPIQGEGGVLPADKEFLHGLRALCDRHNALLIFDEIQTGVGRTGELYAYMHYGVSPDVLTSAKALGGGFPIGAMLTTTKYASALSVGSHGTTFGGNPLACAVAGTVLSLINQPTLLAGVKARHQWFIDELAEINARHNVFAEIRGRGLLIGCVLNAQYAGKSKEIVQAAAQYGLIALIAGPDVVRFAPSLIISPKEIKEGLARLAMGIEQVCQKVTS

SEQ ID NO: 71576 - protein, 382 aa, Arabidopsis thaliana
KSLSSPNPQKMSNDKDSFNVSDLTAALKDEDRAGLVNALKNKLQNLAGQRSDVLENLTPNVRKRVDALRDIQSQHDELEAKFREERAILEAKYQTLYQPLYVKRYEIVNGTTEVELAPEDDTKVDQGEEKTAEEKGVPSFWLTALKNNDVISEEVTERDEGALKYLKDIKWCKIEEPKGFKLEFFFDTNPYFKNTVLTKSYHMIDEDEPLLEKAMGTEIDWYPGKCLTQKILKKKPKKGSKNTKPITKLEDCESFFNFFSPPEVPDEDEDIDEERAEDLQNLMEQDYDIGSTIREKIIPRAVSWFTGEAMEAEDFEIDDDEEDDIDEDEDEEDEEDEEDDDDEDEEESKTKKKPSIGNKKGGRSQIVGEGKQDERPPECKQQ

SEQ ID NO: 71577 - protein, 653 aa, Oryza sativa Indica Group
MNLDRALSRAIEYHLIHVIKAQKHITHPTTSRRLSDRKVARFEKNVTKRGSVPETVKKGNDYPVGPIVLGFFVFVVVGSSTLICCQAINPYMLINFSKKYMLLLRTLENRRGRFDVTLVKDSNGTDSLMLAEACRFLNQIHSNRFLSSASVFFLSDLQRISSAFTTRNLLVGLVNRDGVLFLPEMRRPKNKYGFVTAVLSSATPLLLGYDLVMVCGSATLPEPPGVKLLACVAVASCVLGALAAVGAQCVVGDRCTVLLSAAVLCAGALARGLATSFAAFEAGVFVNGVGMGLALMSVPAYAGELSPSSLHRGLTSHPDGFVCLGCILGGLCFSPRFLNLPVRVAWRLTVATGTAIPALLGFAVLLMPELPQWLLTKDHARRVLSRTLSLEDAELRLLETKTELGEPHDVGCDDTVATPAWRTRWREERALWLELLARPTEPVRRNIVSALVAKAFQQASGIGSMFLYVQRAFRDAGVPSDTRMTRALVAFGLVVFAFFAVSTVLLELAWLLVKALAGGCCPRRAPAPAPAPADHPSSPHAHRGGVAMGMKRRREQLKWARSLSATMLMSLMALVWLLLGPVQMADASSSSGWPRWLRTAVAAVNRAVRAAILWSFAWVYEVTAVYGNLLACSAIIVFAWFLVYFGVLGAKER

SEQ ID NO: 71578 - protein, 288 aa, Arabidopsis thaliana
MVGGVEELSIEQLASSISTYKEQLEQVRQLLSEDPRNSEYADMEKELKEVIALTEEVLATAKQNEISLSDAGVSAEATPGSPDLEGAWEKTGLRNDPIHEGKFPVGTKVQAVFSDDGEWYDATIEAHTANGYFVAYDEWGNKEEVDPDNVRPIEQNAIVEAERLAQATKNALKRKIEKAASSDYQTKTLPAKLKIDPNDPEDVKIAKRKKIHVVQNKKQNDWQQFQTTKAKTKKVGFFTGRKKESIFKSPEDPFGKVGVTGSGKGLTDFQKREKHLHLKSGNAEGTDE

SEQ ID NO: 71579 - protein, 251 aa, Coprinopsis cinerea okayama7#130
MTRSFFVGGNWKLNPTSLSAAKALVEALNKADLDPSTEVVVAPPALYLLPIQEIAGKAVKVAAQNAYFKESGAFTGEISPKQISDAGIPYVILGHSERRTLFHETSEVVALKTRAALDNGLKVILCIGETLKEREEGRTAAVCEEQLSAVVKQLKEEDWSNIVIAYEPVWAIGTGKVATTSQAQETHVDVRKYLATAVSPKVASETRVIYGGSVNAANSKDLASQQDIDGFLVGGASLKPEFVDIINARKA

SEQ ID NO: 71580 - protein, 445 aa, Glycine max
MATIKAVKARQIFDSRGNPTVEVDVILSDGTFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 71581 - protein, 351 aa, Thermococcus kodakarensis KOD1
MEGIRFAFLCREKPEPTGKKVAVIGAGPAGLAATGYLVCQGHEVHVYDKLPEPGGLMLFGIPEFRIPIYRVREGYKELEKVYNVKFFTRTKVCFGNPKESGDEFVERRIEFEEILKNYDAVLIATGTWNAYVPTIPGSDLEGVYPALEYLFRIKSAKLGHMDWSEVPPVEGRKVLVVGAGHSAVDAALESINLGAEKVYMSYRRTIREAPAGAYEINLLQQRGVKWLERTMPVRIIGENGRVRAVELVKTELSEPDETGRRRPIPIEGSNFQIEVDYMVCAVGQMPTPPFSKEMGIALDRKGRIVVDSRHMTSREGVFAAGDVVLGPSKVGRAVKDGLYAAESIHLWLMGR

SEQ ID NO: 71582 - protein, 180 aa, Synechococcus elongatus PCC 6301
MAEEKDKKQSSRRRNNRRTEKESEWQERVVQIRRVTKVVKGGKKLSFRAIVIVGNERGQVGVGVGKASDVIGAVRKGVADGKKHLVNVPLTRDQSIPHPSTGEGGAAQVLIRPAAPGTGVIAGGAVRTVLELAGVKNVLAKRLGSKSPLNNARAALEALSSLRTFQEVAQSRDIPVEQLY

SEQ ID NO: 71583 - protein, 231 aa, Haemophilus somnus 2336
MMQIKNNLAKINRQISQYCEQAKRHSSTVSLLAVSKTKPVEDILIAYQAGQTAFGENYVQEGVEKIQYFIEQHIQLEWHFIGPLQSNKTKLVAENFDWMQTLDREKIATRLNEQRPHYKQPLNVLIQINISAENSKSGIQPQEMLILAKHIQNLPHLRLRGLMAIPEPTDNITAQEQAFNQMKYLFTQLQLAFPDEKIDTLSMGMSDDMASAIKCGSTMVRIGTAIFGKRN

SEQ ID NO: 71584 - protein, 699 aa, Acidovorax sp. JS42
MTAEYQVHGDVAVITLNNPPVNGLGLATRQGIVDGLDRAQADAAVKAIVITGAGGAFSGGADIKEFGTDKSLQEPNLHSVINAVENCTKPVVAAIHTVCMGGGLELALGCHYRVAAPGCNVALPEVKLGILPGAGGTQRLPRVVGVEAALNMIVSGEPVKSEMIGAVPGQKLFDKMAASPESLAEEALAFAQSVADVRPLPLVRNLPCKHPEGDAYFQFARNMVKGMAKNFPAPAKCVDAVEAATKRKFADGLAYERELFINLMWTPESRALRHLFFAERAASKIPDVPSETPKRDIKKVGVIGAGTMGGGISMNFLNAGIPVTILEMKQEALDRGIGTIQKNYEAQVKKGKLKEDKYQQRMALLSTTLNYADLKDCDLIIEAVFEELGVKEAVFKQLDAVAKPGAILASNTSTLDVDKIAAFTQRPQDVVGMHFFSPANVMKLLEVVRGKATAKDVLATVMALAKKIKKTAVVSGVCDGFIGNRMIERYSQQAGFLLDEGCTPQQVDKAIEKFGFAMGPFRMGDLAGNDIGWAIRKRRAVEQPDMKYSKTADLLCEMGRFGQKTGAGWYDYQAGKRDAIPSDVVNQMIEEHRKALGITPRKVSDEEIVQRLVYALVNEGAKILEEGIASKSGDIDMVYLTGYGFPIHRGGPMHYASEVGLFNVVQSMKRFARNPLDDARAWEPAPLLARLAAEGKAFA

SEQ ID NO: 71585 - protein, 130 aa, Staphylococcus aureus
YTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 71586 - protein, 122 aa, Neisseria lactamica
MAITKEDILEAVGSLTVMELNDLVKAFEEKFGVSAAAVAVASSAGPAAAAEEKTEFDVVLASAGDQKVGVIKVVRAITGLGLKEAKDIVDGAPKTIKEGVSKAEAEDIQKQLEEAGAKVEIK

SEQ ID NO: 71587 - protein, 895 aa, Brassica oleracea
MEGQCRLSLASLLLLLLLLSATTLTSAADYSPTDNFFLNCGGSSDLPDTDNRTWIPDVKSKFLSSSADSKTSPAATQDPSVPDVPYMTARIFRSPFTYSFPVAAGRKFVRLHFYPNSYDGLNATNSLFSVSLGSYTLLKNFSAAQTAQALTFSFIVKEFIVNVEGGALNVTFTPESAPSNAYAYVNGIEVTSMPDLYSSTDGSLTVVGSSGGVTIDNSTALENVYRLNVGGNDISPSDDTGLYRSWYDDQPYIFGAGLGITETADPNMTIEYPSGTPTYVAPVDVYSTARSMGPTPQINLNYNLTWIFSIDSGFSYLVRLHFCEVAPNMTKINQRVFTVYLNNQTAEPEADVAGWTGGHGIPLHKDYVVNPPDGKGQQDLWLALHPNTKNNPEYYDAILNGVEIFKMNNSDGNLAGPNPIPGPQVTADPSKVLRPRTSQSKNHTAVVAGAASGAVVLGLIVGLCAMIAYRRRNRGENQPASDATSGWLPLSLYGNSHSGGSGKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAHGTMREHLYKTQNSPLPWKQRLEICIGAARGLHYLHTGAKHTIIHRDVKTTNILLDEKWVAKVSDFGLSKTGPALDHTHVSTVVKGSFGYLDPEYFRRQQLTDKSDVYSFGVVLFEALCARPALNPTLAKEQVSLAEWAPYCYKKGMLDQIVDPHLKGKITPECFKKFAETAMKCVLDQGIERPSMGDVLWNLEFALQLQESAEESGKGICSEMDMDEIKYDDDNCKGKNNSEKGCDVYEGNVTDSRSSGIDMSIGGRSLASEDSDGLTPSGVFSQIMNPKGR

SEQ ID NO: 71588 - protein, 200 aa, Zea mays
LIPRVLTRAQVTLGNILKESGQEGIPVNKTWRLNERHYGSLTGLNKSETAAKYGEAQVQIWRRSFDTPPPPMEPDHPYYNTIVKDPRYAEGPSEAEFPMFESLKLTIARTLPYWNDVIIPQLKEGKSIIIAAHGNSLRGIVKHLDNLSDDAIMALNLPTGIPFVYELDENFKPVVSMKFLGDEETVRKAIESVAAQGKAK

SEQ ID NO: 71589 - protein, 96 aa, Triticum aestivum
  misc_feature (21)..(21): Xaa can be any naturally occurring amino acid
  misc_feature (57)..(57): Xaa can be any naturally occurring amino acid
  misc_feature (74)..(74): Xaa can be any naturally occurring amino acid
DHPEIATSLESAFTVTFAKRXEQDIAELKSAIKELDSQLMPPSVQTRLLSLVPTIHXEFTRLNTLAEEIYRRDXSKLHENVAAVNSTPSSIHRKML

SEQ ID NO: 71590 - protein, 363 aa, Bordetella bronchiseptica RB50
MSSPRTYRIAAIAGDGIGREVMPEGLRVVRAAARRFGLDLDIVTFDWAHCDYYREHGQMMPDDWKAQLAGMDAIYFGAVGWPATVPDHVSLWGSLLKFRREFDQYINLRPVRLFEGVPCPLAGRQPGDIDYLVVRENTEGEYTSAGGVIYEGTEREIVIQESVYSRYGADRVLHYAYALADSRPRRRLTVATKSNGIAISMPWWDKRADAVGQQYPGVAVDKQHIDILSARFVLQPDRFDVVVASNLFGDILSDLGPATTGTIGLAPSANLNPEREFPSLFEPVHGSAPDIYGQNIANPVAMIWSGALMLDFLTEGAGAGRAAHDAIVAAIEQVLAHGPRTRDLGGTASTDAMGEAIAARLAA

SEQ ID NO: 71591 - protein, 474 aa, Corynebacterium glutamicum ATCC 13032
MNTAPFKLEADFASALPTMAAPWQGEEAPNPELVILNDDLAYSLGLDPTWLRTPEGVQFLLGLNPEPLTKAVAQAYSGHQFGQFVASLGDGRALLLGEARSADGVLHDIHLKGSGRTQFSRGADGRAVLGPVLREYIISEAMHALGVPTTRSLAVISTGRKIQRGSVAPGAVLVRVATSLIRVGSFQYSNISGGIELSQHLANYTITRHFPSLVAELSAPTPATYVSLFKAILQRQADTVGKWTRLGFVHGALNTDNTLISGETVDYGPCAFMERYRGDAKFSSIDTYGRYKFENQPMILGWNMARLVETLLPLLGATPDEGMTAAQEALVEFDDLCEQAIRKEFATALGLDESDTGTVEQFRELLYLHNPDITTLLRALTDNTAPPSGFEAFVHDWKTQDPDIEAMRAVNPLFIPRNHLVEAALADAVEGNLEKFHELLAAVTNPFDPTAGPDELRLPSEEGFEEDYMTFCGT

SEQ ID NO: 71592 - protein, 463 aa, Oryza sativa
MEAFVSGGAGGVGAAAVVGVFVAAAVVGGFVAAVALAERAGVIAPRKRPNAPPAVPGLPIIGNLHQLKEKKPHQTFTKWAEIYGPIYTIRIGASSVVVLNSTEVAKEAMVAKFSSISTRKLSKALTVLTRDKSMVATSDYGDFHKMVKRYVMSSTLGTSAQKKFRDTRDMMINNMLSTFHKLVKDDPHVPLIFRDVFKDELFRLSMIQSLGEDVSSVYVDEFGRDISKEEIYNATVTDMMMCAIEVDWRDFFSYLSWVPNKSFETRVFTAEARRTAVMRALIKQQKERIVRGEERLYQEIREVCGDETVTEEHLPRLPYLNAVFHETLRRHSPVPLIPPRFVHEDTKLAGYDVPAGTEMVINLYGCNMNKKEWESPEEWVPERFTGGRLEVADMYKTMAFGAGRRACAGSLQVMHIACTAIARFVQEFGWRLTEGDEEKVDTVQFTAYKLHPLHVHLTPRGRM

SEQ ID NO: 71593 - protein, 515 aa, Arabidopsis thaliana; identical to SEQ ID NO: 1063

SEQ ID NO: 71594 - protein, 465 aa, Corynebacterium glutamicum ATCC 13032
MSEQPASIKHYDLIIIGTGSGNSIPGPEFDDKSIAIVEKGAFGGTCLNVGCIPTKMYVYAADIAQEIQESARLGIDATVNSVDWPSIVSRVFDKRIDLIAQGGEAYRRGPETPNIDVYDMHASFVDSKTISTGIAGQEQLISGTDIVIATGSRPYIPEAIAESGARYYTNEDIMRLAQQPESLVIVGGGFIALEFAHVFEALGTKVTILNRSDVLLREADADISAKILELSKKRFDVRLSTAVTAVHNKADGGVKISTDTGDDIEADILLVATGRTPNGNQMNLDAAGIEMNGRSIKVDEFGRTSVEGVWALGDVSSPYKLKHVANAEMRAIKHNLANPNDLQKMPHDFVPSAVFTNPQISQVGMTEQEAREAGLDITVKIQNYSDVAYGWAMEDKDGFVKLIADKDTGKLVGAHIIGAQASTLIQQLITVMAFGIDAREAATKQYWIHPALPEVIENALLGLEF

SEQ ID NO: 71595 - protein, 265 aa, Brassica napus
  misc_feature (238)..(238): Xaa can be any naturally occurring amino acid
  misc_feature (245)..(245): Xaa can be any naturally occurring amino acid
MEFILGQALFLLFCFILSCFLIICTTRSRRKSFEAAATPPGPPRLPIIGNIHLVGKNPHHSFANLSKTYGPVMSLKFGSLNTVIITSPEAAREVLRTHDQVLSWRSSTNSIRSINHHEVSVAWLPPSARWRLLRKLSVTLLFSPQRIEATKALRLNKVKELVNFMNESSERDEPVDISRASFITALNIISNILFSVDLGSYDLKNSNEFQDAVIGVMEAIGNPDAANYFPFLGFLDRXGNRKAMXGCLRKVFRVFREFIDAKIAK

SEQ ID NO: 71596 - protein, 527 aa, Clostridium perfringens str. 13
MITVNNVSLRFGGRKLFEDVNLKFTPGNCYGVIGANGAGKSTFLKILAGEIEPNTGEVSIPAKTRVSVLKQDHYQYDDCEVLKTVIMGNPRLFEIMEEKDALYAKPDFSDEDGIKAAELEAEFADLDGWEAESEASSLLQGLGIGTELHYSHVRDLKGDEKVKVLLAQALFGKPDVLILDEPTNHLDIKAITWLENFLGNFEGTVIVVSHDRHFLNMVCTQICDVDFGKIKLYVGNYDFWYESSQLALQMAKDQNKKKEEKIKELQNFIARFSANASKSKQATSRKKLLDKITLDDIQPSSRKYPFVGFKPEREVGNDILEVNGISKTVDGVKLLDNVSFRVNKDDKIAFVGNERSITTLFKIINGEMEPDSGDYKWGVTITNAYFPKDNTEFFENCELNLVDWLRQFSDEKSESYLRGFLGRMLFSGEEALKQASVLSGGEKVRCMLSKLMLSSANVLTLDQPTNHLDLESITAVNNGLADYKSVLLFACHDHQFVETIANRIIELTPEGIKFDKVCTYDEYLETK

SEQ ID NO: 71597 - protein, 210 aa, Cenchrus ciliaris
STHASGPAHKEQLEERMARIKEDPSLKPILDEIENGGPSAMVKYWNDPEVLQKIGQAMGVNLPGDSSASTVLSGPEETEEEGGYDDESIVHHTASVGDAEGLKKALDGGADKDEEDAEGRRALHFACGYGELKCAEILLEAGAAVDALDKNKNTPLHYAAGYGRKECVDLLLKHGAAVTVQNLDGKTPIEVARLNNQDEVLKLLEKDAFL

SEQ ID NO: 71598 - protein, 370 aa, Aquifex aeolicus VF5
MIYFDNAATTPVLPEVKNFLCKALDIYGNPSSVHTLGKFARSEIETARKTIANYLKVKPENIIFNSCATEGNNTIIRTILNNKDRGNVVLSAIEHKSVKEAIKFWANKSIEIREIKVNKNGVIDLEHLYHLIDSNTILVCVMYVSNEFGTIQPIQEIAKICSDKGVPLLTDAVQAIGKIPIELKNISYATFSGHKFHAIKGSGFLYISDEANYEPLIVGGGQENGKRSGTENVVGILSLAKALEIIVSNFSRYQEQLKKLRDLFENLLLEALPDAQIVGKDAERSPSISSVIMPKFFGAEIVNKLSEKGIYCSTGSACLSGEYEPNKHMLKMGFSQEKALRMVRFSFGLLNKEEEVIECIERIKEIYRLN

SEQ ID NO: 71599 - protein, 352 aa, Brassica napus
MANCSGDSSDVASQFDILRCPFLRNINEPTNLSFSSSLPFPIPARAGQGPIFEDGPNFDTAFRLFHGQDGVVPLSNSARAEAEKKPEPVFNPLAAKAATISLSSFGPGGPFGFDAFSDMFKNQKRKSDSSKNNKDSSKGGSHEAMSDDWLQTGNCPIAKSYRAVSGVAPLVAKILQPPPGMHYKCPKAIVAARAAISKTAFAKNLRPQPLSSKVLVIGMLGMALNVPLGVWREHTEKFSASWFIALHAAVPFIGILRKSVLMPKMAMVFTIAASVMGQVIGSRAERYRLKSVAQKKMTLSGSPNPSSVEATPMEFPGVSSDGRCGDKVVMKWNPMLLEAASPVSTGATNVVC

SEQ ID NO: 71600 - protein, 390 aa, Gloeobacter violaceus PCC 7421
MKAVCWHGAGDVRVETVPDPAILYPRDAIIKVTSTAICGSDLHLYDGVIPTMQKGDILGHEFMGEVVEVGAAVKNLRKGDRVVVPFTIACGHCHFCERTLWSLCDNSNPNAWMAEKVYGSTSGSGLFGYSHLFGGYAGGQAEYVRVPFADTGPMKVPESLTDEQVLFLTDIFPTGYMAAENCNIQPGDTVAVWGCGPVGQFAIKSAYMLGADRVIGIDRHPKRLKMAKEQGGAEVLNLDEVEVGEALKEMTGGWGPSHCIDAVGLEAHGSGIEGIYDNVMNALKLETDKPAALRQAIVACRKGGTVSIPGVYGGLLDKMPMGAAFAKGLTFKMGQTHVHRYLQPLLERIVQGELDPTFVITHRLKLDDAPEGYRTFRDQKDDCIKVVLKP

SEQ ID NO: 71601 - protein, 489 aa, Klebsiella pneumoniae subsp. pneumoniae MGH 78578
MVSETKTTEAPTLRRELKARHLTMIAIGGSIGTGLFVASGATISQAGPGGALLSYILIGLMVYFLMTSLGELAAFMPVSGSFATYGQNYVEEGFGFALGWNYWYNWAVTIAVDLVASQLVMSYWFPDTPGWIWSALFLGIMFLLNWISVRGFGEAEYWFSLIKVATVIIFIIVGVMMIVGIFKGAQPAGWSNWGIADAPFAGGFSAMIGVAMIVGFSFQGTELIGIAAGESENPEKNIPRAVRQVFWRILLFYVFAILIISLIIPYTDPSLLRNDVKDISVSPFTLVFQHAGLLSAAAIMNAVILTAVLSAGNSGMYASTRMLYTLACDGKAPRIFSKLSRGGVPRNALYATTVIAALCFLTSMFGNQTVYLWLLNTSGMTGFIAWLGIAISHYRFRRGYVLQGNDINNLPYRSGFFPLGPIFAFVLCLIITLGQNYEAFLKDTIDWGGVAATYIGIPLFLVIWFGYKLAKGTRFVRYSEMTFPDRFKR

SEQ ID NO: 71602 - protein, 555 aa, Atriplex gmelini
MWSQLSSLLSGKMDALTTSDHASVVSMNLFVALLCGCIVIGHLLEENRWMNESITALLIGLATGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVVNDATSVVLFNAIQSFDLTRIDHRIALQFMGNFLYLFIASTILGAFTGLLSAYIIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNFAKKSQSEKVTFNQQIVIWWAGLMRGAVSMALAYNQFTRSGHTQLRGNAIMITSTISVVLFSTMVFGLLTKPLIMFLLPQPKHFTSCSTVSDVGSPKSYSLPLLEGNQDYEVDVGNGNHEDTTEPRTIVRPSSLRMLLNAPTHTVHHYWRKFDDSFMRPVFGGRGFVPFVPGSPTEQSTNNLVDRT

SEQ ID NO: 71603 - protein, 428 aa, Lactobacillus johnsonii NCC 533
MTVYVEKVRALEIFDSRGNPTVEVHAYLSDGTVAKAEVPSGASTGEKEAVELRDGGNRLQGKGVTQAVTNVNGPINDALKGLSPYNQAEIDRTMIKLDGTLNKAKLGANAILGTSMAIARAAARSKDEPLYRYLGGCELEMPQTFHNVINGGKHADNGIDIQEFMITPVAKNSFRDGFEKIVNTYHALKAVIEEAGFETGLGDEGGFAPNLNSSEEALKMLRKAIIKAGYKPRKDIAIAFDAAASSFYNTEDGKYHFEGHIWNGEEMLQYYDKLLKEFPEIISCEDPFDENDWENFEKFTAKFGSTHQVVADDNVCTNPKLVRKAIKDKLCNSILIKLNQIGTITETLETIRLARKNNMTTMVSHRSGETGDTFIADFTVATNAGQLKSGAPARSERVEKYNRLLEIENQIGVENERLNHFPNNVDFD

SEQ ID NO: 71604 - protein, 334 aa, Clostridium acetobutylicum ATCC 824
MAKIAINGFGRIGRLALRRILEVPGLEVVAINDLTDAKMLAHLFKYDSSQGRFNGEIEVKEGAFVVNGKEVKVFAEADPEKLPWGDLGIDVVLECTGFFTKKEKAEAHVRAGAKKVVISAPAGNDLKTIVFNVNNEDLDGTETVISGASCTTNCLAPMAKVLNDKFGIEKGFMTTIHAFTNDQNTLDGPHRKGDLRRARAAAVSIIPNSTGAAKAISQVIPDLAGKLDGNAQRVPVPTGSITELVSVLKKKVTVEEINAAMKEAADESFGYTEDPIVSADVVGINYGSLFDATLTKIVDVNGSQLVKTAAWYDNEMSYTSQLVRTLAYFAKIAK

SEQ ID NO: 71605 - protein, 397 aa, Clostridium acetobutylicum ATCC 824
MKFNKKTIEDVDVKGKRVLVRCDFNVPLKDGVITDENRLNGALPTIKYLSEHGGKVILCSHLGKAKGPDPSKTLAPVAKRLSELLGREVKFAADDTVVGENAKKAVAELKEGEIVLLENTRFRPEEGKNDDAFSKDLASLADVYVNDAFGTAHRAHCSTVGVTKFVDTAVCGYLIQKELKFLGSAVENPVRPFVAILGGAKVSDKINVINNLLEKVDTLIIGGGMAYTFLKAQGYTIGTSLLEADKVDYAKEMIEKAEAKGVKLLLPIDNIVGAEFKADTKAVTTEDANIPEGYMGLDIGPKTQKLYADAVKEAKTVVWNGPMGVFEFENFAKGTKDVAKAMAESDATTVIGGGDSAAAVNQLGFGDKMTHISTGGGASLEFLEGKELPGIVALNDK

SEQ ID NO: 71606 - protein, 248 aa, Clostridium acetobutylicum ATCC 824
MRTPIIAGNWKMNNTISESLKLIEELKPLVKDAKAEVVVAPTAVSLETVVNATKGSNIKVAAQNAHFEESGAFTGEISLKALEELGVSYVILGHSERRQYFNETDCALNKKVKAAFAHNITPILCCGETLEEREANVTNEVTGKQIKLDLAGLSAEQAAKVVIAYEPIWAIGTGKTATDEQANETIGAIRKTVEVMFGKEVAEKVRIQYGGSVKPNTIKAQMAKPEIDGALVGGASLKAADFAAIVNF

SEQ ID NO: 71607 - protein, 379 aa, Chromobacterium violaceum ATCC 12472
MSHDIIRCQAAVAWAAGQPLSIEEIEVHPPKAGEVRVKMVATGVCHTDAFTLSGADPEGVFPCILGHEGGGVVESVGPGVTSVAVGDHVIPLYTPECRECKFCLSGKTNLCQKIRATQGKGLMPDGTSRFSKDGKPIYHYMGTSTFSEYTVLPEISLAKVNKAAPLEEVCLLGCGVTTGMGAVVNTAKVKAGDNVAVFGLGGIGLSAIIGARMAGAGRIIGIDINEGKFELAKKLGATDCVNPNGFDKPIQDVIVEMTDGGVDFSFECIGNVKVMRAALECCHKGWGESVIIGVAGAGQEISTRPFQLVTGRVWRGSAFGGVRGRTELPEYVERYLKGEFRLDDFITHTMPLERVNEAFDLMHEGKSIRSVIHYAAEPA

SEQ ID NO: 71608 - protein, 311 aa, Rhodopseudomonas palustris CGA009
MSNQLLDRVVAEIADEMAQRADRGEVASYIPELARVDPKAFGLAVIGADGHIAAAGDADVPFSIQSISKVFTLTLALGKAGDRLWRRVGREPSGSAFNSIVQLEHERGIPRNPFINAGAIAVTDLILSGHQPREALGEILRFMQFLAGDSSIAIDEAVAKSEQRTGFRNAALANYMKSFGVLDNPVEYTLGVYFHHCAIAMSCRQLAMAGRFLAHNGQNPSTGLNVVSSERARRINALMLTCGHYDGSGEFAYRVGLPGKSGVGGGILAVAPGRASIAVWAPGLDAAGNSHLGRVALEGLTKRMGWSIFGV

SEQ ID NO: 71609 - protein, 551 aa, Rhodopseudomonas palustris CGA009
MYAYDDIDRAIVHERVEEFRDQVSRRLSGELTEDEFKPLRLMNGVYLQLHAYMFRVAIPYGTLSSAQLRKLAHVARTYDRGYGHFTTRQNIQFNWIALKDLPDALADLAEVGIHAMQTSGNCTRNVTADQWAGVAPGEVEDPRVWAEILRQHTALHPEFSFLPRKFKFAITASDHDRAAIKIHDIGLKLVKNDAGETGFEVLVGGGLGRSPFIGRTIKSFVAGRDILSYIEAVLRVYNQYGRRDNIYKARIKILVHELGIEKFAAEVEQAWAEIADGPLTLDHEMIEDIRSRFIYPAYEKLPAEPDELRAAAGDARFEAWRNNSVAPHRHDGYAIVTLSLKPAGGPPGDATAEQMDAVADLADKYSFGEIRVGHEQNLVLPHVARRDLPALWAALDKLGLATPNVGLVSDIIACPGLDYCSLANARSIPIAQELSRRFASPETAALIGRLHINISGCINACGHHHVGHIGILGVEKNGEEFYQITIGGRADEGAELGELIGPAVPYGEVADVIEDIVEAYLSLRQRPDELFVDAVKRLGVEPFKERVYATR

SEQ ID NO: 71610 - protein, 244 aa, Triticum aestivum
  misc_feature (151)..(151): Xaa can be any naturally occurring amino acid
MATTDAAAAAAAAAPAAAAAPAPAVSLDETKAKNVLRQVEFYFSDSNLPRDGFLRKTVEESEDGLVSLALICSFAKMRSHLGLDATVKEDGVPETTVLAVAKVLRCSAALRVSEDGKRVGRANELLKPDEIIVQIDSRSIAVSPLPHKRKXLEDVQSFFAQYGKVNSVRLPKHVSDKRQFCGTALVEFSEEDEANNIMNNKLSFAGADLEIKTKKEFDAEMEAKKEAYEKSHPNAHPNKNGHDE

SEQ ID NO: 71611 - protein, 149 aa, Glycine max
VKKDDKSPSENDKEPVSREDFKEYFAKFGTVRYVDFSKGDDSGYLRFEESTAAEKARAFAALADEGGLVMKGHLVTLEPVSGQAEKDYWSGIKGGQGRFNNNNRSNRGGRDWKNNSGGGGRHHGGGKRGGRHSDNHERANKVQKLDSSP

SEQ ID NO: 71612 - protein, 271 aa, Pseudoalteromonas tunicata D2
MVLMRHQIWQQLKVEATELVKKEPLLASHVYSCILNHECLGSALSFIVANKLSDAVVSPFTFRELFDQAFVDCDRMLTHVSHDIKAVKDRDPAADSYLSILLNLKGFQAIQVHRLAHCLWRQDRKELARFIQSRNSEVFGVDIHPACKIGHGIMFDHATGIVIGETAVIEDNVSILQGVTLGGTGNEQGDRHPKIREGVMIGAGAKVLGNIEVGQGARIGAGSVVLSAVAPHTTVVGVPAKVVGRPCNRPAETMDQNVLEQSDDSLTSALL

SEQ ID NO: 71613 - protein, 294 aa, Corynebacterium glutamicum ATCC 13032
MVTMSKMRAPLVPGIPTPIREVPAHIERPEYVWKDEVQEAIGEPFVQAPEVIEKMRETSRIAANSLKIAGEAVKPGVTTDELDRIVHEYTCDMGAYPSDLGYRGFTKSSCISLNEIVCHGIPDSTVIEEGDIVNIDVTAFKHGVHGDCNATFLAGDVSEEHRLLVERTEEAMMRSIRAAKPGREINVIGRVIESYAKRFGYNVVRDFTGHGIGPTFHNGLVVLHYDNTQYRDLLVPGMTLTIEPMINLGSLDYEIWEDDWTVQNVDRKFSAQFEHTIVITEDGNEILTLPDDSV

SEQ ID NO: 71614 - protein, 139 aa, Staphylococcus aureus
AEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 71615 - protein, 421 aa, Arabidopsis thaliana
MTKGGLGIAAMSYVAIDYMRYVSPVWHSRLIPVLWSVLAIAVVTRVLFYKHWSKELRAAIPFLGSIVFLLCALLFEALCVRSVTAVLGLDWHRETPPLPDTGQWFLLALNENLPGTLVEILRAHIIGLHHFLMLFIMLGFSVVFDSVKAPGLGLGARYIFTMGVGRLLRAITFVSTILPSARPWCASARFNNVPSQPHRWAQKYYVPYANDPTAIRKLLHWDAAYADPGSYIGDYRADWGSMSFLNEFLRPSYSEGPSWFALLKKAGGGCNDLMYSGHMLVAVLTAMAWTEAYGGFSSAMIWLFVAHSAQREIRERHHYTVDCIVAIYVGILLWKMTGFIWSAERKTKQTKLEKIQNSLIHAAKDGDIETVRRLVEEIEVSSRVEKQSKVISNRTMTVFACATVITTLTIVILALTLTSDG

SEQ ID NO: 71616 - protein, 470 aa, Oryza sativa Indica Group
MEADSGKLFVGGISWETDEDRLREYFGRFGEVTEAVIMRDRNTGRARGFGFVVFTDAGVAERVTMDKHMIDGRMVEAKKAVPRDDQSITSKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPAARSPAGGQNYAMSRVHSFLNGFNQGYNPNPIGGYGMRVDGRYGLLTGARNGFSSFGPGYGMGMNSESGMNANFGANSSFVNNSNGRQIGSFYNGSSNRLGSPIGYVGLNDDSGSLLSSMSRNVWGNGNLNYPNNPTNMSSFAPSGTGGQMGITSDGINWGGPTPGHGMGNISSLGLANLGRGAGDSFGLPSGSYGRSNATGTIGEPFSAPPNAYEVNNADTYGSSSIYGDSTWRFTSSEIDMPPFGNDLGNVDPDIKSNIPASYMGNYTVNNNQTSRGQ

SEQ ID NO: 71617 - protein, 151 aa, Oryza sativa
STPARIHGLSGTVMAERELIDKDKLILRGLQFHGFHGVKQEEKTLGQKFVVDVDAWMDLSAAGETDSISDTVSYTDIYRIAKDVVEGPSRNLLEAVAHRIASATLLKFPQISAVRVKVGKPHVAVQGIVDYLGVEILRYRKNVGGDRQELH

SEQ ID NO: 71618 - protein, 342 aa, Aquifex aeolicus VF5
MAIKVGINGFGRIGRSFFRASWGREEIEIVAINDLTDAKHLAHLLKYDSVHGIFKGSVEAKDDSIVVDGKEIKVFAQKDPSQIPWGDLGVDVVIEATGVFRDRENASKHLQGGAKKVIITAPAKNPDITVVLGVNEEKYNPKEHNIISNASCTTNCLAPCVKVLNEAFGVEKGYMVTVHAYTNDQRLLDLPHKDFRRARAAAINIVPTTTGAAKAIGEVIPELKGKLDGTARRVPVPDGSLIDLTVVVNKAPSSVEEVNEKFREAAQKYRESGKVYLKEILQYCEDPIVSTDIVGNPHSAIFDAPLTQVIDNLVHIAAWYDNEWGYSCRLRDLVIYLAERGL

SEQ ID NO: 71619 - protein, 342 aa, Gloeobacter violaceus PCC 7421
MNLKPIEQQVVVVFGASSGIGRASALQFAGRGASLVVAARSEGGLASLVAEVRRFGTQVVPIVADAADFAQVSRVADLAVESYGHLDTWVHAAATAVIGRFEETTAEEFRRVVDVSLLGQVYGAMAALPHLKRTGGGALIHVSSVEGRRAMPLMAAYAAAKHGVEGFLESLRLELRKDGVPVSVTSILPSVINTPFYNKARSKLGVKPSGVPPYYQPELVADAIVFAAQHPVRELIVGDSGRVLDWLQRLSPPLLDKLLEWTAFDLQRTQQPKSPGDPDNLFTPIDSEQGYDRSRGDFSHLAIPSLLDWTDRYPAVAAALGAFALLGLVGLLRPRVNEQVSK

SEQ ID NO: 71620 - protein, 558 aa, Listeria monocytogenes EGD-e
MVQLFSAFDRETIERNLQEEKFDLVIVGGGITGAGIALDATSRGMSVALVEMGDFASGTSSRSTKLVHGGLRYLQQFEIKEVADLGKERAIVYENGPHVTTPEWMMLPFHKGGNMGKTTASFGIRLYDYLAGVKKNERRKILSAKETLAKNPFVKKDGLKGSGYYVEYRTDDARLTIEVMKKAVELGANAINYTKAEHFLYDDNKQVVGVTVTDRLSGKAYDIKGHRVINAAGPWVDKVRKLDYATNNKHLRLTKGIHLVIDKQKFPMEQAVYFDTPDGRMVFAIPRDKKVYVGTTDTVYDEAVINPKALESDHNYVIKAINYMFPDVHITEKDIESSWAGVRPLIYEEGKDPSEISRKDEVWFSESGLITMAGGKLTGYRKMAEKLLDDVSKTLAKETGKKYKTVQTKHLPISGGDIGGSEQLEAFLSKKAKEGNNRFGWTLEEGREMAKRFGSNIDQLFTYAQEHKEQNETTLPNSLYAELRYSIQHEAVTTPIDFLLRRTGYLLFDMPYLLEWKDAVVDEMAKQFHWSDDVKQTYIEELNIQINDAREPADWHDR

SEQ ID NO: 71621 - protein, 327 aa, Aquifex aeolicus VF5
MKKVLVTGGAGYIGSHVVKALGEKGYEVLIYDNLSTGNEWAVLYGKLVKADLADKETLRRVFEEFKPDAVMHFAAYIVVPESVKEPLKYYRNNVVNTINLLEVMQEFGVNKFVFSSSAAVYGIPESIPVKEDAPLNPINPYGETKATVERILRDLKNSGKDFNYVSLRYFNVAGADPEGKIGFAYPNPTHLIIRAVKTAAGEFDRLEIYGTDYPTPDGTCIRDYIHVTDLAEAHILALEYLFSGGKSEVLNCGYGHGYSVLEVVNAVKKVTGVDFKVVEAPRREGDPPALVADNKKIKRVLNWEPKYDDLEFIIKTAWEWEKKFKLK

SEQ ID NO: 71622 - protein, 141 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTSEFSPDAETDNVDIDAIPNDKMALDIGPKTSELLR

SEQ ID NO: 71623 - protein, 93 aa, Gloeobacter violaceus PCC 7421
MSTETLERKSVQRKPMPLYKVLLHNDDHTPMNYVIEVLMKTIPKMQPSKARKIMLEAHNGGVAVVIVCALEHAEFYSESLNRHNLTSTYEPDC

SEQ ID NO: 71624 - protein, 142 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTAEFSPDAETDNVDIDAIPNDKMALDIGPKTSELFAD

SEQ ID NO: 71625 - protein, 250 aa, Exiguobacterium sibiricum 255-15
MIITKAPREIDIMRQAGQIVARTHKELKAHIRPGITTGQLDAIAERYIRSQGATPSFKGYNGFTGSICASVNEELVHGIPGDRVLHDGDIISIDIGAEYNGYHGDSAWTYPVGTISEETKRLLDVTEESLYKGLERAKAGVHLTDISHAIQSHVEAANFSVVREYVGHGVGQNLHEDPQIPHYGPPGKGPRLKTGMTLAIEPMVNVGKRYVRTLSDNWTVVTVDGSMCAHFEHTIAITDEGYEILTVDAE

SEQ ID NO: 71626 - protein, 335 aa, Myxococcus xanthus DK 1622
MKHVTHIKDLGPEGVEAVLAQAAAWKQKGPEHALFANTLLGMVFFNPSLRTRTSFEAVMLRGGGNAIILDVGSGVWKLEHREGAVMNADRAEHLKEAAPVLSRFVDMLGVRTFSQGGGDEEDELDPVINAFRKWSTVPVVSMESAREHPCQGLADMLTLRETFGNTKKLPVTLTWAPHIKPLPKAVPNSFLLSAAAAGCEIRVAHPPGFDLHPAVRAEAEAYAKATGGSVTYTHDQDEALAGSRAVYAKSWGPTAAAAFSPNDVSALLASYSGWMPTRLTMSRAQKDAAFLHCLPVRRNVEVADEVLDHPSSRVVDEAGNRYHVQRALLHWMRSR

SEQ ID NO: 71627 - protein, 508 aa, Coprinopsis cinerea okayama7#130
MLQIQRLARRNASSSARRLRQASVQVCAWQSSRGYASASEPYDVVVIGGGPGGYVAAIKAAQMGLRTACVEKRGALGGTCLNVGCIPSKALLNNSHLYHQAKHDFARRGIDVENVSLNLPKFMEAKDSAVTGLTKGIEFLFKQNKVDYIKGAASFVNANKISVDLLDGGKSEVDAKNFVIATGSEVAPFPGGAIPIDEEQIVSSTGALSLTKVPEKMVVIGGGIIGLEMGSVWSRLGAEVTVVEFLGAIGGAGIDEEVSKQFQRLLTKQGLKFKLNTKVVSAEKKDGKVFLKAEAAKGGKEETLDADVVLVAVGRRPYTDGLNLEAAGVELDNRGRIVIDDQFTTSAKNIKCIGDVTFGPMLAHKAEEEGIAAVEFIKHGHGHVNYGAIPSVVYTHPEVAWVGQTEQDLKAAGVKYNIGKFSFSANSRAKTNLDSDGFVKFLSEKETDKILGIHIIGPNAGEMIAEGVLAIEYGASSEDVARTTHAHPTLSEAFKEAAMAAYSKPIHM

SEQ ID NO: 71628 - protein, 202 aa, Oryza sativa Japonica Group
MATDGHITHFAHPQHLLLKTRYDSTSRHVCDICRAKLSGLVGYRCNACDFDIHQACADYFKKTISFFAHPWHTLTLSSIPDGSTTWSCDLCRENCPRGNFVYRCIQCAFDVHPLCILLPQTIRSPLHQQHDIHMVPSWGRCSACREDLDLWYYQCGFCLFKLHIRCVSGAPSGVGQGSGPSGVRPCLVQEIFLDLVDIRTHI

SEQ ID NO: 71629 - protein, 274 aa, Zea mays
MAKLMNKLVDSFEHDEILDVGCVRAVLAELVLTFLFVFTGVSAAMAAGKDRSFSPFMKRTWLCTRAGSDGKPGDAMPMATLAAVAIAHALAAGVLVTAGFHVSGGHLNPAVTVGLMVRGHITKLRAVLYVAAQLLASSAAYVLLRFLSGGMVTPVHALGRGISPMQGLVMEVILTFSLLLVTYAMILDPRSQVRAIGPLLTGLIVGANSLAGGNFTGASMNPARSFGPALATGDWTNHWVYWIGPLLGGPLAGLVYESLFLVQKMHEPLLNGEV

SEQ ID NO: 71630 - protein, 184 aa, Triticum aestivum
  misc_feature (48)..(48): Xaa can be any naturally occurring amino acid
  misc_feature (76)..(76): Xaa can be any naturally occurring amino acid
  misc_feature (95)..(95): Xaa can be any naturally occurring amino acid
GRACLPCCGYGNLRLSRFGRALFRGIFVQNLQSCNFLLDDNDHAVLGXFGIPSLLFGLPLPNPDLIQRRGTPNYMXPEHWRPDIRGPISYETDSXWGFAWSILEMFSGVQTWCAKSPDEIYQSVVLKKEKPMFLYNLPMEVANVLSGCYEYEFRDHSLMLDILQSFERLEVTRERWQCKIADIK

SEQ ID NO: 71631 - protein, 464 aa, Physcomitrella patens subsp. patens
MCHGTHEWHRQVIKNCRRLNAEKGYGIVVMIDTEGSEIHMGDLGGVSSAKEEDGEEWCFTIRKFNGPLPAYTLPVNYEGFAEDVQVGDELVVDGGMVRFEVLEKVGPDVKCKCTDPGILLPCANLNLWRDGYLVREKNVTLPTISSKDWVDIDFGISEGVDFIAVSFVKSPDVIKHLKSYVAARSPDRSIGVIAKIEDANSLRCLDDIIRVSDGVMVARGDLGAQIPLEQVPSVQEAIIDACRKLNRPVIVASQLLESMIEYPTPTRAEVADVSNAVRQQADALMLSGESAMGLHPQKAVEVLRGVSVRMEHWSREESHHEKPPLPEISTSDTGRTSEQICNSATQIGGLLNITANKLGADAILVYTRRGYMASLISRNRPDCPIFAFTESRNVMRCMDLQWGVVPFQFAFRKDLESNLLQSLALLKAHCMVRSGNLVVAVSDVSSASQSGTGVLQSIQVHVLS

SEQ ID NO: 71632 - protein, 380 aa, Vitis vinifera
MSSTAGQVIRCKAAVAWEAGKPLVIEEVEVAPPQVMEVRLKILVTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 71633 - protein, 226 aa, Yersinia pestis CO92
MSCNFKIILTGASGLIGSAIADALYKSGMNLVLACKRSQKLQDRYLSDDKSKRAYFWYGDLTNEKACRELVEYAVQQMGGVDVLINCAGVFNFSALEEMTYSRITDTISTNLLAPIYLTHLVLPYIKTSACPIIVNISSIAGFSSLPEGACYAASKWGLNGFIHSIREELRKKSIHICNISPCQVKTLSHHSDTAIRTIAPENIANAVILVLSYVQKTSSSIDVVL

SEQ ID NO: 71634 - protein, 289 aa, Oryza sativa Indica Group
MLFCGTGSFKDVDGKAAAPEAKKKKQGGGGGGGKKENPYASRGLDKFSTVLSELESRREKILRQVGGAGGGGAPGEGGGGGGGEHVLVRFVQSEGKGWVPIVVKLPPEEEEQQQRKGGKNKRKQQAAATSATSSQSSTPPTSEPASPREDVIKPARPAAAAAAEAPGSAKRKAGVRWSWSDVRPRHYMPFVAVLLLASLVVFGKVFAICCTSVWWYLVPILTASSNGAGGAGGAHGVRRSKAAVKVLGKKASDKKMAVTPLLGPSHGKRGSSGVHELISPRSHPHGKKG

SEQ ID NO: 71635 - protein, 323 aa, Ralstonia eutropha JMP134
MAKAIRFYETGSADVLKLETVEVGDPGPGQARVRHTYIAVNFIDIYFRTGHYPLQLPNGLGSDAVGVVEAVGPGVTDIRVGDRVGYLLGPQGAYSDVRVMPAEVLIPLPDGVSDRTASTLIMKGMTAQYLFRQVYPLKGGETILYHAAAGGVGLIACQWARALGVTMIGTVSSDEKAEVARANGCTHTIVTSRENIVERVMEITDGKKVPVVFDSIGKSTLDASLSCLQVRGTLVSNGTTSGPVEIDSRTLAAKGSLWVTRPAMVHYATPRSHMLDMAKEVFDMVLAGKITSEPRQSFALADAAEAHRALESRKTSGATVLVP

SEQ ID NO: 71636 - protein, 276 aa, Brassica napus
  misc_feature (12)..(12): Xaa can be any naturally occurring amino acid
  misc_feature (14)..(14): Xaa can be any naturally occurring amino acid
  misc_feature (21)..(21): Xaa can be any naturally occurring amino acid
  misc_feature (37)..(37): Xaa can be any naturally occurring amino acid
  misc_feature (61)..(61): Xaa can be any naturally occurring amino acid
  misc_feature (112)..(112): Xaa can be any naturally occurring amino acid
  misc_feature (124)..(124): Xaa can be any naturally occurring amino acid
  misc_feature (138)..(139): Xaa can be any naturally occurring amino acid
  misc_feature (141)..(141): Xaa can be any naturally occurring amino acid
  misc_feature (165)..(165): Xaa can be any naturally occurring amino acid
  misc_feature (174)..(174): Xaa can be any naturally occurring amino acid
  misc_feature (182)..(182): Xaa can be any naturally occurring amino acid
  misc_feature (187)..(187): Xaa can be any naturally occurring amino acid
  misc_feature (190)..(190): Xaa can be any naturally occurring amino acid
  misc_feature (195)..(195): Xaa can be any naturally occurring amino acid
  misc_feature (203)..(203): Xaa can be any naturally occurring amino acid
  misc_feature (208)..(208): Xaa can be any naturally occurring amino acid
  misc_feature (216)..(216): Xaa can be any naturally occurring amino acid
  misc_feature (219)..(219): Xaa can be any naturally occurring amino acid
  misc_feature (229)..(229): Xaa can be any naturally occurring amino acid
  misc_feature (237)..(237): Xaa can be any naturally occurring amino acid
  misc_feature (247)..(248): Xaa can be any naturally occurring amino acid
LRIGQYISELSXEXTLYQSTXDGKKMVDVLSTRHLPXIKSTRLVPLVGLTTSHVPRLDGLXSRTAAYYQQGARFAKWRTVVSIPNGPSALAVQEAAWGLARYAAISQDSGLXPIVEPEILLDGXEHNIDRTYEVAEKXXAXVFSTSLSNNVMFEGILLKPSMVTXPGAESKDRXATPEKVAXYTLKXLPXRIPPXVPGIMFLXAGRPXSDGDFEPXRNXPRTEPVARVXLLRTCIAXHLLEDMGRQXXERESGSGDTLDPGQSQFAGSAREIHRRR

SEQ ID NO: 71637 - protein, 363 aa, Vitis vinifera
MGVPQVLATFLALGELTNFLRLGFLRYWQRHGFCSLILLQHSLDGGVDDVIAPTQELSSVGLHVTATVMCASARSSTSTAQTAIYDTFIFALTDMVETERERERETRAEFGTSSCRIRHEGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 71638 - protein, 388 aa, Vitis vinifera
  misc_feature (14)..(14): Xaa can be any naturally occurring amino acid
  misc_feature (76)..(76): Xaa can be any naturally occurring amino acid
  misc_feature (140)..(140): Xaa can be any naturally occurring amino acid
  misc_feature (249)..(249): Xaa can be any naturally occurring amino acid
  misc_feature (297)..(297): Xaa can be any naturally occurring amino acid
  misc_feature (379)..(379): Xaa can be any naturally occurring amino acid
MEKSYEPANGNGFXDNGHRTMRYSPYQPCIKVSLSWLDIRVFYVRVSKCEIDDSTPEYLTLNHIPLNRDTLLEVNXVRSSIYSDGVSTLLRRDRLDKKSEEATFVSTDSVRMTGSVKFEVFDKDVLVLYGVLEMSNSNGXTGKSKNIGQRWSMTCELDIVPGTSFLKGKQYMGGPESASPAIEVYIAGCFSATPIILTKTLQLTLRKKQIRKGMLDSIPEYDATECQKDETAGLSLQMLQISEHPNYKXENEDYNSLYSGTEYLEGEDGELSWFTAGLLSRNRHRSGAAGQDLPRHXQQLQKATTVTIYSTLLSHNPKRTANLVVFLRGSYLANKCRKCMNRVRSTAETIEPLNKRVIVTMQRYHHNCRNFSSIPALDXVGHKLVSRL

SEQ ID NO: 71639 - protein, 206 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 71640 - protein, 540 aa, Vitis vinifera
MVSHHLERTTTTISSYWTWWWEATSKKDHVNQAVFTVLIAIFATLWYLWASRRARKRTAPLPPGPRGLPIVGYLPYLGSNLHHSFAELADIYGPIFKLWLGNRLCIVLSSPSLAKEVARDQDIIFANRDPPVAALIASYGRLDIAWSPYGSYWRNLRKLFVREMLSNNILDRCHAHRRYEVRKTITNVYNKIGTPMEIGKLSFQTELNVMTRSLWGNTIEGLEDSVTAVSFRELSNEMMRWLGKPNISDFFPVLARFDIQGVEREMKKVFLSVDQILDRIIEQRMKLDTAKEKRTSNNREEKDFLQFLLDVKEQEATETPITRTKVKALLVDILVGGTDTTATTIEWAMAEMMSNPETMRKAQEELADVVGMTNIVEESHLPKLKYMDAVMKETLRLHPAVPLLIPKCPSESCTVGGYTVPKGTKVFVNVWAMHRDPKYWDNPSEFKPERFLTDSSRWDYRGNNFQYLPFGSGRRVCPGIPLAERMIIYLLASLLHSFDWQLIAKGEDLDLSEQFGIVVKKRTPLIVIPTKRLPNSALYA

SEQ ID NO: 71641 - protein, 494 aa, Bacillus anthracis str. Ames
MLTTNIELKPKVKAFLDEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 71642 - protein, 142 aa, Bacillus simplex
PAVAGLLMEKELSVLGKALSNPERPFTAIIGGAKVKDKIGVIENLLEKVDHLIIGGGLGYTFIKAQGHEIGNSLLEEDKIGLAKSFIESAKQKGVKLHLPIDAVVTAEFSPDAETDNVDIDAIPNDKMALDIGPKTSELFAD

SEQ ID NO: 71643 - protein, 349 aa, Clostridium perfringens SM101
MKAKLILENGVVFEGKAFGYLKECVGEVVFNTGMTGYQEVLTDPSYYGQIVTMTYPLIGNYGINLEDLESKEPKVRGFIVREKCQYPNNFRCELELETYLAQNKVLGLDGIDTRVLTKILRNNGTMKGIIVLDNSNLEDVKDKLEAFSNRDAVSIVSTNEKYEISGEGKNVAIIDFGIKQNIIRNFVKRGCNVTVFPYDFKAEEVLDINPDLVFLSNGPGDPEDMGEAVNEIKKIVGKKPIVGICLGHQLLALTLGGETKKLKFGHRGCNHPVKDLINNRVHITSQNHGYYVATLPENMEITHVSMNDGTVEGMKHKELPIFSVQFHPEACPGPKDSEYIFDEFMKYAL

SEQ ID NO: 71644 - protein, 536 aa, Gloeobacter violaceus PCC 7421
MAFMGTSSAVHPAILVILDGWGYREQTDGNAVAAAKTPIFDALKASYPFTLIHTSGKAVGLPRGQMGNSEVGHLNLGAGRMVPQELVRISDAVEEGTLLSNPELLRLCRTVRERGGKLHGVGLVSDGGVHSHIEHLFGLLDLAKREGFETLFIHGMSDGRDTPPTSGVAYFEKLEARIAETGFGTIATLGGRYFGMDRDRRWDRTEAMYRVMTETGPGTGKRASETLRESHAAGKTDEFVLPVRLAAGAVEPGDGVIYFNFRPDRARQLTRAFVQADFDGFVRPYLDPLAFLTFTQYDATLPVAVAFAPQSLDNLLGQVIAHHGLRQFRIAETEKYAHVTYFFNGGIETPLPGEERSMIQSPLVPTYDLKPEMAAREVTDHAVAAIETRQYSLIVINYANPDMVGHTGNFDATVKAVETVDACIGRLVEACVRAGGTMLLTADHGNAELMWDEQGNPWTAHTTNPVPFILIESEGLKIPGWGTDVQLRAGGSLGDIAPTILEILGLPQPAEMTGRSLLGESEIEIRTPRSPLRVGL

SEQ ID NO: 71645 - protein, 141 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFTESAKEKGVKLHLPIDAVVTAEFSPDAETDNVDIDAIPNDKMALDIGPKTSELLR

SEQ ID NO: 71646 - protein, 540 aa, Vitis vinifera
MVSHHLERATTAISSYWIWWWEATSKKDQVNQAVLTVLIAIFATSWYLWASLRARKRTAPLPPGPRGLPIVGYLPFLGSNLHHSFAELADIYGPIFKLWLGNRLCIVLTSPSLAKEVARDQDIIFANRDPPVAALISSYDRLDIVWSPYGSYWRNLRKLFVREMLSNNILDRCHAHRRYEVRKTITNVYNKIGTPMDFGKLSFQTELNVMTWSMWGNTIEGLEDSVTGVSFRELSNEVMRLLGKTNISDFFPVLARFDIQGVEREMKKVFLSVDQILDHIIEQRMKLDTAKEKRASNNREEKDFLQFLLDVKEQEATETPITRTQIKALLLDILVGGTDTTATTIEWAMAEMMSNPETMRKAQEELADVVGMTNIVEESHLPKLKYMDAVMKETLRLRPAIAVLVPKRPSQSCTVGGYTVPKGTKVFLNVWAMHRDPKYWDNPSEFKPERFLTDSSRWDYRGNNFQYLPFGSGRRVCPGIPLAERMLIYLLASLLHSFDWQLITKGEDLDLSEQFGIVLKKRTPLIVIPTKRLPNSALYA

SEQ ID NO: 71647 - protein, 445 aa, Thermococcus kodakarensis KOD1
MVVRPNVKELPGPKAKEVIERNFKYLAMTTQDPENLPIVIERGEGIRVYDVDGNVFYDFASGVGVINVGHSHPRVVEAIKKQAEKFTHYSLTDFFYENAIILAEKLIELAPGDIERKVVYGNSGAEANEAAMKLVKYGTGRKQFLAFYHAFHGRTQAVLSLTASKWVQQDGFFPTMPGVTHIPYPNPYRNTWGIDGYEEPDELTNRVLDFIEEYVFRHVPPHEIGAIFFEPIQGEGGYVVPPKGFFKALKKFADEYGILLADDEVQMGIGRTGKFWAIEHFGVEPDLIQFGKAIGGGLPLAGVIHRADITFDKPGRHATTFGGNPVAIAAGIEVVEIVKELLPHVQEVGDYLHKYLEEFKEKYEVIGDARGLGLAQAVEIVKSKETKEKYPELRDRIVKESAKRGLVLLGCGDNSIRFIPPLIVTKEEIDVAMEIFEEALKAALK

SEQ ID NO: 71648 - protein, 141 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTAEFSPDAETDNVDIDAIPNDKMALDIGPKTSELLR

SEQ ID NO: 71649 - protein, 537 aa, Vitis vinifera
MISYHLNKATETICSLWSWWWAGSNKKLDVVDGAVLTVSVAVLAILWYLRTSRKGTAPWPPGPRGLPVVGYLPFLGSNLHHSFAELAHLYGPIFKLWLGNKLCVVLSSPSLAKQVVRDQDIIFANRDPPVAAFAYTYGGLDIAWSPYGSYWRNLRKVFVREMLSNTSLEACYPLQRSEVRKAITNAYSKIGTPMDIGQLSFQTVVNVTLSSLWGNTPEAHNDGKIGAEFREAASEITELLGKPNISDFFPTLAGFDIQGVERQMKRAFLSAEQVIDSIIDRKMKKSTAKEEGASDNGEKKDFLQFLLDLKVQEDTETPITMTQIKALLMDILVGGTDTTATMVEWVMAEMIRNPVIMTRAQEELTNVVGMGSIVEESHLPKLQYMDAVIKESLRLHPALPLLVPKCPSQDCTVGGYTIAKGTKVFLNVWAIHRDPQIWDSPSEFKPERFLSEPGRWDYTGNNFQYLPFGSGRRICAGIPLAERMIIYLLASLLHSFNWQLPEGEDLDLSEKFGIVLKKRTPLVAIPTKRLSSSDLYL

SEQ ID NO: 71650 - protein, 329 aa, Acidovorax sp. JS42
MTTPGSASHVPSPHHARLTPQMRNVIDGMARAGRPPLHTLSPAQARAAYELGAGVLELPKAALPRVEDLRIPARDGTPLPARLYAPTASDAQALPLLLYLHGGGFTIGSIATHDVLCRELARLAGCMVVSLDYRLAPEHPFPTASDDAWDALAWLAQHATTLGADPSRLAVGGDSAGGTLAAVCALQARDAGLPLALQLLIYPGTTAHQDTPSHTEFAHGLVLERAAIGWFFDQYIPSRAEREDWRFAPLLAPDAEGVAPAWIGLAEYDPLVDEGVEYADKLRAAGVPVQLEIYRGVTHEFIKMGRALPEARQAHADAAAALRSAFQLD

SEQ ID NO: 71651 - protein, 313 aa, Lactobacillus johnsonii NCC 533
MTKEEKLSANTVIADTLDKATKVDPNLLVVTCDSRGSAGLVNFTNAHPDRTVEMGIAEQNAVTVAAGMAHAGKHPFVFSPAAFLAMRSIEQVKVDVAFNQTNVKLIGISGGNSYTWLGTTHHSLNDVAITRAIPNLEVYQPCDQYQTRALFNYLLTSPRPAYVRIGKRKLDNVYHEDFKFEPGKAKIIRKGKDVCLISVGEMLYFTLQAAEKLAKNGIDAEVVDLASIKPLDAEMLDKLAQEFNQIVTVEEHDLINGIGSAVAVEVAKFGHAKLTILGFPDEPAIQGTQDEVFHYYGLDSAGIEKAVEDLLTH

SEQ ID NO: 71652 - protein, 576 aa, Rhodococcus sp. RHA1
MAFSVQMPALGESVTEGTVTRWLKQEGDTVEVDEPLLEVSTDKVDTEIPSPVAGVLSKIVAQEDDTVEIGGELAVIGDAGEAPASDSAPAPAAEEPAAEPAPAAEAPADEPAPAASGNGSAEGTAVKMPELGESVTEGTVTRWLKAVGDEVAVDEPLVEVSTDKVDTEIPSPVAGTLLEISAEEDDTVSVGGQLAVIGSGAPAAKPAAEPKPEPTPEPAPAPEPAKPEPAKSAPAPAAAPAASAPAPAAAAPAPAATSGDSTPYVTPLVRKLAADNSVDLSSVTGTGVGGRIRKQDVLAAAEAKKAPAAAAAPAAAPAAAAAPAAASAGVRPELAHLRGTTQKANRIRQITATKTRESLQSTAQLTQTFEVDVTKIAALRAQAKNTFVEREGVKLTFLPFFAKAVVEALKSHPNINASYDEANKQITYYDAEHLGIAVDTDQGLLSPVIHNAGDLSLAGLARAIADIAKRARSGGLKPDELSGGTFTITNIGSQGALFDTPILVPPQAAMLGTGAIVKRPVVVTDESGSESIGVRSMCYLPLTYDHRLVDGADAGRFLTTIKQRLEQGAFEADLGL

SEQ ID NO: 71653 - protein, 128 aa, Geobacter sulfurreducens PCA
MELERGERPWGTYTVLEENKNYKIKRIEVKPGQRLSLQMHHHRSEHWIVVSGTARVTCGDDEYTVNVNESTFIPIGRNHRLENPGKIPLVIIEVQSGEYLGEDDIIRFDDDYHRCEAAAATCAEEEGA

SEQ ID NO: 71654 - protein, 411 aa, Mycoplasma genitalium G37
MLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKVQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQKNS

SEQ ID NO: 71655 - protein, 506 aa, Vitis vinifera
MEATSVKAGMQPASEDAHHHQSTPLSKIILVASIAAGVQFGWALQLSLLTPYVQLLGVPHTWASFIWLCGPISGMLIQPTVGYYSDHCNSQWGRRRPFIIVGTILVTLAVILIGFAADIGKSAGDPPDKVPKVRAVVVFVLGFWVLDVANNMMQGPCRALLADMSGHNHKKTRTANSYYSFFMAVGNVLGYAAGSYTDLYKVFPFTKTKACDVYCANLKTCFIFAIILLLVLTTAAMTLVKERPLVLTQQYNADQDEEDEEEVSMPFFGQILSALGNLSRSMWMLIVVTSLNWLAWFGFLLFDTDWMGKEVYGGTVKGKESKLYDRGVHAGSLGLMLNSLVLGLMSLAIEPAARLMGGVKRVWGIGNFILAICLGLTVAVTKMAQSSRHEAAAEGRSLMPPANVKIFALTIFALLGIPQAITYSIPFALASIYSNASGAGQGLSLGVLNMAIVLPQILVSAVSGLLDDLFGGGNLPVFVAGAIAAAASGVFALTILPSPPAQPSRL

SEQ ID NO: 71656 - protein, 154 aa, Triticum aestivum
  misc_feature (125)..(125): Xaa can be any naturally occurring amino acid
  misc_feature (136)..(136): Xaa can be any naturally occurring amino acid
MAAPSSLASSRLAAAAPAPQHHHQNHQLRLGCSRRRAQRLVAMAGSGKFFVGGNWKCNGTKESITKLVSDLNAATLESDVDVVVAPPFIYIDQVKSSLTDRIEVSAQNTWIGKGGAFTGEISAEXLVDIGCQWVIXGHSERRHVIGEDDELLGR

SEQ ID NO: 71657 - protein, 173 aa, Bacillus cereus
  misc_feature (4)..(4): Xaa can be any naturally occurring amino acid
  misc_feature (101)..(101): Xaa can be any naturally occurring amino acid
  misc_feature (154)..(154): Xaa can be any naturally occurring amino acid
SNAXIYPYKEKKPKIASSAFIADYVTITGDVYVGEESSIWFNTVIRGDVSPTIIGDRVNVQDQCTLHQSPQYPLILEDDVTVGHQVILHSCHIKKDALIGXGSIILDGAEIGEGAFIGAGSLVSQGKKIPPNTLAFGRPAKVIRELTAEDRKDXERIRTQYVEKGQYYKSLQK

SEQ ID NO: 71658 - protein, 393 aa, Listeria monocytogenes str. 4b H7858
MKISKRLQNLPDQFFSSLVEKVGKKVAEGHDVINLGQGNPDQPTPKHIVEAMKTASEKPLNHKYSLFRGKHELKQAAADFYAREYNVTIDPNTEVAILFGTKTGLVELPMCLMDPGDTMLLPDPGYPDYLSGVVLGEVQFEKMPLIAANNFLPDFTKIPEDIAEKAELMYLNYPNNPTGAVATADFFEETVAFAKNHNIVVAHDFAYGGIGFDGKKPISFLEANGAKEVGIELYTLSKTYNMAGWRVGFAVGNSEVIEAINLIQDHMYVSLFPGIQDAAIEALTGDQTCVGELTARYESRRDAFISACKKIGWEAVAPAGSFFAWMPVPENFTSSEFADYLLEEVSVAVADGSGFGEFGEGYVRVGLLMDEERLEEAVTRVSKLHLFDKVTQQ

SEQ ID NO: 71659 - protein, 319 aa, Cryptococcus neoformans var. grubii
MSKVQESTVKKPTDTDVSGFLTNFLMGGVSAAISKTAAAPIERVKLLIQNQDEMIKQGRLSTPYKGVMNTFARTYKDEGLISLWRGNTANVIRYFPTQALNFAFKDYFKTLFGFKRSEGYWKWFAGNIASGAAAGASSLLFVYSLDYARTRLANDNKSAGKGGTRQFNGLLDVYKKTLASDGLIGLYRGFIPSVAGIVVYRGLYFGLYDSVKPVVLVGALEGNFIASFLLGWTVTTAAGFVSYPLDTIRRRMMMTSGGTVHYKSMFDAASQIVAKEGSRSLFKGAGANILRGVASAGVLSLYDKAQELMFGKVYSSGSG

SEQ ID NO: 71660 - protein, 316 aa, Cryptococcus neoformans var. grubii
MSEVARKPKDAKAFLTDFLMGGVSAAVSKTAAAPIERIKLLVQNQDEMIKQGRLATPYKGVTDCFARTYKDEGLASLWRGNTANVIRYFPTQALNFAFKDYFKSMFGFKKSEGYWKWFAGNIASGGAAGASSLLFVYSLDYARTRLANDSKSAKKGGARQFNGLVDVYKKTLASDGIAGLYRGFIPSVVGIIVYRGLYFGLYDSIKPVILVGPLEGNFLASFLLGWTVTTSAGLASYPLDTIRRRMMMTSGGTVHYKSMFDAGSQIIAKEGVKSLFKGAGANILRGVAGAGVLSLYDKAQELMFGKVYSLSKGGSG

SEQ ID NO: 71661 - protein, 478 aa, Vitis vinifera
MTPISPFLEKQIAMLSDAWSWWWESTNSSDEFARVSLTFALISLVISWYAWMFIKNRGGAPPPPPGPRGLPLLGYLPFLDPELHSHFADLARAHGPILKLRLGSKVGIVVTSPSLAREVLKDHDTIFANRDVPDLTNALQYGGFDIVCTPFGPEWRMLRRVCVREMLSSATLDVFYDLRRQEFQRTVRYLYGQAGSPVNVGEQMFLTVMNVITSMLWGGTGEGGRESEPWGRRMKIDKEGGKDFLQFLLRLKDEGHAKTPLTMNHVRALLLDMVVGGTDTTSNTVEFAMAEMMNKPEVMRKAQQELEVVVGRDKKVEESHIGKLPYLYAVMKEVLRLHPALPLLVPHCPSESCVVGGYTIPKGARVFVNVWAIHRDPSIWKSPLEFDPERFLRGTWDYSGKDFSYFPFGSGRRICAGIAMAERMVMFSLATLLHSFDWKLREEKLDLSEKFGIVLTKKMPLVAIPTPRLSHPLLYEYE

SEQ ID NO: 71662 - protein, 311 aa, Methylococcus capsulatus str. Bath
MVFSGNANLPLAEGVVRKLNMRLGMATVGRFSDGEIAVEIEEHVRGREVFVIQPTSQPINENLMELLVMIDALRRSSASVITAVIPYFGYARQDRRIRSARVPITAKLVAKMICAAGADRVLTVDLHADQIQGFFDVPVDNVYASPILLGDVWRQKYPDLMVVSPDVGGVVRARALAKRLDDADLAIIDKRRPRANEAKVMNIIGDVRGRTCVMVDDLVDTAGTLCKAAGALKEHGAERVVAYCTHPVLSGPAVDNIEASMLDELVVTDTIPLQERASACNRIRQLTIAEMLAETIRRIAMGESVSSLYVD

SEQ ID NO: 71663 - protein, 206 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSIQG

SEQ ID NO: 71664 - protein, 258 aa, Triticum aestivum
  misc_feature (115)..(115): Xaa can be any naturally occurring amino acid
VSREQRWSLAGATALVTGGSRGIGHAIVEELVGLGARVHTCSENAAELEECRRRWEETKLPVTVSVCDVSVRAEREKLMETAKQTFDGKLDILVNNVGRNVAKAAVEWTAEEYSXLMSTNLEAAFHLSQLAHPFLRDASIAGGGSVVNISSVASSLGYPTLALYCISKGGVNQLTRSLAAEWAQDKIRVNSVAPGGINTELQNSVDPKVIENTLLRTPMHRLGEPVEVASMVSFLCMPAASFLTGQVIYVDGGRTISG

SEQ ID NO: 71665 - protein, 430 aa, Thermococcus kodakarensis KOD1
MENPFEITNVIAREILDSRGNPTVEVEVYTPISMGRAAVPSGASTGTHEALELRDGGSRYHGKGVRRAVENVNKIIAPEIIGMDVTWQRDIDTLMLELDGTENKSNLGANAILGVSLAVAKAAANALGLPLYQYIGGTNAYVMPVPMSNVINGGVHAGNELDFQEFMIMPVGADSFREAIRWVSETYHVLKKVIMEKYGRNAVNVGDEGGFAPPMKEVTEPLDVLIKAIEEAGYKPGDEIAFALDAASSEFFDGEKGKYVVAGKEYDKGELLELYRELVTTYPIVSIEDPFHEEDWEGFVMITKELGSKVQIVGDDLFVTNPKRIRKGIEMGAANALLLKVNQIGTLSEAIDAAYTSFRAGYGVVVSHRSGETEDATIADLAVALNAGQIKTGAPARSDRNAKYNQLIRIEEELEGIAVYPGKKFRNPFL

SEQ ID NO: 71666 - protein, 403 aa, Zea mays
  misc_feature (261)..(261): Xaa can be any naturally occurring amino acid
  misc_feature (277)..(277): Xaa can be any naturally occurring amino acid
MNYDLSPVKRKDGQRAGAATDDSSDMAKPAAARKPSAASTVALTLVLALASAVLLFLLLRFSPSSPSPNPHPHRRLRLRPRAHAHHHQIPFDPVVADIERRLEDREWERLAAAGLHAPGMEAAPVPEDLTDGEVDADEDYINDAARFNVTLRVEALFPKIDVDPADGAVTGAELAAWNLANARREVLHRTARELELHDRDHDGRVAYGEYERPSWAWRFDDHNSTDDGVGWWKEEHFSAADMDGDGFLNLTEFNDFLHPAXYYQPKANTLVVQRRSXRERDKDNDGKLNFQEFFNGLFYSIRHYDDEGLTDDTGGSDAPAKKSFSHLDLDNDGLLSADELKPVIGNLHPSEYFYAKQQADYVISQADTNKDGQLSMNEMIENPYVFYNALFTEDDYGFHDELR

SEQ ID NO: 71667 - protein, 406 aa, Novosphingobium aromaticivorans DSM 12444
MLNELRIPRMGSVENARLLNWRVQEGEAYEPGQVLYEIETDKTSVEVEAEGPGVLARHLAAVGDEFKVGDRIGLWALPGTAPATLRAALSPQPMPASEPAPSPSSTLPAAVSAPGLHALRPVSRDAAGGRRVSPLARRLAAQNGVDLATVTGTGMGGKISGKDVLAASAKPRPAPVPVSPPRPGSDGEIVPHSLRRRTIAQRMVEAAAIPTLTADMEVDLTALFARRRSVEGNGASVLGMIAEAAIAALLQHRRLNAHWREDAMVQFGAVHLGIAVDTPEGLVVPVVRNAESLNARGLTDAIAALADKARAGTLRPQDMEGGTFTISNPGSMGPVVRAEALLNPPQVALLGLPGIVRAPVAIKDGDAWAMAVRPLLRLSLSFDHRALDGGPVIAFLNTLKATLERP

SEQ ID NO: 71668 - protein, 168 aa, Oryza sativa
  misc_feature (87)..(87): Xaa can be any naturally occurring amino acid
RRRIRFFAVPVLNRKEFRGISPHRRARASRTSTASSRRTPPRKHWICIEDKFRAAGDYVSQKSSSVFGKKKVEPMVKDAAAPGKGGXLKMESSNAQPQDSAYSVPKNPSMTCCRKRTDGATFLEDLKDHIEEFIHASMDEHKTCFKHHPKDVWDVKGCRGAFGGCQGS

SEQ ID NO: 71669 - protein, 320 aa, Gloeobacter violaceus PCC 7421
MVSTEIGPSALGSVQPPAETDLLQWVGNTPLLRLERVTAGLSPDVEVYGKAEWFNPGGSVKDRPALNMILEGERSGRLTREKIILDATSGNTGIAYAWIAARRGYRVKLALPLNASEERKRILKAYGVDLILTDPTLGSDGAIQEARRLYAADPERYFYPDQYSNNANWQAHYLTTGVEIYQQTGGRVTHFVAGLGTSGTCMGVGRRLKEFDPAVRVIAMQPDSPFHGLEGLKHMETAIVPAIYNPALPDRQVEVSTEEAQRTVKRLAREEGMLVGISAGGNVAAALRLARELDRGVVVTILCDSADKYLSERFWDDPNL

SEQ ID NO: 71670 - protein, 201 aa, Escherichia coli
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 71671 - protein, 205 aa, Escherichia coli
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSIQGT

SEQ ID NO: 71672 - protein, 142 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTAEFSPDAEADNVDIDAIPNDKMALDIGPKTSELFAD

SEQ ID NO: 71673 - protein, 286 aa, Brassica napus
  misc_feature (284)..(284): Xaa can be any naturally occurring amino acid
LIQKCPNLEVLETRNVIGDKGLEILAQCCKQLKRLRIERGADEEGMMDEIWGADEQGNEDLGGFVTQRGLTALAQGCQKLEYMAVYVTDISNECLRTIGAYLKNLSDFRLVLLDQEERIRDLPLDNGVRSLLMGCEKLRRFAFYLRRGGLTDVGLRYIGQYSPNVRWMLLGYVGETDEGLVEFSREGCCPKLQKLEMRGCCFSERAIAAAVMKLPSLRYLWVQGYRESVTGQDLRVMSRPNWNIELIPARRVPEVNLGDVREMEHPAHILAYYSLAGQRTDCPXTG

SEQ ID NO: 71674 - protein, 263 aa, Brassica napus
  misc_feature (234)..(234): Xaa can be any naturally occurring amino acid
IQVWKDVDGVLTCDPTIYKRATPVPYLTFDEAAELAYFGAQVLHPQSMRPAREGGIPVRVKNSYNPKAPGTIITKTRDMTKTVLTSIVLKRNVTMLDIASTRMLGQVGFLAKVFSIFEDLEISVDVVATSEVSISLTLDPSKLWSRELIQQELDHVVEELEKIAVVNLAKGRAIISLIGNVQHSSLILERAFHVLWTKGINVQMISQGASKVNISLIVNDAEAEGCVEALHKSXFFESGDLSELLIQPRLGNGSPVRAMQVEN

SEQ ID NO: 71675 - protein, 242 aa, Haemophilus somnus 2336
MQIELSTIEELRYNRQIIMKQIDFDGQEKLKGTKMLIVGLGGLGCAAAQYLACTGVGHLTLLDFDTVSLSNLQRQVLHNDERLNMLKVQSAKIALQQLNPHIEIQCIAEKLNEEKLAEIVPHFDAVLDCTDNVEIRNQLDRCCLATKTPLVSGAAIRMEGQVSVFTYEENTPTYQHLSRLFGENTLSCVEAGVLSPIVGIVGAIQALEAIKVRLNIGKILSGRLLMIDGLNMKIREINIPSE

SEQ ID NO: 71676 - protein, 1373 aa, Vibrio fischeri ES114
MSDASQKIFKTLTPLALFVAAQCSQAQASTIQIVGPEGKDQTVSSQVVTEPQPAKVYTKSVPAEKAPQAKASTKIYGPTREDETLWSIASRVNPSNTTSVQQTLLAIYRLNPQAFENNNIHGLEPNSRLRLPTLEQVRRENTDDAKQLLLAHNKKLAAQKASEAQVKRTVKTEKPAPTPKPAVTPAKTEAKVQEQKPAKEVVKSVAPVAEQNSTVVALKSELDTTEQEFTALQENNHQLRVRLAQVQNEVDNLKSELGDEDRIRNEVEKFINEQKQLAAAEKKVEPTAMDKLASSPGLIASLALIPGALIAGLIAFFLFRRKKEEEEGEGEAQAEQQPAPLVMPEDNFKMDDDIPEISLDDDDDILSDLNNDEFIFDEQSDSNDDLFAEFETDNDNTDEDPFAELESDSDLDSLSLEDESDLDLELGGLDDLDDDLDMSSSALTVGAEEKALGLEEMEKALNDFDSDLFSESDLEAEDDDFDLSLIDDSDSEKASSIPELEETEELEGGELDQSMLDDLFASVDDEDEDESVLDQGWDLDENEETKLVPETEEVEAKTDSLEDELDFDELLSGMADEESEKESDLEDELDLDSEDESTALLDELLDESDDETEDEFDLEDNSTALLDELIDESDEEQDDDLDIDADSTALLDELLDDEELDDEDDITLEEDSTALLDELLADDDEKNDNFELDEDSTALLDELIGDDADEENETLGKTGVDAEVDGVAASEALSEDTPRDEDWLIEDDEEDEDDIPLFESEPENEHVSELDSEEDEITSETDLLESTETQMQEEESVEPVSESDILKEFEEDDLDSLLADDESLLDLEEESADLDALNEDEALNEESEDAFSFDEELEPEIEETDVSELAEPTEPEVMAEDVTEETVTPEVERTEALEEDDLDEVTLDSLLAGDESLLDLDEESVDLETLNEDEALNENSEDAFSFDEELESEVEETKVSELEEPTESEVIAENTVEEAVASDVENTEALEEDTLDEDDLDSLLADDESLLDLEEESVGLEALNEDEALNENSEDAFSFDEELESEVEETDVSELEEPTESKGIAEDTVEEAVASGVESTEALEEDTLDEDDLDSLLADDESLLDLEEDPVELTELTDDEDDNDFSLDDFVEQNATDFSQKSEEESSVSELDLDSDEEEQDTKFDGLSIEDALAALGDDDNEIDDSAFNLDSTEEETEIAPSREEFNFTSQVSDEEKEALTHLDSAGLDIDSMLEDGGSDWSGFSLDGHSNTESALEDEDWSEQPNVENDPHGENRFLSIEALIAETEKGDKNDFEEEDLNLDVGLDEFPDMLGNVAEHDVDVNSDAQSKLDLAKAYIEMSDDKGALELLEDVLRSDDVSLKIEAEKLMKQIG

SEQ ID NO: 71677 - protein, 180 aa, Oryza sativa Indica Group
MNRGGQVISEIVESCRSHDITDLVLVHEHRGQPDGLIVCHLPFGPTAYFGLLNVVTRHDIKDRKAMGKMSEAYPHLILDNFTTKTGERTANIVKHLFPVPKPDSKRIITFANRDDYISFRHHVYEKHGGPKSLDLKEVGPRFELRLYQIKRGTVDQAEAQNEFVLRPYMNTAKKQKSLGA

SEQ ID NO: 71678 - protein, 260 aa, Acidovorax sp. JS42
MITSVDDTPDLERRFAGLERLFGQEGAARIRCAHVAVVGIGGVGSWTAEALARSGVGALTLIDLDHVAESNVNRQIHALTTTIGQAKVRAMAERIALINPACRVNCVEEFVDAQNWPTLLPSSVDALVDACDQVNAKAVMAAWAVSTRLPFVTVGAAGGKRHAYKVEVEDLAFTTHDPLLAQLRYRLRRNHGAAREGRKIGVTCVYSKEAVSKPHASCGVGEGDGSLNCHGYGSSVAVTATFGQCAAGWILDKLAERSKT

SEQ ID NO: 71679 - protein, 597 aa, Mycoplasma genitalium G37
MHQVFYQKYRPINFKQTLGQESIRKILVNAINRDKLPNGYIFSGERGTGKTTFAKIIAKAINCLNWDQIDVCNSCDVCKSINTNSAIDIVEIDAASKNGINDIRELVENVFNHPFTFKKKVYILDEAHMLTTQSWGGLLKTLEESPPYVLFIFTTTEFNKIPLTILSRCQSFFFKKITSDLILERLNDIAKKEKIKIEKDALIKIADLSQGSLRDGLSLLDQISNFSDSEKISITDVEKTFNIVDRNAKFTFIKAVLSGDIKEAFNLLDDFESNGLNFTYFLRELFALTVNLYAYAKLKNINVLDSTEKTMIETLNFEKQHYAFLIKAIEENTNFGLSQLTLIDRLKAIVISYNEFFNQKPLTISSPSNEKSLHLETEYLEKKKIKKSNHKQDQKHFSLFEKSFIDKSEKTPKNDEVTNNKFLDTSKLNLANIALAINAFNDNKWINHFQNLLSVFQTKFNDKDKQNNLSYFNNFIDKYSARDIVKATKIVKASSFGIVILFEDQKIAMRLWKEAIEEGNVQATIFQIFNQNLFLASFSEHQYKTTITEETKNQKYQTEVLNLTQLENLAKPFLKEKKRSLSQKMVDKYFKGLFEEK

SEQ ID NO: 71680 - protein, 617 aa, Haemophilus somnus 2336
MNKYPLLSLINSPDDLRLLSKDKLPQLCQELRSYLLESVSQSSGHLASGLGTVELTVALHYVFKTPFDQLLWDVGHQAYPHKILTGRRDKMSTIRQKGGLHPFPWREESEFDVLSVGHSSTSISAGLGIAIAAQKENLGRKTICVIGDGAITAGMAFEALNHAGSVHTDMLVILNDNEMSISENVGALNNHLARLLSGSIYSTLRESGKKILSGLPPIKEFVKKTEEHVKGFVSPVGTLFEQLGFNYIGPIDGHNIHELISTLKNMQSLSGPQFLHIKTKKGKGYAPAEKDPIGFHGVPKFDHKLGELPKSSTTPTYSQIFGSWLCEIAAQDEKLIGITPAMREGSGMVEFSQQFPQQYFDVAIAEQHAVTFAAGLAIAGYKPVVAIYSTFLQRAYDQLIHDVAIQNLPVLFAIDRAGIVGADGQTHQGAFDLSFMRCIPNLVIMTPSNENECRQMLYTGYKCGKPAAVRYPRGNAIGVKLEPLAELPLGKSKLIRQGKNIAILNFGTLLSEATKVAEDLDATVVDMRFVKPLDTQRIQEIAQTHSLIVTLEENAIQGGAGSAVAETLYQQQQKVSLLQLGLPDNFIPQGTQKEMLAELKLNAEGIFEQIKQFLQKI

SEQ ID NO: 71681 - protein, 159 aa, Listeria monocytogenes str. 4b H7858
MNIQIVTVGKLKEKYLVQGIAEYLKRLSAFAKVTIVEVPDEKAPEVLSDAEMKQVKDKEGARILAKIPDDAHVIALAIDGKMKSSEEFAADLDKLATYGKSKVTFVIGGSLGLSEAVLKRSNERISFGRLTLPHQLMRLVLVEQVYRAFRIVRGEPYHK

SEQ ID NO: 71682 - protein, 397 aa, Mycoplasma genitalium G37
MNEKAKQFIKKRTSVFIALLVVFCFFLLISAFADGFNFWSPWSADFNSRTLKVEQASGVTSVISTEINENFKAVRFSFSIIIILIVGVIGSLMIWELFTNILKNKPKLSLSLTLLNAGIIIFGMIGTFVVVYFYKWNATVNGIWTLSFTLSVVLLWIIYIACMSKTRIKFSLQLSYSLGAIACFIASIGTIYFSVIRGWTTIFLLMSLAVSVDTFSFLFGKRFGKNPLIKISPSKTWEGAFFGIISTIVVVALLCVLYSIPFFVAKPTFNQTNGIALNTPQNYDSHNLITNIFLIAFISGGSSFYIYWWVSTLALIFTGSVFAIGGDLFFSYIKRLISIKDFSKVLGKHGGVLDRFDSSSFLISFFFVYHLIAGTISNQRLLMEPNTYFSAITSIQS

SEQ ID NO: 71683 - protein, 190 aa, Geobacter sulfurreducens PCA
MLLMIDNYDSFTFNIVQYFGELGEDVRVFRNDGITLDEIEALAPRRLVISPGPCSPEEAGISVAAIRHFAGKIPILGVCLGHQSIGAAFGGTVVRSSTLMHGKTSPIHHNGQGLFRGLPNPFNATRYHSLVVERASLPDCLEITAWVEEGEIMGLAHRELPVWGVQFHPESILTEGGMDLLRNFLEITRS

SEQ ID NO: 71684 - protein, 127 aa, Lactuca indica var. laciniata
NDDFRRGKPTNHKVYGEDVAVLAGDSLLAFAFQHIASATVGASPERVLAAVGELAKSIGTEGLVAGQVVDIASTGAKDVGLDQLEFIHIHKTAALLEAAVVLGAILGGGSDTQVEKLRKFARCIGLL

SEQ ID NO: 71685 - protein, 327 aa, Physcomitrella patens subsp. patens
MGYLSCRTEAAIGTCESVHLKQKNQLIKKATKPRNIIPRVFSFSELRDATLNFAESRLLGKGSHGLVYKGVLKDGKEVAVKRATHARQLLQDETSFDNELEILSKIWSERFVNLLGYTREEDEKLLVVEYMSNGTLHDNLHDNFKTTLNWMMRIELALQIARGIFTLHSASPPIIHRDIKSSNVLIDETWKARLGDFGLALRGNIEDMLKSSTPPAGTMGYLDPEYETPSDLSTKTDVFSFGILLLEMISGRNAIDLAYEPPCIHEWAIPLIKQGRMDELLDRKLDLPGNIKPLKQLINLALKCVRSSRLRRPSMLCVVDDLKEIQK

SEQ ID NO: 71686 - protein, 325 aa, Ralstonia eutropha JMP134
MADSERFLVTGALGCIGAWTVRRLANEGVPVVAFDADNDVRRLRLLMDDAQRSRVEMVRGDITDLSLLEATLDHHRITHVIHLAALIHPRFKSDPPLGARVNVLGGVNLFEAVARRVERIPRIVYASSIAVYDNGDAANDAAIQHHTAGHPTTLYGVFKQAEEGMARVYYQDRGVSSIGLRPATVFGAGRDYGLTAAPTQAVLAAALGRPFHIPYSGRSQIHYADDLARMFIACARSGYRGADVFNMHGSVADMGEIVETIESVIPQARGTITFDGASLGLPEDYDATALENVIGPLPRTPLREAVGETFRLFRSRIASGEIRDT

SEQ ID NO: 71687 - protein, 244 aa, Xanthobacter flavus
MKRVQDKVALVTGGAMGMGRTHAETLAAEGAYVFVGDRDAAAGKAVADGIVAKGGKAEFLSLDVTKESDWAAAVDTVKAKSGKLNVLVNNAGILVLKPAHETTNDEWDSTFNVNVRGVWLGIRSFVPLMKGNNGSIINISSIYGIVGAPMAGAYIASKGAVRLLTKSCAVDLIQFGIRVNSVHPGVIDTPMTKDLLHGDPAARKAIMGATLFDRPCQPVEVSKAVLFLASDESSFVHGAEMVVD

SEQ ID NO: 71688 - protein, 363 aa, Yersinia pestis CO92
MGFKCGIVGLPNVGKSTLFNALTQAGIEAANFPFCTIEPNTGVVPMPDPRLDQLAEIVKPQRILPTTMEFVDIAGLVKGASKGEGLGNQFLTNIRETEAIGHVVRCFENDNIIHVAGKVDPADDIETINTELALSDLETCERAIHRVQKKAKGGDKDAKAELEALEKCLPHLENAGMLRALDLTAEDKAAIRYLSFLTLKPTMYIANVNEDGFENNPYLDQVRAIAAAEGSVVVAVCAAVESDIAEMEDEDRAEFMAELGIEEPGLNRVIRAGYELLNLQTYFTAGVKEVRAWTIPVGATAPQAAGKIHTDFEKGFIRAQTIAFDDFITYKGEQGAKEAGKMRSEGKEYIVKDGDVMNFLFNV

SEQ ID NO: 71689 - protein, 315 aa, Yersinia pestis CO92
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQQNLENPIVVSPDIGGVVRARAIAKLLNDTDMAIIDKRRPRANVSQVMHIIGDVAGRDCVLVDDMIDTGGTLCKAAEALKERGAKRVFAYATHPIFSGNAVDNIRNSVIDEVIVCDTIPLSAEIKALKNVRTLTLSGMLAEAIRRISNEESISAMFEH

SEQ ID NO: 71690 - protein, 192 aa, Escherichia coli
LTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMI

SEQ ID NO: 71691 - protein, 141 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTAEFSPDAEADNVDIDAIPNDKMALDIGPKTSELLR

SEQ ID NO: 71692 - protein, 420 aa, Yersinia pestis CO92
MTLLALGINHKTAPVSLRERVTFSPESMDQALNSLLQQPLVQGGVVLSTCNRTELYLSVEQQENLHEQLTAWLCNYHKLSPDDVRQSLYWHHGNDAVRHLMRVASGLDSQVLGEPQILGQVKKAFAESQRGQSLSSELERLFQKSFSVAKRVRTETEIGASAVSVAFAACSLARQIFESLSELHVLLVGAGETIELVARHLREHQVKHMIIANRTRERAQSLASEVGAEVITLPEIDARLADADIIISSTASPLPIIGKGMVERALKTRRNQPMLFIDIAVPRDIEPEVGKLSNAYLYSVDDLQAIIQHNMAQRQAAAVQAESIVQQESMNFMTWLRAQGAVETIRDYRSQAEQVRSEMTAKALVAIEQGANVEQVINELAYKLTNRLIHAPTKSLQQAASDGDMERLQLLRDSLGLDQH

SEQ ID NO: 71693 - protein, 142 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTAEFSPDAETDNVDIDAIPKDKMALDIGPKTSELFAD

SEQ ID NO: 71694 - protein, 482 aa, Chimaphila umbellata
RINSTPSVPGAAVLEKKNLGRIVQIIGPVLDVAFPSGKMPNIYNALVVKGRNTVGQPINVTCEVQQLLGNNRVRTVAMSATDGLTRGMEVIDTGAPLSVPVGGVTLGRIFNVLGEPIDNLGPVDTRTTSPIHRSAPAFIQLETKLSIFETGIKVVDLLAPYRRGGKIGLFGGAGVGKTVLIMELINNIAKAHGGVSVFGGVGERTREGNDLYKEIKESGVINEQNIAESKVALIYGQMNEPPGARMRVGLTALTMAEYFRDVNKQDVLLFIDNIFRFVQAGSEVSALLGRIPSAVGYQPTLGTEMGSLQERITSTKKGSITSIQAVYVPADDLTDPAPATTFAHLDATTVLSRGLAAKGIYPAVDPLDSTSTMLQRRIVGDEHYKIAQRVKQTLQRYKELQDIIAILGLDELSEEDRLTVARARKIERFLSQPFFVAEIFTGSRGKYVGLAETIRGFPLILSGELDGLPEQAFYLVGNIDEA

SEQ ID NO: 71695 - protein, 142 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTAEFSPDAETANVDIDSIPNDKMALDIGPKTSELFAD

SEQ ID NO: 71696 - protein, 79 aa, Glycine max
  misc_feature (30)..(30): Xaa can be any naturally occurring amino acid
  misc_feature (57)..(57): Xaa can be any naturally occurring amino acid
LKSMAGFCTMQNMNDIISIASNGGRVQCLXVWPPVGKKKFETLSYLLDLDDAQFANXVEYLLRNGWILVRYHWSTFVYV

SEQ ID NO: 71697 - protein, 155 aa, Triticum aestivum
  misc_feature (66)..(66): Xaa can be any naturally occurring amino acid
  misc_feature (77)..(77): Xaa can be any naturally occurring amino acid
  misc_feature (84)..(84): Xaa can be any naturally occurring amino acid
  misc_feature (100)..(100): Xaa can be any naturally occurring amino acid
  misc_feature (121)..(121): Xaa can be any naturally occurring amino acid
  misc_feature (123)..(123): Xaa can be any naturally occurring amino acid
  misc_feature (129)..(129): Xaa can be any naturally occurring amino acid
MSAYCGKYKDELIQNAAYIGTPGKGILAADESTGTIGKRFASINVENVEDNRRALRELLFCTPGCXSKYLSGVILFXKETLYQXTKGGKAFVDILRGAMXPGIKGDKGTIELAGNNGETTXRXFDDLGXRCAKYTSWCRSQVGESGASIVSSTKR

SEQ ID NO: 71698 - protein, 470 aa, Diapensia lapponica
MRINPTTSGPGASVLEKKDLGRIVQIIGPVLDVTFPPGKMPNIYNALVVQSRDTVGQPINVTCEVQQLLGNNRVRAVAMSATDGLMRGMEVIDTGAPLSVPVGGATLGRIFNVLGEPVDNLGPVDTRTTSPIHRAAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPWILGEEHYQTAQRVKQTLQRYKELQDIIAILGLDELSEEDRLTVARARKVERFLSQPFFVAKVFTGSPGKYVALAETIRGFQLILSGELNGLS

SEQ ID NO: 71699 - protein, 407 aa, Exiguobacterium sibiricum 255-15
MGIDASIRNQFPILDQQVNDRKLVYLDSAASSQKPLVVIEAIENYYKTVHSNVHRGVHTLGTRATDAYEGARENVRRFIKAQHHEEIIFTRGTTTAINIVASSYGMEHVEEGDEIVVTYLEHHANLIPWQQVAKKKKAKLKYVDLTADGRVTIEAVKEQISDRTKIVAMAHVSNVLGTINPIKEVTQLAHAAGAVMVVDAAQSAPHQQIDVTDLDCDFLAFSAHKMCGPTGIGVLYGKKALLNAMEPVEFGGEMIDYVGLEESTFKPSPYRFEAGTPIIAGAVGLSAAIDFLEQVGLSNIEAHERELAQYAMAQMRDIEGLTIYGPEERVGLVTFNLGDVHAHDVATVLDMQGIAVRAGHHCAQPLMRWLGASSTARASFYLYNTKEEVDALVTGLRQTKEYFSHGF

SEQ ID NO: 71700 - protein, 287 aa, Juglans regia
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWNDQWIFWVGPFIGAAIAAFYHQYILRAGAAKALGSFRSSSTI

SEQ ID NO: 71701 - protein, 127 aa, Metaplexis japonica
NDDLRRGKPTNHKVFGEDVAVLAGDSLLAFAFEYIATATAGVEPARVLAAIGELAKSIGTEGLVAGQVVDLSCTGKSNVGLDQLEFIHIHKTAALLEASVVLGAILGGGTQEEVEKLRRFARCIGLL

SEQ ID NO: 71702 - protein, 290 aa, Zea mays
MGHSLSSHSKSTLSSPPRRSRSLSPMSPPPLRLTAPMQIAAEDSGSDSSSSFAPPARDYTQDLPDEILALVFASLSPTDRNACSLACSRWMEVDATTRHRLSLDARAALGNAAPALFARFTAVTKLALRWARGSGADSLSDYGAAAVATALPSGRLSRLKLRGLRQLSDAGLASLAAAAPAIRKLSVASCTFGPKAFVAVLQSCPLLEDLSVKRLRGLPDTAGATTSIAEDIKFPPASSLRSVCLKDLYSALCFVPLVASSPELRSLKILRCSGAWDLPLEVITARAPGL

SEQ ID NO: 71703 - protein, 850 aa, Rhodococcus rhodochrous
MKADKDVVIVGAGFAGLYAVHKLRNELGLEVQAFDAGGGPGGTWWWNRYPGARCDFDSVYYSYSFSEEIQREWQWTEKYAAQPEILNYLEWVADRLDLKRSFQFNTRVTSMVWNDEGQYWTVGTDDGRTCTARYVVCGTGNVSIPKKPEFPGIEDFKGEVLQTSSWPHEPVDFSGKRVGIIGTGATGIQLIPELAKHAAHLTVFQRTAQFASPLGNEKLDPEARRWLAENHKQVRAGARDHFLGAPYDAPRPSALADSPEERKKVYDEHYGSGGFRMVVSTYGDLLYNRESNDTIADYLRDRIRERVTDPKIAEMLCPTDHPYATKRAPFETNYYETYNRDNVTLVDVRSTPIERVTEHALKTTAAEYEIDVLVMATGFDVFTRPLLEMGIVGRDGLTLDEKWSGVPGTYLGIQTAGFPNLFTVTGPQSAVALYNNALAIEDHVEWISRAIGHLRTTGATTIEPTAEAESRWGDFAEGILNQTLIPQSESSWYMGANVVGKTRGTYIFAAGAPVYRAICAQVAERGYAGFAIDGVETAVPPMAKLDPEVVTALSAIHRPGYKPLEDCTVEETRAMVEQLVGMQVPGPDMLVDDIVDPAVRLYVPRTQTEGTRPVIVFLHGGGWVAGSLDVVDNPCRQIARATDAIVVSVDYRLAPEHPFPAAHDDAFEAVRWVQENIAGYGGDADKIVIMGESAGGNLAASTALRARDAGLKLAGQVLVYPPTDPEASTQSRVEFADGPFLSVKAVDTMWGAYLNGAEVTETVAPLRAENLRDLPPALIFSMELDPTRDEAEDYARALQDAGVRVELHRFEGMIHGVFNMDAIVSAAPEMYSLTAQFVADTVTAEPVSVR

SEQ ID NO: 71704 - protein, 127 aa, Metaplexis japonica
NDDLRRGKPTNHKVYGEDVAVLAGDALLAFAFEHIVTATKGASSEQLVRVIEELAKCIGSEGLVAGQVVDICSEGISDVGLEHLEFIHLHKTAALLEGSVVLGAILGGANDVQISKLRKFARCIGLL

SEQ ID NO: 71705 - protein, 487 aa, Physaria fendleri
MANVKLLYHYLITHFFKLCLLPLIALVASKASSLDQEDLQNLWFHLQHNILTLTILFAVLTFVSAIYFLTRPRPVYLVDYSCHLPPPHQKITVKKIVENVNKNRELDASHNSKIPESSLDFVLRLLERSGLGEETYIPDSLLNVPPIQTMAAAREETEQVIFNAIDNLLANTKVNTRDIGIIIVNSSMFNPTPSLSAMVVNKYKLRSTIKSFNIGGMGCSAGIIAIDLAKDLLQVHKNTYALVISTENLTRNMYVGNNRSMLVANCLFRLGGAAILLSNKSGERRRSKYKLLHTVRTHTGADDKSFRCVQQEDDDMGKTGVSLTKDITSVASRTITKNIATLGPLVLPISEKILFFITYIHKKFVNDKVKHYIPDFKRAIDHFCIHAGGRALIDELEKNLGLLPIDVEPSRSTLHRFGNTSSSSIWYELAYTEAKGRMKKGNKAWQIALGSGFKCNSAVWVALCDVKPSVNSPWEHCLDKYPVKLDL

SEQ ID NO: 71706 - protein, 94 aa, Zea mays
MDGQPGAAASSSPGRRVKASLVLGSESFTINSESGTLSEQLATVKEKSMAVLKEHIARHNAPNEVPDEAAEGESDSEDEAALVDNPPKKPKKQK

SEQ ID NO: 71707 - protein, 390 aa, Pseudomonas syringae pv. phaseolicola 1448A
MPQPYSARSRAIEPFHVMALLARANELQAAGHDVIHLEIGEPDFTTAQPIIKAGQAALADGKTRYTAARGLPQLREAISGFYARRYGVDIDPQRILVTPGGSGALLLASSLLVDPGKHWLLADPGYPCNRHFLRLIEGEAQLVPVGPQERYQLNPELVAAHWNQNSVGALVASPANPTGTLLNRDELAALSQALKARNGHLVVDEIYHGLTYGVEASSVLEVDNEAFVLNSFSKYFGMTGWRLGWLVAPQDAVADLEKLAQNLYISAPSMAQHAALACFEPQTLEIFEQRRAEFGRRRDFLLPALRELGFGIAVEPEGAFYLYADISAFGGDAFAFCRHFLETEHVAFTPGLDFGRHQAGHHVRFAYTQSLPRLQQAVERIARGLRSWGA

SEQ ID NO: 71708 - protein, 339 aa, Clostridium perfringens SM101
MKKVLVLGEMLMRLTPPNNNKIGQANTFNVCFGGAEVNVAVGLSNLGIETRVLTALPDNEIGNFAKFFLKSQHVDCDFIISKGDRLGLYYYEEGCSARKAKVVYDRKHSSITELQYEDIDVESLFKDIELLHISGITFGLSEEVSGVALKLVNEAKKRGIKISIDLNYRSKLFESYEEFVRIMTPIVQDAYLCFGWLNKENEPFKVLDASTTELSDEDFIERFRYTIEDLKVKNIVTTLRSGTPYNYHTLQGVFYDGKRVYKSSKYDFSMISRIGGGDAFAAGVIRTLIENKWEDLSHVIEFGTAAAVLKQTQLGDVSVSSNEEVLDLINNKNLGSVNR

SEQ ID NO: 71709 - protein, 386 aa, Methylococcus capsulatus str. Bath
MNLHEYQSKRLLADYGVPVPRGGVAFSPDEARSCALQIGGERWAVKAQVHSGGRGKAGGVKLCSSEDEVAAAAHALLGSELVTSQSGGKGLPVHAVLVEEVRGIAREIYLSVLVDRSSATIMFLASGEGGMDIEAVAAGSPEKILSSRIHPAAGFQPYQGRDIGYALGLDAAQIGTLVRLMAGMYRLFVEKDLSQIEINPLIVTAEGELLALDAKIGIDDNALFAHPELAGLRDASQEDARENAAREHGLSYVTLGGNIGCMVNGAGLAMATMDMVKLHGGEPANFLDVGGGATAEKVAEAFKLILSDSGVRAVLVNIFGGIVRCDLIAEGLIAAVREVRVGVPVVVRLEGTNAGEGRALLERSGLAIIAADELDEAARKAVEAAA

SEQ ID NO: 71710 - protein, 108 aa, Zea mays
LSPTKMSTVTRAHLDQRLAAAKRCSKEAAMAGAKAAAVATVAAAVPTLASVRMLPWAKAHLNPTGQALIISTVAGMAYFIVADKTILSMARKHSFDDAPEHLKNTSFH

SEQ ID NO: 71711 - protein, 100 aa, Coccidioides immitis RS
MVVTALKDNAAFQAAINPAAVASEGKKLVVVDCFATWCGPCQAIAPKVNEFSEKYPDVAFYKIDVDDAPDVAQELGVRAMPTFVFFKDGQKVDEIEIWDE

SEQ ID NO: 71712 - protein, 395 aa, Bradyrhizobium sp. ORS278
MHTGRHFLQIPGPTNVPDRVLRAMDMPTLDHRGPEFAELGFAVLAASQRIFRTKQPVVIYPSSGTGAWEAAIVNTLAPGDKVLMAETGQFAVLWKAIADKFKLDVDFIAGDWRHGADIAAIEQRLVADKAHKIKAVCVVHNETSTGCLTPPLDVRKALDRAGHPALLMVDTISGLGSMEYEHDAWGIDVSVAGSQKGLMLPPGLGFNAVSEKALAVAKANPGMRSYWDWQEVISFNKLGTFPYTPACNLLMGLNEALKMLEEEGHENVFARHRRHSLATRAAVKAWGLDTQCQDPQAHSPALTGVVMPEGHDADAFRKTVLENFDMSLGTGLNKIKGKVFRIGHIGHFNDLMLMGTLSGVEMGLALANVPHRAGGVLAAMDVLKAREAAPIPKVA

SEQ ID NO: 71713 - protein, 401 aa, Bradyrhizobium sp. ORS278
MTRHQGRHFLHIPGPSPVPERVLRAMDMPVIDHRSAEFAELGKAVLSGSQKIFKTTGPVIIYPSSGTGAWEAAIVNTLSPGDRVLMVETGHFATLWRQMAARWGIEVDFIPGDWRRGVDPAAIEEKLTADTAHQFKAVMVVHNETSTGATSRIGEVRAAMDRAGHPALLMVDTISGLASADFRFDEWKVDVAVSCSQKGFMLPPGLGFNAVSDKARAVAKANKMPRSFWDWEDMLKLNANGFFPYTPATNLLYGLREAIAMLLEEGLEQVFARHQKLAAATRAAVEHWGLDVLCQEPRDYSPVLTAVLMPPGHDADQFRQVVLDNFNMSLGSGLSKVAGKVFRIGHLGECNELTLMAALSGVEMGLRVAGVPHRGGGVDAAMALLEQPLPGNAPRHLAVVK

SEQ ID NO: 71714 - protein, 287 aa, Juglans regia
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWDDQWIFWVGPFIGAAIAAFYHQYILRAAAAKALGSFRSSSHM

SEQ ID NO: 71715 - protein, 214 aa, Vitis vinifera
MASLFLPKHSLPSLLSTQIPKTPSLHSLPLVSKSSHSQFYGLTFSSSPSLPLPSSSSPKKASIFAKVSKGQVPPPFTLKDQDGKTVSLSKFKGKPVVVYFYPADETPGCTKQACAFRDSYEKFKKAGAQVVGISGDDPSSHKAFAKKYRLPFTLLSDDGNKVRKDWGVPADLFGTLPGRQTYVLDKKGVVQLIYNNQFQPEKHIDETLKLLQTL

SEQ ID NO: 71716 - protein, 166 aa, Lipomyces kononenkoae
MTDKFPEDVKFLYIAYTPAKADITACGIPIPLDFDKEFRDKTVVIVAIPGAFTPTCTANHIPPFVEKFTALKSAGVDAVIVLSANDPFVQSAFGKALGVTDEAFIFASDPGAEFSKSAGLSLDLPPAFGTRTARYAIIVSNGVVKYVEKDSEGVAGSGVDAVLAAL

SEQ ID NO: 71717 - protein, 307 aa, Exiguobacterium sibiricum 255-15
MIAKSVRDLVGNTPLYEITSFDLPAGTRILAKLEWMNPGGSVKDRLGIQLVDAAIEQGYVTRGGTIIEPTAGNTGIGLALAAKKYDLQVICVVPEKFSQEKQTLMRALGATVVNTPTELDMQGAIDKAKELGQTIPNSYVPLQFENEENPVTYQRTLGPELMAELDQIDWFVAGCGSGGTFAGTAAYLKERLGTKGAIVEPEGSVLNGGPAGPHKTEGIGTAKWPSLVSRDLVDEIHTISDHDAFTKVHELAAREGLLVGSSAGAALVAALDLAHRFPGSTIVTVFADSAERYLSQQIFEKVDETHA

SEQ ID NO: 71718 - protein, 291 aa, Triticum aestivum
  misc_feature (135)..(135): Xaa can be any naturally occurring amino acid
  misc_feature (146)..(146): Xaa can be any naturally occurring amino acid
  misc_feature (174)..(174): Xaa can be any naturally occurring amino acid
MEGKEEDVRLGANKYSERQPIGTAAQGSEDKDYKEPPPAPLFEPGELKSWSFYRAGIAEFMATFLFLYVTILTVMGYSGATSKCASVGIQGIAWSFGGMIFALVYCTAGISGGHINPAVTFGLFLARKLSLTRAXVFYIIMQCLGXAICGAGVVKGFQQGLYMGNGGGANVVAXPGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAVYHQVVIRAIPFKTKS

SEQ ID NO: 71719 - protein, 482 aa, Azospirillum brasilense
MANQRMLGFVHTAQRMPDKRPAAERRQDFAEIYARFSDERANEQANRCSQCGVPFCQVHCPVSNNIPDWLKLTSEGRLEEAYEVSQATNNFPEICGRICPQDRLCEGNCVIEQSTHGAVTIGSVEKYINDTAWDQGWVKPRTPSRELGLSVGVIGAGPAGLAAAEELRAKGYEVHVYDRYDRMGGLLVYGIPGFKLEKSVVERRVKLLADAGVIYHPNFEVGRDASLPELRRKHVAVLVATGVYKARDIKAPGSGLGNIVAALDYLTTSNKVSLGDTVEAYENGSLNAAGKHVVVLGGGDTAMDCVRTAIRQGATSVKCLYRRDRKNMPGSQREVAHAEEEGVEFIWQAAPEGFTGDTVVTGVRAVRIHLGVADATGRQTPQVIEGSEFTVQADLVIKALGFEPEDLPNAFDEPELKVTRWGTLLVDHRTKMTNMDGVFAAGDIVRGASLVVWAIRDGRDAAEGIHAYAKAKAEAPVAVAAE

SEQ ID NO: 71720 - protein, 540 aa, Klebsiella pneumoniae subsp. pneumoniae MGH 78578
MTGRLDSEVIIIGGGATGAGIARDCARRGLRTLLIERHDIATGATGRNQGLLHSGARYAVTDNESARECISENRILRRIARHCIEPTNGLFITLPEDDLAWQQTFIDACQQAGIEATPLSPQEALRREPAVNPTLLGAVQVPDGTIDPFRLTAANMLDAREHGAQILTGCEVTGLLRRGDRVCGVQVYDRQLHQARTLYAGMVVNAAGIWGQRIAEYADLRITMFPAKGSLLILDHRINNLVINRCRKPADADILVPGDTISLIGTTSMHIPYDEIDDNRVTAAEVDTLLREGEKLAPVMGRTRILRAYSGVRPLVASDNDPSGRGVSRGIVLLDHAQRDGMEGFITITGGKLMTYRLMAEWATDAVCRKLGNTTPCTTAEAPLPGSQEPTESTLQKIISLPTPLRGSAVYRHGDRTPSWLGDSRQHRSLVCECEAVTAGEVKYAVENLAVNTLLDLRRRTRIGMGTCQGELCACRAAGLLQRFNVTTPAQSLTQLSEFLNERWKGVQPIAWGDALRESEFTRWVYLGLCGLPQEHRDEV

SEQ ID NO: 71721 - protein, 368 aa, Rhodococcus sp. RHA1
MSAGRVVVEADGGSRGNPGPAGYGAVVFDAANGTVLAERKESLGIATNNVAEYRGLIAGLDAAAELGASEVDVRMDSKLVVEQMSGRWKVKHPDMIPLQRQASTLARQFDSVTYTWIPRAENAHADRLANEAMDGADGDADVEPEPAAVPSEKTTPAAPGWMDTTGAPTRMLLLRHGQTPLSVDRRYSGRGNPALTEIGQAQANGAAVRFAGNNGIAAVVSSPLGRAQQTATAAAKVLGLPVTVHEGLTETDFGEWEGLTFREAAERDPELHRKWLSDTSVCPPAGESFDEVRERILKVRDDLTASYAGSTILVVTHVTPIKTLLQLALDAGPSLLYRLHLDLASLSIAEFYPDGGSSVRLVNDTSHL

SEQ ID NO: 71722 - protein, 126 aa, Youngia japonica
NDDFRRGKPTNHIVYGEDVAVLAGDALLSFSFEHLATATKGVSSDRILRAIGELAKCIGSEGLVAGQVVDICSRRRRCRIRPFGVYPFTQDAALLEGSVVLGAIMGGGSDEEIEKLRKFARSIGLL

SEQ ID NO: 71723 - protein, 440 aa, Physcomitrella patens subsp. patens
SGKLSMSRASAGSDSNESSCSSIGYGASKPHKANDKRWEGIQAIRIRDGALGLSHFKLLKRLGCGDIGSVYLAELRGGHSHFAMKVMDKGSLASRKKLLRAQTEREILQSLDHPFLPTLYTHFESEKFLCLVMEFCSGGDLHTLRQRQPGKHFSEQAARFYAAEVLLALEYLHMMGVVYRDLKPENVLVREDGHIMLSDFDLSLKCVVSPTLVRSTVHESRDGKGSGAYCMQPAACAEPACTGGFEDGKSPKPSPGKSKSKSKADCGHSVSSLPELIAEPTGARSMSFVGTHEYLAPEIIKGDGHGSAVDWWTFGIFLYELLFGKTPFKGSGNRATLFNVVGQPLKFPDSATGQVSFAARDLIRGLLMKEPVLRLASKRGAGEIKAHPFFEGVNWALIRCTNPPEVPRPFEPGPSSNSNRSATAVSTQSSGGSYVDFDFF

SEQ ID NO: 71724 - protein, 127 aa, Youngia japonica
NDDFRRGKPTNHKVYGEDVAVLAGDSLFAFAFQHIASATVGASPARVLAAVGELAKSIGTEGLVAGQVVDIASTGVKDVGLEQLEFIHIHKTAALLEAAVVLGAILGGGSDTQVEELRTFARCIGLL

SEQ ID NO: 71725 - protein, 1049 aa, Vitis vinifera
  misc_feature (5)..(5): Xaa can be any naturally occurring amino acid
  misc_feature (388)..(388): Xaa can be any naturally occurring amino acid
  misc_feature (486)..(486): Xaa can be any naturally occurring amino acid
  misc_feature (644)..(644): Xaa can be any naturally occurring amino acid
  misc_feature (723)..(723): Xaa can be any naturally occurring amino acid
  misc_feature (739)..(739): Xaa can be any naturally occurring amino acid
MVMDXEVEEGGGGQVVETGEEETAPNASNTQGCTCEVQELMVVIGSIVAIGDYRRTQKKECQNLVRRLKLLLPLLEDVKDLHGQVPEKSLNPFWNLKKALLRVKKLLITCSEGSKIYLALENEAVMARFHRANEKLSQALEDLPYEELGVSEEVKEELDLVRMHLKRSKRRTDTQDIELAMDMMVVFSKDDERNADSAIIVRLAKKLELLTVEDLNAETIAVRKLVKERGGQNAESTQHVIELLNKFRQSGGLEEINVLDDPIVPKTLEKSPSLAIPHEFLCPITLEIMTDPVFVATGQTYERESIQKWLDSNHKTCPKTMQPLVHSSLVPNYALRNLILQWCENNNFQIPKKDASSSTEGSSEQKESVLSVVQNLSSNQLEVQRKAXKKIRMLSKENPVNRVLIAQSGGIPPLVQLLSYPDSKIQEHTVTALLNLSIDEANKKLIAIEGAIPAIIDVLRKGSVEAKGNSAAALFSLSIDDDIKAXIGLSNGIPPLVDLLQHGTIRGKRDAATALFNLSLNKANKTRAIEAGVIPPLLQLIKSPNSGMIDEALSILFLLASHPDGRQEIGQLSVIETLVEFIRDGTTKNKECATSVLLELGSSNSSFILAALQYGVLEHLIEITKSGNSRAQRKANSLLQLMSXCDQKFVKMVGTDENNPGVGVIGPANNQGGLRAGVGKFTTGIGHNRRALSSIDRNIIGVPPYPCAVGSWPFLVSHVSDSXKIHVLIKLFLFDFCLXFRKFAAQMASNKQQRAAIPEESRKLVLQSAPSELKDCVFVDAEDCKGTSDLPVPMSVQHTEAMLEEIDRMEEEIEMEDLVKEPVMDIDGSDNKNSLAVVEYIDEIYAYYRKTESSSCVSPDYMSQQFDINDRMRGILIDWLIEVHYKFELMDETLYLTVNLIDRFLALQPVVRKKLQLVGVTAMLLACKYEEVTVPIVEDLILISDKAYSRKEVLDMEKLMVNTLQFNMSVPTPYVFMRRFLKAAQSDKKLELLSFFIIELCLVEYEMLKFSPSLLAAAAIFTAQCTLNGSKHWSRTCEWYTRYTEEQLL

SEQ ID NO: 71726 - protein, 208 aa, Arabidopsis thaliana
MAPTIRTIGSYATQQRYSVDFFGEELFVTVTPDPSVIGQWIHDVFFHNRLSSHPLVVGVGVHSDPPADTLQLCVGNRCIIIQLRYCERVPQVLRNFLADRDNTFVGIWNSQDAGKLERSRHQLEIAELMDLREFVSDSSGRRSMYNYSLEKIVEENLGYPGVRLDREVSMSDWRVYNLSYDQILQASIDVYACCSLAILDHLWEEKNR

SEQ ID NO: 71727 - protein, 100 aa, Oryza sativa
  misc_feature (24)..(24): Xaa can be any naturally occurring amino acid
SDPQNIIDDTCMRASVPTVKLVIXNGAKVILASHVGRPKGDTRKNSLKPMVPRLTELLGVDVEKANDCIAEEVDKLAAAVPDGGGLLLENVRFYKEEEND

SEQ ID NO: 71728 - protein, 77 aa, Glycine max
ISSPAVATVNRAGACMVAPFTGLKSMDGFPTINTNDDVASIAIYGVTVQCIQVWTPVGRRKFDTLSYLPDLDDAAIG

SEQ ID NO: 71729 - protein, 141 aa, Mannheimia succiniciproducens MBEL55E
MSLERTFSIIKPDAVERNLIGKILARFEQSGFEIVAAKMVRLTKAQAEGFYAEHQGKPFFEDLVEYMVSAPILVSVLQKENAVKDYRTLIGATDPAKAKEGTVRKEFAESLRRNSVHGSDSLESAAREIAYFFIDSEICSR

SEQ ID NO: 71730 - protein, 298 aa, Nocardia farcinica IFM 10152
MVPAAGLGTRFLPATKTVPKELLPVVDTPGIELVATEAADSGAQRLVIVTSPGKDGVVAHFVEDLVLESTLAERGKFQLLEKVRKAPALLDVTSVVQEEPLGLGHAVAQAEQALDDDEDAVAVLLPDDLVLPCGVLDVMSRVRRKRGGTVLCAIDVPKDQVSSYGVFDVAPVPDAANPNVLRVKGMVEKPALADAPSTYAAAGRYLLDRAIFDALRRIEPGAGGELQLTDAIALLIEEGHPVHVVVHRGSRHDLGNPGGYLRAAVDFALEREEYGPALREWLQHRLSSDWDPQLTTYE

SEQ ID NO: 71731 - protein, 320 aa, Gloeobacter violaceus PCC 7421
MHIAHDITELIGRTPLVQLNRIPAAEGALARIVVKLESFNPAASVKDRIGVSMINEAEKSGFILPGKTTLVEPTSGNTGIALAMVAAARGYRLILTMPETMSSERRALLRAYGAQLELTPGSEGMRGAIRRAEEITREVPDAFILQQFRNPANPKIHRETTAEELWRDTDGQMDIFVSGVGTGGTVTGVGEVWKVRKPGVQIVAVEPAASPVLSGGKPGSHLIQGIGAGFVPDVLRRDVIDEVIAVADEKAIEYSRRLAKEEGLLSGISTGAALWAALQLAKRPENTGKLIVFIQPSFGERYLSTALFQNEGQSPTAVAR

SEQ ID NO: 71732 - protein, 370 aa, Chlamydomonas reinhardtii
MASLERVASHRAASCSQIISPVRFGRWQSVVHVSRLDRRVALPSRVLVSAAAADVPQQGAPITSSTPYVPTAHQSIDEDNVLTSFIAETLLPTRHGKFRLRGYKHSTDGGATFTEPTAIVSGKVEGQEDVAVRVHDACFTSEVLGSLKCDCAEQLELALRMIQGAPPGIVIYLQQEGRGIGLANKIAAYSLQEQGLDTVDANRALGLPDDCREYTSVRNMLQDMGVKSIRLITNNPRKINTLTKLGIQVNGRIPCLVAAGAYNQGYLEAKRDRMAHMLPEEEALGSSLGGPEPAAAAAQRPNGAGVEAGELNGDFCFWDHSGEPTQAVATVYAKGGMDLPQGLAHGDNGRVVPVAAAPAGSSSGSDAGSS

SEQ ID NO: 71733 - protein, 393 aa, Vitis vinifera
MQQQRLKQQQQALIQQSLLQQQSLYHHPGLLAPPQIEPILSGNLPPGFDSSTCRSVYVGNIHPQVTEPLLQEVFSSTGPLEGCKLIRKEKSSYGFVDYFDRRSAALSIVTLNGRHLFGQPIKVNWAYASSQREDTSGHYNIFVGDLSPEVTDATLFACFSVYPSCSDARVMWDQKTGRSRGFGFVSFRNQQEAQSAINDLNGRWLGSRQIRCNWATKGAGGNEDKPNSDAKSVVELTNGTSEDGKDKSNDEAPENNLQYTTVYVTSVDLHRHFHALGAGAIEDVRVQRDKGFGFVRYSTHAEAALAIQMGNARILCGKPIKCSWGSKPTPAGTSSTPLPPPAAPHMPGISAADFAAKMGGSACPKADSHGNGQAIYDGGFQNAATTQQLMYYQ

SEQ ID NO: 71734 - protein, 591 aa, Oryza sativa Indica Group
MDQYEVLEQIGKGAFGSALLVRHKLEKKKYVLKKIRLARQTDRTRRSAHQEMQLIATVRNPFIVEYKDSWVEKGCYVCIVIGYCEGGDMAEAIKRANGTYFSEEKLCKWLVQLLMALDYLHANHILHRDVKCSNIFIARDQSIRLGDFGLAKILTSDDLASSVVGTPSYMCPELLADIPYGTKSDIWSLGCCIYEMTALRPAFKAFDMQALINKITKSIVSPLPTKYSGAFRGLIKSMLRKSPEHRPSAAQLLKHPQLQPYVLQVQLKSSPTRNILPIHQSLTDKVKKMTFPSDVVDSARRRMARRNSLGNERTVTFSKPSPERNSVSSTRSIKEYTTTQSVEGLSVDSSEAGDEVTSKAIITKTSSILRTPKSLPAKTYTARNQLEPPKTSYNRTYRSELPSKTTPNKIARPARRASLPLSTYETPTKRSISILEQLDSPDVSVNAPRIDRIAEFPLASSEDPLLPIHNKLSPGHGSCSTPPFINRSITKDKCTIQVLRTDGDNGSDSSGRNATAASSRGSNDSRQQRFDTSSFQQRAEALEGLLEFSAQLLQQERYEELGILLKPFGPEKASPRETAIWLTKSFKETAS

SEQ ID NO: 71735 - protein, 233 aa, Exiguobacterium sibiricum 255-15
MERRTNMTRMREDIRNVFKQDPAARSTIEVVLTYPGLHAVWMHRLAHRMWKMNLHLAARMLSQFSRFLTGIEIHPGATIGRRFFIDHGMGVVIGETAIIGDDVTLFQGVTLGGTGKETGKRHPTLGNGVLVSAGARVLGDITIGDSSKIGASSVVLKDVPSNATVVGIPGRVVIQDGIKVDAPLDHQLPDPVRECQERVELELEQLKYEIERIKGGHRHDTTLQQHDRKKGTV

SEQ ID NO: 71736 - protein, 503 aa, Mycobacterium sp. JLS
MSSAAGMVATSHPMAVRTAVTILEEGGTAADAAVAAAAMLTVVDPPSTGVGGDLFALYWESGGTEPVGLTAAGVAPAALSVQALRDSGFDTMPADGPWTVTVPGATWGWSALLERYGTLGRDRVLAPAVEAARTGFAVTPAVAEEWKLGANRLRADPHAAALFLPAGRAPRVGDVFRNPDLAETLQTYAREGHAPFYTGDIAADFADAVHPLRTSDLGEWPGPEWVTPIRARFRGVDVYEMPPPGQGLAVLQALRLYQRFAPDSDHHLVESIKAAVADAADHIADPRFHPVPVAELLGDGRVGELADRIGATASDGRTPGMPSDTVYVCVVDRWGAACSLIQSIYDGFGSGVLAPGRGVLLQNRGAGFTLRDGHPNRPEPRKRPYHTIIPAMLGGPDGFRGSLGVVGGFMQPQGQVQVLRNVLDRGMSAQQAVDAPRLRVLGGHTLGLEEGFDAGGAAELARRGHRLSALPRSECGGAQLILRTPAGLDGGSDFRRDGYVGVC

SEQ ID NO: 71737 - protein, 256 aa, Saccharomyces cerevisiae
MFKSVAKLGKSPIFYLNSQRLIHIKTLTTPNENALKFLSTDGEMLQTRGSKSIVIKNTDENLINHSKLAQQIFLQCPGVESLMIGDDFLTINKDRMVHWNSIKPEIIDLLTKQLAYGEDVISKEFHAVQEEEGEGGYKINMPKFELTEEDEEVSELIEELIDTRIRPAILEDGGDIDYRGWDPKTGTVYLRLQGACTSCSSSEVTLKYGIESMLKHYVDEVKEVIQIMDPEQEIALKEFDKLEKKLESSKNTSHEK

SEQ ID NO: 71738 - protein, 207 aa, Oryza sativa
MGTATLSSVSKGATRETISRKPHTVSCKVADKYGSVTVRMMLPPMGSSVVATRVPKKVLKFAGIEDVFTSSRGSTKTLSNFVKHQMKRALNFQYKPPPLPPFLRQSRPPRRGAASPTRSKRDGSGSGEGSSFAGLPLDALFEILLLCGLVARQQPEGDLHLPPQRLSAVCRGRGHQRARVLVEPVVPRSIVRQPGLRRITSSPPTPR

SEQ ID NO: 71739 - protein, 373 aa, Robiginitalea biformata HTCC2501
MVYQEFQCKGPLGPLPAGEVGWQAPSNIALVKYWGKRDGQLPTNPSVSFTLEACRTSTRIAYSPLEQSVKGPRFRVFLDGFPAPDFEPKIRQFLERALPYAPFLSGLHLEIRTENSFPHSSGIASSASGMAALALCLVSLEEQLLPGTDPGYARRKASFLARLGSGSAARSTAGGLILWGEQEGIPESTDLLGVPYPGEVHEVFHTYHDTILLVDKGQKTVSSSVGHGLMDGHPFAAERFEQARRHLEKLGGIFASGDLEAFANLVESEALSLHAMMLTSTPSFILMKPGTLEIIEKIRDYRRETGHPVCFTLDAGANVHVLYPEASAGPVYSFIREELLEHCVSGQHICDRVGSGPQPIKNAPDRTSDKGIG

SEQ ID NO: 71740 - protein, 369 aa, Pseudoalteromonas tunicata D2
MKLNSAAEIIEDIRAGKMVILMDDEDRENEGDLIMAAEHISADAINFMATYGRGLICLTLTQDRCRQLDLPLMVRNNGAQFSTNFTMSIEAAKGVTTGISAADRARTVQAAVAKGAVPTDIVQPGHIFPIMAQPGGVLTRAGHTEAGCDLARLAGCEPSSVIVEILNPDGTMARRPDLEVFAQQHGLKIGTIADLIEYRNLNEATIERVAKCKLPTEHGHFDLVTYKDTIDGQLHYALVNGAIESHTPTLVRVHLQSTFNDLLLSDRVADRSWTLPNAMQRVASEGGVVVILGKQESPAELESIVKALEAQDNGETTQLRKFQGTSRTVGVGSQILADLGIHQMRLMSLPKKYHAISGFGLEVIEYVEP

SEQ ID NO: 71741 - protein, 452 aa, Methylococcus capsulatus str. Bath
MISYRLSDSIPFPLTMNDDMTAEFSTDAQQLLDFIDQSPSPWHAGRSIAARLLAAGFRRLEEGEVWRLEPGDRAFVVRGDSSMVAFIVGGGTLAETGFRIVGAHTDSPGLRVKPRGAHAEGSMLRLGVEVYGGPILATFADRDLSLAGRVGVRTEAGVDIRLVDFPDALVRLPNLAIHMNREVNKDGLKFNKQTELPLLLAVADEVPAEDRLRALLSERAGCDPKDVLSWELSVFDTQPGAFWGPQREFIADGQLDNLASCHAGLSALLQVSHAEAVAVAAFFDHEEIGSESHKGADGALLPDVLERIALALGLDRTGYKRALARSFLVSADMAHAYQPNFPQSYEPQHKVFVNAGPVVKTNACGRYATDAEAAARIIRLCERAEVPYQQYVHRTDLGCGSTIGPMTAARLGIPAADIGNPMWAMHSVRESAGVRDHTHMIRLLRCFFSTGA

SEQ ID NO: 71742 - protein, 332 aa, Candida albicans SC5314
MPFVNKSGFFDPSTAPYYDPKETRKVVFITGGNSGIGWYTVLHLYLHGYIVYVAGRTESKVLKAIDDIKAEAENRQAKETTKHPLGELNYIHIDLLDLSTVTKAVDEFAEKEKILDVLINNAGLMGVPYEVTKDDYEIQYQVNFVAHYLLTLKLLPFLQSAVKIGVTPRIINLASIGHNFQFKHFTPEQNKLDKFPNSVFTWVRYGIAKSSQIQFAKELANHYPDILSVSVHPGVILGTELYNHWKNIPIIGIGARGIFALSDKLIGVSNEEGSLATLRAALDPSLTLKENGEYLITGGKIDEPSKIASNTQYSKETWDWNYEQLKKRGYNI

SEQ ID NO: 71743 - protein, 154 aa, Pseudoalteromonas tunicata D2
MKIIEGNMNATGKKFAIVISRFNSFIGSSLLAGAVDTLKRTGGVNDEDITVIYVPGAVELPLVAKRVAAKKEYDAIIALGVVIRGGTPHFDLVAGESNKGLAQVSLEYDIPVAFGVLTTESIEQAIERAGTKMGNKGGEAALGALEMVNVLDQI

SEQ ID NO: 71744 - protein, 447 aa, Corynebacterium glutamicum ATCC 13032
MTVDEQVSNYYDMLLKRNAGEPEFHQAVAEVLESLKIVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKAANAGGVATSALEMQQNASRDSWSFEYTDERLQVIMKNIFKTCAETAAEYGHENDYVVGANIAGFKKVADAMLAQGVI

SEQ ID NO: 71745 - protein, 270 aa, Nitrosomonas europaea ATCC 19718
MKITFIGGGNMAGAMIGGLIHHGSTPSHICAVETDAMRRQQLAEACGVTVTASIPDGIHGSEIVILAVKPQQLRAVANQAAQFLQNKLVISIAAGVRASDLSQWLNRHEFVIRAMPNTPALIGEGITGLYALPLVDSRQKEQATTILEAIGTVIWVNEEAQLDAVTALSGSGPAYVFYFLEAMQEAGTQLGLTADTAKQLAMQTFLGATHLAAQSNDTLATLRMKVTSQGGTTEQALLSMEQADIRGAFIRAMHAACDRSRQMGEIFGRT

SEQ ID NO: 71746 - protein, 329 aa, Vitis vinifera
MAVTSRFLSLPPPTTPTATKPTIFSIAPTSISIPTRRRRSPVPAMAFACSTTSFIGRVGFHRREGNVSILSFGINPGPISEIPTTDSSQLLSALLPFVVAATAVAALAQPSTFTWVSRELYAPALGGIMLSIGIRLSIDDFALAFQRPLPLSIGFMAQYALKPALGVLIARALGMSQLFYAGFVLTACVAGAQLSSYASFLSKGDVALSILLTSSTTIASVLVTPLLTGLLIGSVVPVDAVAMSKSILQVVLVPVTLGLALNTYAKPVVNLLRPVMPLVAMRVSVWFSGDHISSLTCIFEPDDRCGSCAGKKKKFAGQFLCARECKARP

SEQ ID NO: 71747 - protein, 496 aa, Nitrosomonas europaea ATCC 19718
MNDAKMSQTEKLPCLFVIFGATGDLASNKLLPALFELENAGRLADNFSIVAFSRREWTTDDWLEHLREILKNRIDQSFPEGVLERFFARFRYQQGDLNDIESYRVLAAGLAPGSACSRTVFYLAIRPADFVAVIRNLKAAGLNEPRGMNRVVIEKPFGEDLESAQVLNRLLHQHFDEEQIYRIDHFLGKETVQNLLVFRFANTLIEPLWNRNFIDHVQITVAESGGIEKRAGYYDRAGALRDMLQNHLMQLLTVVAMEPPPALEADALRDEKVKVLRSIRPIAKRAIHAHAVRAQYTHGNIDGQVVAGYQQEDNVERDSITETFVAAKFYIDNWRWRGVPFYLRTGKRMPKQNSMIAIRFKHPPQQLFRETPLEWIAPNWVLLSIQPEESMHMEIHVKQPGLDMNTRVMQMNASFLKTDEQALDAYEALLLDVIEGDRSLFIRFDEVEWAWQVIDPILKHWVVEREYIPTYPAGSWGPAEANRLFDNDDQTWRNEL

SEQ ID NO: 71748 - protein, 284 aa, Archaeoglobus fulgidus
MVILVGGTNGLMALKVAKISGLPLCYSHVDRYPDGEKYFRFASNIDGEDVVIFNSMHPNPDEIIFETLLIAETAYSNGARSVTCVFPYFAYARSLDTVKGEALPIKTVVKVLKAAGVKKIITVDFHLQENVFGVEHVDLTGMEKLAEYCLEEFSDSFTVLAPDEKAAFWAEKFAAKANCDVVALRKIRIDAENVIIDDLRTGVEGDVVIVDDIVSTGGTVCQAARIAKRAGARRVFVACTHAILARDAMMRILESGIEDIVSTDTILSPVSHVSVADVIASALS

SEQ ID NO: 71749 - protein, 317 aa, Corynebacterium ammoniagenes
MSTQYLNSNLKVFSLNSNKELAEQIAKHIGVGLGKCSVDRFSDGEVQINIEESIRGCDVFIIQSTSFPVNEHIMELLIMIDALKRASAKTINIVIPYYGYARQDRKARSREPITSKLVANLLETAGATRVITLDLHAPQIQGFFDIPIDHLMGVPILSDYFETKGLKDIVIVSPDHGGVTRARKMADRLKAPIAIIDKRRPRPNVSEVMNIIGNIEGKTALLIDDIIDTAGTITLAANALVENGASEVYACCTHPVLSGPAIERIQNSNIKELVVTNSIVLPEEKKIDKVHELSVAPLIGEAIIRVYEEESVSVLFN

SEQ ID NO: 71750 - protein, 321 aa, Bacillus anthracis str. Ames
MSIVNKKIIFFGDFGIDDAVALIYANKTCKLDILGIVAEYGNVSREIVTENVYFLERYYATEVKIIEGAARPMTAEEPLFFPEIHGEHGLGPIIPPDLRICKRENFCELIKLIEPCPEDIIIVATGRLTTLATLFLLYPNVMDKVCSYYIMGGAFLFPGNVTPVSEANFYGDPIAANIVMKYAKNAHIYPLNVTQEALITPEMVDIINKEGTGQAKLIKPMIDFYYENFYKKEYPGIAGSPIHDLLPFISFINDDIFEYKKSAVWISTTNDVTRGQSVADFRKIAEPTRFDDRPVQKIAVGFNYPAFKEEFMRTILKPDCP

SEQ ID NO: 71751 - protein, 161 aa, Exiguobacterium sibiricum 255-15
MMIRIGQGFDVHAFAEDRKLILGGIEIPHTKGLLGHSDADVLLHTIADAALGAIAAGDIGKHFPDTDPEFKDADSAKLLQHVYALVKAQGYELGNLDATVIAQAPKLRPYIDTMRARIAELLEADIEQINVKATTTEWLGFTGREEGIACQAVILLKRIEE

SEQ ID NO: 71752 - protein, 624 aa, Oryza sativa
MAAASISRSLLRRSRCGGGEHHLLLLARGFVTAECHRPVVLHKRGSDILHDPWFNRGTGFSMTERDRLGLRGLLPPNVVSSQQQIDRFMLDMQRLQKYARDGPSDTYPLAKWRILNRLHDRNETMYYKAEVLIDNIEEHAPIVYTPTVGLVCQNYSGLFRRPRGMYFSAEDRGEMMSMVYNWPADQVDMIVVTDGSRILGLGDLGVHGIGIAIGKLDLYVAAAGINPQRVLPVMIDVGTNNEKLLKDPLYLGLQEHRLEGEEYVAIIDEFMEAVFARWPNVIVQFEDFQSKWAFRLLQRYRKTYRMFNDDVQGTAGVAIAGLLGAVRAQGRPMLDFPKQKIVVAGAGSAGIGVVNAASRTMARMLGNNEVAFESARSQFWIVDAHGLITEERTNIDPDARPFARRKSELGHQGLSEGASLVEVVKKVKPDVILGLSAVGGLFSKEVLEALKDSSSSRPAIFAMSNPTKNAECTPEEAFSILGEKIIFASGSPFSDVDLGNGKIGHSNQGNNMYLFPGIGLGTLLSGARVISDGMLQAAAERLASYMKEEEVLEGIVYPPISRIRDITKEVAAAVVKEAVAEDLAEGYRDMDARELARLSEEETVEYVQQNMWSPVYPTIVYKKD

SEQ ID NO: 71753 - protein, 97 aa, Triticum aestivum
  misc_feature (48)..(48): Xaa can be any naturally occurring amino acid
MSSTTQSAALSAKCAAWAQERRPFTHPIEIPAASGAPDERRGRGRGGXGGEVEPPHVLMARRRAASSVCSGQGRTLKGRDLTRTRDSVLRMTGFIES

SEQ ID NO: 71754 - protein, 477 aa, Oryza sativa
MGTYKCCIFFTRRFALSDASTPGDVRMLFTRHAGGAPYMGIDELRRYLAASGEAHVDADTAERIIDRVLQERSRTPRFGKPSLTIDDFQYFLFSEDLNPPICHSKEVHHDMNAPLSHYFIYTGHNSYLTGNQLSSDCSDIPIIKALQIGVRVIELDMWPNSSKDDVDILHGRTLTAPVSLIKCLKSIKEYAFVASPYPVIITLEDHLTSDLQAKVAKMVLEVFGDTLYYPESKHLQEFPSPEALRGRVILSTKPPKEYLESKGGTMKDRDIEPQFSKGQNEEAVWGTEVPDIQDEMQTADKGYGRSLWLMHGFYKANGGCGYVKKPDFMMQTCPDGNVFDPKADLPVKKTLKVKVYMGEGWQSDFKQTYFDTYSPPDFYAKVGIAGVPSDSVMQKTKAVEDSWVPVWEEEFVFPLTVPEIALLRVEVHEYDVSEDDFGGQTALPVSELRPGIRTVPLFDHKGLKFKSVKLLMRFEFV

SEQ ID NO: 71755 - protein, 227 aa, Glycine max
MATPASITNVTVEFLQFPALVTPPGSTKSYFLGGAGVRGLNIQEEFVKFTGIGVYLEDKAVSSLAAKWKGKSAAELLDSLDFYRDIIKGPFEKLIRGSKLRTLDGREYVRKVSENCVAHMQSVGTYSDEEEKAIEEFRNAFKDQNFPPGSTVFYKQSPTGTLGQLIFSKDETIPEHEHAVIDNKPLSEAVLETMIGEIPVSPALKESLATRFHQFFKELEANPNIEN

SEQ ID NO: 71756 - protein, 447 aa, Geobacillus kaustophilus HTA426
MAIEQLTMPQLGESVTEGTISKWLVSPGDKVNKYDPIAEVITDKVSAEIPSSFAGVIRELIAKEGETLPVGAPICTIEVEGAAPASEAKPADEAPKAEDNAKPAAPKKAGRANNGRYSPAVLRLAQEHGIDLEQVEGTGLGGRVTRKDLLKLIESGQIPKAGAAPAAEQAAPKAEPRTEQPATAAATVQPSAAAAPTAPQAAPIKPAAPNVEAGAGDIEIPVTPVRKAIAANMLRSKHEAPHAWTMVEVDVTDLVAYRDAIKDEFRRREGFNLTYFAFFVKAVAQALKEFPQLNSVWAGDKIIQRKDINISIAVATDDALFVPVIKHADEKTIKGIAREIAELAAKTRAGKLRPEDMQGGTFTVNNTGAFGSVQSMGIINYPQAAILQVETIVKRPVVKNGMIAIRDMVNLCLSLDHRVLDGLICGRFLARVKAILENMNKDNTPIY

SEQ ID NO: 71757 - protein, 235 aa, Chrysanthemum x morifolium
MATPSSATSLNVENIVFPSSVKPPGDTNTLFLGGAGVRGMEIQGNFVKFTGIGVYLEDKAIPLLAGKWKGKTAEELVNSVEFFRDIVTGPFKKFTQVTMILPLTGKQYSEKVSEMCVGVWKAHGTYTDADGATIDKFLEVFKDENFPPGASILFTTSPDGSLTISFSKDGMIPEAANIVLENEKLAQAVIESVIGKNGVSPATKQSLASRLSDLMNHFDEKATTDAEPNLSKNGL

SEQ ID NO: 71758 - protein, 614 aa, Zea mays
MEAAPPTSPPSLVLLLLLLLIVSSPCSSSALLSPKGVNPEVQALMTIKNTLKDPHGVLKNWDQDSVDPCSWTTVSCSLENFVTGLEVPGQNLSGLLSPSIGNLTNLETILLQNNNITGLIPAEIGKLTKLRTLDLSSNHLYGAIPTSVGNLESLQYLRLNNNTLSGPFPSASANLSQLVFLDLSYNNLSGPVPGSLARTFNIVGNPLICGTNNAERDCYGTAPMPMSYNLNSSQGAPPQAKSKSHKFAIAFGTAIGCIGLLVLAAGFLFWWRHRRNRQVLFDVDDQHMENVSLGNVKRFQFRELQSATGNFSSKNILGKGGFGYVYRGQFPDGTLVAVKRLKDGNAAGGEARFQTEVEMISLALHRNLLRLYGFCMTATERLLVYPYMSNGSVASRLKGKPPLDWVTRKRIALGAGRGLLYLHEQCDPKIIHRDVKAANILLDDCCEAIVGDFGLAKLLDHRDSHVTTAVRGTVGHIAPEYLSTGQSSEKTDVFGFGILLLELVTGQTALEFGKTANQKGAMLDWVKKTHQEKKLDVLVDQGLRGGYDKMELEEMVRVALLCTQYLPGHRPKMSEVVRMLEAGEGLAERWEASHSQSQSADSHEFKAVELSGPR

SEQ ID NO: 71759 - protein, 378 aa, Vitis vinifera
MATTGQVITCKAAVAWEANKPLVIEDVQVAPPQAGEVRIKILFTALCHTDAYTWSGKDPEGLFPCILGHEAAGIVESVGEGVTEVQPGDHVIPCYQAECRECKFCRSGKTNLCGKVRAATGVGVMMSDRKSRFSINGTPIYHFMGTSTFSQYTVVHDVSVAKIDPVAPLEKVCLLGCGVPTGLGAVWNTAKVESGSIVAVFGLGTVGLAVAEGAKSAGASRIIGVDIDSKKFDPRIFGVTEFVNPKDHEKPIQQVLVDLTDGGVDYSFECIGNVSVMRAALECCHKGWGTSVIVGVAASGQEISTRPFQLVTGRVWKGTAFGGFKSRSQVPWLVEKYMKKEIKVDEYITHNLTLGEINEAFDLMHEGGCLRCVLAMHV

SEQ ID NO: 71760 - protein, 226 aa, Glycine max
MAFPSVTSVTVENVTFPPTVKPPCSPNTFFLAGAGVRGLQIHHAFVKFTAICVYLQYDALSFLSVKWKTKSTHQLTESDQFFSDIVTGPFEKFMQVTMIKPLTGQQYSEKVAENCVAIWRSLGIYTDSEAEAIDKFLSVFKDLTFPPGSSILFTVSPNGSLTISFSGDETIPEVTSAVIENKLLSEAVLESMIGKNGVSPAAKQSLASRLSHLFKEPGVCDPQSHK

SEQ ID NO: 71761 - protein, 646 aa, Salmonella enterica subsp. enterica serovar Typhi
MMSYVDWPPLILRHTYYMAEFETTFADLGLKAPILEALTDLGYEKPSPIQAECIPHLLGGRDVLGMAQTGSGKTAAFSLPLLNNLDPELKAPQILVLAPTRELAVQVAEAMTDFSKHMRGVNVVALYGGQRYDVQLRALRQGPQIVVGTPGRLLDHLKRGTLDLSKLSGLVLDEADEMLRMGFIEDVETIMAQIPEGHQTALFSATMPEAIRRITRRFMKEPQEVRIQSSVTTRPDISQSYWTVWGMRKNEALVRFLEAEDFDAAIIFVRTKNATLEVAEALERNGYNSAALNGDMNQALREQTLERLKDGRLDILIATDVAARGLDVERISLVVNYDIPMDSESYVHRIGRTGRAGRAGRALLFVENRERRLLRNIERTMKLTIPEVELPNAELLGKRRLEKFAAKVQQQLESSDLDQYRALLAKIQPSAEGEELDLETLAAALLKMAQGERPLILPPDAPMRPKREFRDRDDRGPRDRNDRGPRGDREERPRRERRDVGDMQLYRIEVGRDDGVEVRHIVGAIANEGDISSRYIGNIKLFASHSTIELPKGMPGEVLQHFTRTRILNKPMNMQLLGDAVPHAGGERRGGGRSFSGERREGGRNFSGERREGGRGDGRRFSGERRESRGPRRDDSTGRRRFGGDA

SEQ ID NO: 71762 - protein, 473 aa, Geobacillus kaustophilus HTA426
MAKEYDVVILGGGTGGYVAAIRASQLGLKTAVVEKGKLGGTCLHAGCIPSKALLRSAEVYAQTKNGEAFGVIADGVRLDFAKVQARKAAIVEQLHKGVQHLMKKGKIDVYAGTGRLLGPSIFSPLPGTVSVEMNDGSENEMLVPKFVVIATGSRPRTLPGLEPDGEFVMTSDEALQMETLPSSILIVGGGVIGMEWASMLNDFGVDVTVLEYADRILPTEDEDVSKEMEKLLRRRGVNIVAGAKVLPETLEKGNGVTIQAEHQGERKTFTADKMLVSVGRQANIEGIGLENTEIVVEKGYIQTNEFGQTKESHIYAIGDVIGGLQLAHVAAHEGIVAIEHLAGHNPAPIDYTMVPRCIYTRPEAAAVGLTEQEAKAKGYDVKVGKFPFKAIGKALVFGEAEGFVKLIADRNTDDLLGVHMVGPHVTDLISEAGLARVLDAAPWEVAHAIHPHPTLSEAMAEAALAVDGKAIHF

SEQ ID NO: 71763 - protein, 77 aa, Vibrio fischeri ES114
MSNLEERVKKIIVEQLGVDEAEVKNEASFVDDLGADSLDTVELVMALEEEFDTEIPDEEAEKITTVQAAIDYVTSAQ

SEQ ID NO: 71764 - protein, 245 aa, Vibrio fischeri ES114
MMNLEGKIALVTGASRGIGRSIAELLVSRGATVIGTATSEGGAAAISEYLGENGKGLALNVTDVESIESVLKSINDEFGAIDILVNNAGITRDNLLMRMKDDEWTDIMDTNLTSIFRLSKAVLRGMMKKRNGRIINVGSVVGTMGNAGQTNYAAAKAGVIGFTKSMAREVASRGVTVNTVAPGFIETDMTKALNDDQRAATLSAVPAGRLGDPKEIASAVVFLASPEAAYITGETLHVNGGMYMV

SEQ ID NO: 71765 - protein, 700 aa, Oryza sativa
MESMLVAGAGAAAVAAVGGLVAAAALADKLVAAPPPRKNRANPPPAVPGLPIIGNLHQLKEKKPHQTFAKWSETYGPIYTIKTGASPVVVLNSTEVAKEAMIDKFSSISTRKLPKAMSVLTRKSMVAISDYGDYQKMAKRNIMIGMLGFNAQKQFRGTRERMISNVLSTLHKLVSLDPHSPLNFRDVYINELFSLSLIQSLGEDVSSVYVEEFGREISKDEIFDVLVHEMMMCAVEADWRDYFPYLSWLPNKSFDTIVSTTEFRRDAIMNALIKKQKERIARGEARASYIDFLLEAERSAQLTDDQLMLLLSESILAAADTVLELLYQEIREACGGEAVTEDDLPRLPYLNAVFHETLRLHSPVPVLPPRFVHDDTTLAGYDIAAGTQMMINVYACHMDEKVWESPGEWSPERFLGEGFEVADRYKTMAFGAGRRTCAGSLQAMNIACVAVARLVQELEWRLREGDGDKEDTMQFTALKLDPLHVHLKPRGRMMNSDIKNIMSSLNLHLIFSSSLSHSGGGRAVVWQATARRQERRRQQRGLAAVGRVGDAGLRAVGSGVGGPGAARSDDARRREATVGARWLKATATSGYGGAILGAPGSRRPWSNARRWAGADSGPAAPSPAATTTSGGGTTAIPLAPFPLFTAAAAGAASAASGGLAPRRSSDKGGGGGRSGAGDGSGGRLRWERPASSGGGAAACG

SEQ ID NO: 71766 - protein, 282 aa, Glycine max
  misc_feature (172)..(172): Xaa can be any naturally occurring amino acid
MEATSLVERGRERVGHVNKVSYVRRVIAKKKKQLYRRLRRPELSVSKTLQQLFDSCREVFKGPGTVPSPQDVQRLRHILNNMKPEDVGLSRDLQFFKSGNMVKEKQRVTYTTVYKCNNFSLCIFFIPEGGVIPLHNHPDMTVFSKLLLGLMHIKSYDWVVHEASDDNMLQPXSQLRLARLKADKVFTSSCGTSVLYPTTGGNIHEFTAITPCAVLDVIGPPYSKEDGRDCSYYRDHPYTCFPNERIIGEAKEENDSYTWLEEIEMPENSEMNGVEYLGPTPF

SEQ ID NO: 71767 - protein, 259 aa, Robiginitalea biformata HTCC2501
MKPVLSVVKIGGAFLEEPGLVESFTSAFASLEGHKILVHGGGQRATALSRRLGVEPRVVDGRRITDADSLEVAVMVYAGWANKTLVARLQSLGCNALGVSGADAGLIRALKRPAGEIDYGFVGDIASVNAPGIANLLAAGIVPAFCALTHDGRGQLLNTNADTIASELAVAMSDKFTTRLLYCFEKAGVLRDVSDPGSVIPRIDAAAYADLRAKGKVAAGMLPKLHNCFQALEKGVDQVFIGAPEMLTPGHAIQTEITL

SEQ ID NO: 71768 - protein, 313 aa, Robiginitalea biformata HTCC2501
MKHFCTTDDITELADWLHLGNRLRAEPDLLAHLGRGKTLCLLFFNNSLRTRLSTQKAAQLLGMEVMVMNFGSEGWSLEYTDGTVMDQGTAEHIREAAPVVAQYADLIGIRAFAGLKDREADYAEMVLQGFVQHAGIPVLNMESATAHPLQALADALTIEQFREKDRPKVVLSWAPHPRALPQAVPNSFAKMMQALPVDLTITHPEGYELAPEFTGGLSPEYNQEKALEGADFVYVKNWSSYSDYGAILSQDPAWMMTAKKLGEAQLMHCLPVRRNVVVADDALDGGRSLVLQQAANRTLSAQLALAHLIQSNS

SEQ ID NO: 71769 - protein, 620 aa, Pseudoalteromonas tunicata D2
MTVDNSKYPLLGLIDEPAQLRELPQERLATLSTELREYLLTSVSQSSGHLASGLGTVELTVALHYVYNTPEDRLIWDVGHQAYPHKILTGRRDQMHTIRQKNGLHPFPYREESQYDTFSVGHSSTSISAALGMAIAAKKEAKNRKVVAVIGDGAVTAGMAFEAMNHAGDLDADMLVILNDNEMSISENVGALNNHLARILSGSFYTNIREGGKKLLSGMPPVKELASKMEEHLKGMVVPGTFFEELGFNYIGPIDGHDVNMLCDTLRNMRNLKGPQLLHVRTQKGKGYQPAEADPIGYHGVPKFDPSESSLPKSKPAAPTFSKVFGDWLCDMAAQDSKLMAITPAMREGSGMVRFSKEYPAQYFDVAIAEQHAVTLAAGLACEGLNPVVAIYSSFLQRAYDQLIHDVALQNLPVLFAIDRAGIVGADGETHQGAYDLSFMRCIPNMVIMAPSDTNECRQMLYTGHKLNQPAAVRYPRGSAGEYLANSPMQAIAIGKANTIRQGEKVAILSFGTLLEHAKPVAEKLNATLVDMRFIKPIDCDLLTELAAKHKYFITLEDNAIQGGAGSAVNEFVMTNKLSVHVLNLGIPDEFIKHGTQDEMHSEMGLDSAGILTKISQYIA

SEQ ID NO: 71770 - protein, 296 aa, Pseudoalteromonas tunicata D2
MTIKKLIVENQLRVEGVLDTLLTQPMITDQTLLAASRYSLLNGGKRMRPCMVYVTGEIFGANPDDLDLVAAAIECIHSYSLVHDDLPAMDDDDLRRGMPTCHIAYDEATAILAGDALQTFAFEILSSSKFKTINAQQQVALIANLASASGLRGMCGGQALDIAATNCAINLTQLEQIHQLKTGALLTSAILMGAICAPKTTPEILQNLKIFGENIGLAFQVQDDILDIEGDTAVLGKPQGSDLQANKSTYPSLLGLEQAKLKSQQLYENALNALAQIPADTTQLAQLAAYIVSRDH

SEQ ID NO: 71771 - protein, 264 aa, Robiginitalea biformata HTCC2501
MKIAIIGAGNLGVSIARGILHSGGATSMYLTRRNLSAIRELEAYGNVTLTSDNREAVAAADILIFAVQPGHFGPILESIKDLLHENHVVISTITGFGIERIESILGADRHIIRAMPNTAISVGRSMTCLCANEKGGKRLELASAIFNRMGHTMVIPENRMQAATVICASGIAFWMRLIRATTQGAIQLGFDAREAQELAMHTCHGAAELLIESGSHPEEEIDRVTTPMGCTIEGLNEMEHQGLSSSLIRGVVASFDKISQIRKG

SEQ ID NO: 71772 - protein, 669 aa, Saccharomyces cerevisiae
MLRTRLSVSVAARSQLTRSLTASRTAPLRRWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRRHIKELVPIIYTPTEGDAIAAYSHRFRKPEGVFLDITEPDSIECRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 71773 - protein, 475 aa, Arabidopsis thaliana
MAATTRRLLYYVSKRFSTAGVRRSYGGLPQSNSKSPPSSSQRLMELESEFSAHNYHPVPVVFSRANGSTIWDPEGKRYIDFLAAYSAVNQGHCHPKIMKALQEQVEKLTLSSRAFYNDKFPVFAERLTNMFGYDMVLPMNTGAEGVETALKLARKWGHEKKNIPKDEAIIVSCCGCFHGRTLAIVSMSCDNDATRGFGPLLPGNLKVDFGDADSLEKIFKEKGDRIAGFLFEPIQGEAGVIIPPDGYLKAVRELCTKYNVLMIADEVQSGLARSGKMLACDWEEIRPDMVILGKALGGGVIPVSAVLADKDVMLHIKPGQHGSTFGGNPLASAVAMASLDVIVEEKLVERSASLGEELRIQLNEIKKQFPKYIKEVRGRGLFNAIEFNSESLSPVSAYDICLSLKERGVLAKPTHNTIVRLTPPLSISSDELRDGSEALHDVLELDLPNLLKINSGKTPVSHITECDRCGRNLYA

SEQ ID NO: 71774 - protein, 447 aa, Saccharomyces cerevisiae
MVEKDTWKLITATALFTVAVTTITDYAWTSWQAQKQVIAQQKNKNKGGQTKSDTDKYHQYDEQFIRQSLKNNVEFLGEDTIEKLSNQYVVVVGAGGVGSWVVNSLVRSGCRKIRVVDFDQVSLSSLNRHSCAILNDVGTPKVECLRRHMREIAPWCEIDPINELWTLQNGERLTLGNGTPDFIVDCIDNIDTKVDLLEFAYNHGIKVISSMGASAKSDPTKLNVGDLATTEEDPLARVVRRKLKKRGILSGIPVVFSAEKPDPKKAKLLPLPDEEYERGKVDELSALKDFRVRILPVLGTMPSLFGLTITTWILSNISDKPLEPVEGKNRIKVYDGIYQSLAGQMSRVGIPSQRIPLALKDVSYLVEEVFKGKSPISGISTRLTLTKWDPSKPISLQNVVVLTKNEQKVHEDRVLKGKESLQDVYDAKVLKLVSQRFREEAYYSQFR

SEQ ID NO: 71775 - protein, 68 aa, Triticum aestivum
MRDWAPAIIATALFALLCPGGVLQMPGRQRPVDLMNMKTSFPSMLVHAIIYFLLLMLFIGILQPHLYI

SEQ ID NO: 71776 - protein, 643 aa, Methylococcus capsulatus str. Bath
MNVSNIVVFALGSGAAGVACALMNAGGVLRRSAGSADVLAVARAIQEGTGAFLKRQYIAVAVVGSLLALALTKLGAWTANGFIAGVVASALAGYIGLAVSVRAEARTADAAGAGLGAALSTAFRSGTAMGLLVAGLALSAVAGYYALASSAGTPDDVHGGLLGLALGGSLMSVFARTVGGVWAKTAGGPPLQETSEVAAVGNHVGHAAGTAADVFETLTLALVAAMLLARSVFGADSPWVEFPLLVAGFVVAASLAGACFVRLGKSRYLVGALYRSVIVTMILAGVGLYYASEWFLGLPAVQPAFSLLNLFSAACIGLVLAGLNIAATEYHTSKSFGFAKRIAAASRGGPATNVVAGLAAGLKSTGWSVALLCAAFIGPYHLGGGFSGHEGTGLFAVGLAAVAMASLGGVMVAIDGYGIAAEAAHGIAETAGLPDEVRQATASLDAAGRATRPVVQGYVVGAGGLAMLALFAEYSKCFAVPLALNLSDPVVLTGLFAGGLMPYLLGSVSLGAVGNVPAGAGGQANGGLRVALKRASILVLVPLAVPLLVGLGGGREALGGMLVGAIVTGLFQAFAMSSGGGAWDSARRYIEDGMYGGADSEAHRAALTGDQVGTACQAVAGPALNPLIKLMGLVAVLIAPLLA

SEQ ID NO: 71777 - protein, 133 aa, Oryza sativa Japonica Group
PPMAASPASTAAAVVNAPAATGGLLLPRGRSSWSWSCCNNNNSSMGRRWRAAAVGEVAAEGNTYLIAGAVAVALVGTAFPILFSRKDTCPECDGAGFVRKGGATLRANAARKDLPQIVCPNCNGLGKLGQIDK

SEQ ID NO: 71778 - protein, 179 aa, Malus x domestica x Pyrus communis
MASSMISSGTVATVSAPAQARMVAPFTGLKSSSAFPVTRKSNDITSIASNGGRVQCMQVWPPLGLKKFETLSYLPPLSTESLAKEVDYLLRKNWVPCLEFELEHGFVYRENNRSPGYYDGRYWTMWKLPMFGCTDSSQVLKELEEAKKAYPQSFIRIIGFDNVRQVQCISFIAYKPPGV

SEQ ID NO: 71779 - protein, 126 aa, Physcomitrella patens subsp. patens
MERPSQLQYDKNWDAAIDLTLRRFVYGSLSGAASALLLFRSPTTRWAAVAFGAGAGIGSAFTDSSRLFQNSIGGNLPFISSPSSSPAIVGDVQSSSVNPVPEPPKHIEAPKLERFEEPLVQEAQNS

SEQ ID NO: 71780 - protein, 397 aa, Clostridium perfringens SM101
MILSRKAQNIGASLTLALTAKAGELKKEGIDVVSFGVGEPDFNTPKNIIEAATRAMEEGKTKYTATSGIVELKEAIARKLHDDNGLNYGTKNIIISTGAKQSLANVFMAILNPGDEVIIPVPYWVSYPELVKLSDGVPVFIETKKENDFKVTYDELKSVLSENTKAIVINSPNNPTGTVYSKKDLEVIAKFAKENDLIIISDEIYEKLIYGKEEHISIASSSEDAFKRTVVINGFSKAYTMTGWRIGYAACYNEELIKVMNNVQSHMTSNTNSIAQFAALEALNGDQETIKNMVKEFSLRRELMIELISEIEDLTFIEPKGAFYVMIDVSKVLKKANIKGSMEFANLLLKEENVVVIPGIAFGEDNFIRLSYATSKEEIIKGLKRIKEFVNKLMNRD

SEQ ID NO: 71781 - protein, 452 aa, Zea mays
MDYGPSDSSGTDDDLPQLPHRSIRGSGRVSGNGRTIVPAGSYARAPTDMEAQIQQLEQEAYCSVLRAFKAQSDAITWEKEGLMTELRKELRVSDKAHRELLNKVNNDNIICSIREWRSTGGLQASMSNNPQPIHDPVPSPTTSGRKRQKTSQSVPALPAPPAMHSQQLATPTQPSSSTARKAVPPVPKGKKTKPGQKVPGGSAAKPMPSSAGPSGRGPHMNRNFPGGSAPEAQAQNVDPLVGRKVMSRWPEDNSFYEAVISDYNAETGLYVLVYDINTANETWEWVDLKEMGPEDIRWKEDDSGIDPVVYLRSRGAPSSGVRKPTGRGGPMPGSGRGRGLPKNMSRKDFPPPQNGVGKRSSDDIDILHTESLIKEVEKVFSVSNPDPQEVEKAKKALKEQEQSLIDAIARLAEASDGESDGLNRGRRNLYAGNQHQANYVDDMPVGDQADAM

SEQ ID NO: 71782 - protein, 806 aa, Magnaporthe grisea 70-15
MTVSHDYPHRGSNHPPANMLALEDRFEVLKEIGDGSFGSVALARVRTAGAAVARRGTVVAIKTMKKTFESFTPCLELREVVFLRTLPAHAHLVPALDIFLDPFTKKLHIAMEYMEGNLYQLMKAREHKALDNASVKSILFQIMQGLEHIHAHSFFHRDIKPENILVSTSGHNESSTSFRRYSSIVNPPAQAYTVKIADFGLARETHSKLPYTTYVSTRWYRAPEVLLRAGEYSAPVDIWAVGAMAVEVATLKPLFPGGNEVDQVWRVCEIMGSPGNWYNKTGGRVGGGEWREGTRLAGKLGFSFPKMAPHAMDTILQAPQWPSSLSQFVTWCLMWDPKNRPTSTQALAHEYFADAVDPLRPKSSASRILGRKQSDLNKGKDSATSTPTSSKSWFRKSLIGRTDSNESAAPAPVAKDVAPRPAPIHTVSEINQPKARPPVATSKRTTWTNGPSNVAPMPILPTIRPISPMSDAVTAQAASNRTPAYNDAYANASSNRGTEKASKKIGRQLSVASSTNHYAEIHRQQAERALNGNGGLASPPSGKQEKESFFSHLRKRARRFSGRHQAPISPTYDDVEAQAGCGPFASNRSSMVIDQQGQAAGKDSHGDYMAEPPAVPVHNVPANNNGTRHHSLPHHQPRSVDNLMNAARNGNNVPGGPISSRTRRAQAGQPGGMHQYDAPDEEDELLDEVLTSTHNAMTKLENKDKAPPHSNSHYNNMAKTPASNRNSAAAAHNANLNPYPTPSPSANGNSVLFGDGSENVTPKPLNLEKGNTSTPTDYGKWPTPPYEESEWAASASASIWAASHRF

SEQ ID NO: 71783 - protein, 379 aa, Triticum aestivum
MMDELRPPSVVQKLHGQSMLFREISSSAMRSHVINNAHYARNFSVTKYHQTNGSIGRLPRNTPSPIRAPAPEEKGFSGFMIDFLMGGVSAAVSKTAAAPIERVKLLIQNQDEMIKSGRLSHPYKSIGHCFTRTIKDEGVVALWRGNTANVIRYFPTQALNFAFKDHFKRMFNFRKDKDGYWKWFFGNIASGGAAGASSLLFVYSLDYARTRLANDAKAAKVGGQRQFDGIVDVYRKTLASDGVRGLYRGFNVSCVGIIVYRGLYFGMYDSLKPAVLVGSLEDNLLASFLLGWGVTMGAGLASYPIDTVRRRMMMTSGESVKYKNSMDAFRKIIAEEGAKSLFKGAGANILRAVAGAGVLAVYDKLQVVVFGKKYGSGGG

SEQ ID NO: 71784 - protein, 284 aa, Methanocaldococcus jannaschii
MIVVSGSQSQNLAFKVAKLLNTKLTRVEYKRFPDNEIYVRIVDEINDDEAVIINTQKNQNDAIVETILLCDALRDEGVKKITLVAPYLAYARQDKKFNPGEAISIRALAKIYSNIVDKLITINPHETHIKDFFTIPFIYGDAVPKLAEYVKDKLNDPIVLAPDKGALEFAKTASKILNAEYDYLEKTRLSPTEIQIAPKTLDAKDRDVFIVDDIISTGGTMATAVKLLKEQGAKKIIAACVHPVLIGDALNKLYSAGVEEVVGTDTYLSEVSKVSVAEVIVDLL

SEQ ID NO: 71785 - protein, 434 aa, Oceanobacillus iheyensis HTE831
MNKSDQHWQELVNSIGNFLAPSMAKDHPNLPVVKAEGCYYYGTDGKEYLDFTSGIAVENVGHRHPKVVQAIKDSADHLVHGPSGVIIYESILKLAQELQEIMPPKLDNFFFANSGTEAIEGGLKLAKHVTKRPYVISFTGNFHGRSIGSLSVSTSKSKYRKYQQPSWLTYQLPYALPEYLPEGQDPEVFFAEKLEKDAESLFKHQVDPEEVACMILEPIMGEGGYIIPPKSWLQKVREICDRHGILLIFDEVQTGFGRTGDWFAAQTFGVTPDIMAIAKGIAAGMPLSATVASKELMDQWPLGSHGTTFGGNPIACAAARASLSIMKEEKLLNNAKTMGDYALTKLSGLKDKYEIVHEVRGIGLMLGIELRDPETGEPDGEAVMKALNGCLDEGVLFYLCGNAGEVIRMIPPLTINKEQIDQGIDVLDKVLAQM

SEQ ID NO: 71786 - protein, 399 aa, Bacillus anthracis str. Ames
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETEIQMAGATSYYMPLKKENDFLPNLELIPEEIADQAKMMILNFPGNPVPAMAHEDFFKEVIAFAKKHNIIVVHDFAYAEFYFDGNKPISFLSVPGAKDVGVEINSLSKSYSLAGSRIGYMIGNEEIVGALTQFKSNTDYGVFLPIQKAACAALRNGAAFCEKNRGIYQERRDALVDGFRTFGWNVEKPAGSMFVWAEIPKGWTSIDFAYALMDRANVVVTPGHAFGPHGEGFVRIALVQDKVVLQQVVENIRNSGIFALEKVDELVKN

SEQ ID NO: 71787 - protein, 143 aa, Glycine max
APALVGEVGLGADLVRLDGKAMCSPGFSCDSAFQVTYIVRGSGRAQVVGADGRRVLETTVKAGNLFIVPRFFVVSKIADSDGLEWFSIITTPNPVFTHLAGSIGTWKALSPAVLRAAFNVDAGLEQLFRSKRNADAIFFPPPN

SEQ ID NO: 71788 - protein, 381 aa, Clostridium perfringens SM101
MTKDELLKQRELAHGLISIKPNFDINNREQLSQIYTPGVSTICKEVEHHPSMLKTLTSVGNSIAVITDGTAVLGLGNIGTLAGYPIVEAKALVYKDLAGVNAIPLCVDQIGCNELIKTIKNIYSSFSGIHLEDIKAPECFYIEDELKKTLNIPVYHDDQHGTAIAVLGALYNASKVVNKDFSKLKVLILGAGASGIATAKLLLKAGIEDIILVDKNGALVSGDETLNDPQKEMAKITNKELKKGTLEEVIKGRDVFIGLSEGNLVTKEMVESMNEDPIIFALANPTPEIKPEIAKEAGARVIATGGPSYPNQINNILVFPGLFKGLLEAKATDVTYGVMIAVSKKLASLVENPTAEKIIPGVFDGDIVKSVSETVVKNIEK

SEQ ID NO: 71789 - protein, 219 aa, Leymus triticoides
  misc_feature (50)..(50): Xaa can be any naturally occurring amino acid
GRRRVEMEDRHVAKLALGGDPEVALFAVFDGHGGAAEFAAENMPKFMAEXVRKVDGGGSEEIEGAVKKCYLKTDEEFLKREESGGACCVAALLQKGGLTVSNTGDCRAVLSRAGTAEALASDHRASCEDERERIENLGGFIVNNRGTWRVQDSLAVSRGIGDAHLKQWVVADPDTRTLLVDPQCEFLVLASDGLWDKVDNQEAIDIARPLCIGNDKASR

SEQ ID NO: 71790 - protein, 1341 aa, Chlamydomonas reinhardtii
RVGISLPGVEVRWENLRVEVTAPPHQNKNTPAATTNDNEAGTGAISGKKLLPPLPRRRRARRQVILDAGSGVLRPGRMTLLLGPPGAGRSTLLKALAGQLIPPNTPAAVGGPNGSGSSKPAFDVARVATYVSQTENHLPELTVAETLTFAAQCQGSDLALRMHELLRAREAAAGLSGAEGDDAELALLLELARGPDAPLLMSQHTARMLEIDHVMDTVVGNELLKGISGGQKRRVTAGEMVVGQAQVLMLDEITNGLDAASALTICKALRSTCEQANTTIVATLLQPSPEVVACFHDVILLSQGVIAYHGPTERLAPFLGSLGLAANAEAGQTMADFAQVLASPEDQAKYRLPQPPAPAPQLAWQGLKWISPRRMRQVRGHDAAAAQPRLLHGWTTAGRCVRSTWLLAAGVFTCMHVCGLAWVGPILLAAFLVSTGFVNLDRTNSDGANLTMSVMFFSLMSLFFGGFNFAPIYCARLQVFFKQRDHGFYSPLAHAVASVLLRIPETLINSVGFAVMVYFSVGLTMDAGRFFIFLLNLFAMGVQSVTTFQLLGALTRNDVATQGLGGVLLMINVLLSGFPIARTSIPGWWIWGYWLSPMSWGLRSMLVSEMTSDDWPLADPADPTGPTVGESGMAMRGFQTEWYWVWAGIGYVLGMALLQLAAQVVALTYLGREWLGRAGHAVVVVSAGGSSSNNAHTGDDAAAAVGADMSFKPVVMAFKDVSYFVPHPDKAHQQGAWAGFPGKELQLLNGVSGVFRPGVLTSLMGASGAGKTTLMDVLAGRKTGGRAEGLQLVNGAPKRMSTFARVMGYVEQLDVHNPQATVEEALMFSAALRVEPAAFAAGVGGDGGSAVDTTAARKAFVRRMMDVVELGPLAGRTIGLGGAGGGLSTEARKRLTIAVELVANPSVVFMDEPTSGLDARAAGVVMRAVRNTVATGRTVVCTIHQPNREIMDYFDELLLLRPGGRTIFFGALGARQRDLVAYLGSVTPGIPAYEPHMNPANWMLEVTAPSAATALGVDFAELWQASEQCRWGAARCWVWVGVWQWAGGLHVAYVHPRFARSPLAQLGLVVRRNLVSQLRNVEYNGMRFATAFVLAWVLGSLYWDRGTKTNTLVGVMDVLGVLFASSLFLPLNNMLLVMPVVAADRAVYYREKASGMYGGAVFAAAQAIAELPFLFMQSVLFVVIVYTTVHFEFNSAKAMWFWLYMWLQTMFFTFFGIASMNLAPVMPTAIAGSSGLIMLWNLFCGFLISRPNMKPWYLWAYYANPPTWTIYGTAVSQLGDLTDTFIELPGGESMSVAEYIKGAFSYDYDMRGWIVLIMIGFIVACRAAAYYGLIRLNFQKR

SEQ ID NO: 71791 - protein, 221 aa, Leymus cinereus
GRRRVEMEDRHVAKLALGGDPEVALFAVFDGHGGKNAAEFAAQNMPKFMAEEVRKVDGGDSDEIEGAVKKCYLKTDEEFLKREESGGACCVTALLQKGGLTVSNTGDCRAVLSRSGTAATLTSDHRASREDERERIENLGGFVVNNRGTWRVQGSLAVSRGIGDAHLKQWVVADPDTRTLLVDPQCEFLVLASDGLWDKVDNQEAIDIARPLCIGNDKASR

SEQ ID NO: 71792 - protein, 396 aa, Exiguobacterium sibiricum 255-15
MKHLSERVERLAPSGIRRFFDLAGSMEDVISLGVGEPDFVTPWNVREASFAALEQGYTAYSANAGLVELRQEIKLYMQEKFSIDYRVADEIIVTTGASEGLDLAFRTLINPGDEVIVVEPAFVSYAPLIELAGGIPVAAACRAEDGFTIQPETIEAVMTERTKAIIFCFPSNPTGSVMTRDQLADLALLAKKHDLYVISDEIYAELSYEDEPTCFATLPDMRERTIVINGFSKAFAMTGWRLGFTCAPPAISQAMLKVHQYGMMCAPTLVQFAGIEALRSRHKTVPDMVRSYRQRRNYFVKALNDAGLPTHSPGGAFYAFPYIGGTGLTSEEFAEQLLLAERVAVVPGSVFGASGEGYVRASYASSIEQLQQAIHRINRFMQHLNQKQVELSNPSR

SEQ ID NO: 71793 - protein, 515 aa, Vibrio fischeri ES114
MFEFPKFSNHSVKNDVLSGLTVALALVPEAVAFAFVAGVDPMVGLYAAFIVGLITSLIGGRPGMISGATGAMAVVMVSLVSVHGVQYLFAAIMLAGILQISAGLFKLGKFIRIVPHPVMIGFVNGLAIVIFLAQLGQFKAPDALGNLDWLQGDQMMLMLGLVAVTMAIIHFLPKLTTAVPSSLVAIIVVTGLVQGLDLDTRTVVDFLRTMSGNDSATLAGSLPTFALPVVPLSLETLYIIFPYALILAAIGLIESLLTLTVIDEMTGTRGQSNRECVGQGVANVTCSVFGAMGGCAMIGQSMINVNSGGRGRLSGIVAAVMLLVFILFASSLIEMIPLAALVGVMFMVVIGTFEWATFKLARRVPKQDFFVIVLVTVVTVFTDLAVAVAVGVIASALMFAWQHAKHIFSTNSVNEEGSKVYEINGPIFFGSAANFLELFDVENDPQDIIIDFAASRVVDHSAIEAVDTIAERYSKAGKKVHLRHLSQDCHALLNKAGSLVEINVQEDPIYKVVSQ

SEQ ID NO: 71794 - protein, 493 aa, Ricinus communis
MAVVVKDLEEAVRVVVLAVLRDMEVVVVLVTAVMGVVGDMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 71795 - protein, 353 aa, Burkholderia sp. 383
MILVTGGAGFIGANFVIDWLCQSDEAVLNVDKLTYAGNLRTLQSLNGSPKHVFARVDICDRAALDALLAEHRPRAILHFAAESHVDRSIHGPAEFVQTNVVGTFTLLEAARQYWSALPDAEQAGFRFLHVSTDEVFGSLSATDPQFSETTPYAPNSPYSATKAGSDHLVRAYHHTYGLPTLTTNCSNNYGPYQFPEKLIPLMIANALAGKPLPVYGDGQNVRDWLYVGDHCSAIREVLARGTPGETYNVGGWNEMTNLDVVHTLCDLLDDARPRAQGTYRDQITYVKDRPGHDRRYAIDARKLERELGWKPDETFATGLAKTVSWYLDNQAWSDEVASGEYRKWVETNYAARV

SEQ ID NO: 71796 - protein, 628 aa, Geobacillus kaustophilus HTA426
MTKIDHPRVVKNMSIPELKRLSAEIRRFLIEKLSKTGGHIGPNLGVVELTIALHREFDSPKDKLIWDVGHQSYVHKILTGRAAAFDTLRQYKGLSGFPKRSESEHDVWETGHSSTSLSAAMGMAIARDLKGTDEYIVPIIGDGALTGGMALEALNHIGHEKTDMIVILNDNEMSIAPNVGALHNILGRLRTAGKYQWVKDELELLLKRIPAVGGKLAATAERLKDSLKYLLVSGVFFEELGFTYLGPVDGHDFEDLFENLRYAKKMKGPVLVHVITKKGKGYSPAENDKVGTWHGTGPYKIETGAFVKTKEAGPSWSALVSETVRRLARTDPRIVAITPAMPVGSKLEGFASEFPDRMFDVGIAEQHATTLAAGLATQGMKPFLAIYSTFLQRAYDQVVHDVCRQNLNVFFAIDRAGLVGADGETHQGVFDIAFLRHVPNLVLMMPKDENEGQHMVYTAIRYDDGPIAMRFPRGNGLGVPLDEELKEIPIGTWEVLRDGCDAAILTFGTTISMALKAADELAKDGISVKVVNARFLKPMDVAMLHELLESRLPILTVEEAVLQGGFGSAVLEFAHDHGYHGAVIERMGIPDRFIEHGSVSELLNEIGLTSTHIIDRIKTMVPRKQKRA

SEQ ID NO: 71797 - protein, 215 aa, Vibrio fischeri ES114
MSENSNHHCIIVGIAGASASGKSLIASTIYNELRAKVGDHQIGVITEDSYYKDQSHLTMEERVKTNYDHPNALDHELLCEHLEQLMRGEAVNIPTYSYTEHTRTSEVDVMTPKKVIILEGILLLTDPRLRNLMHASVFMDTPLDICLLRRARRDVEERGRTMESVFEQYQKTVRPMFMQFIDPSKQHADIIVPRGGKNRIAIDVLKAHISRLLKA

SEQ ID NO: 71798 - protein, 297 aa, Geobacillus kaustophilus HTA426
MAQLSVEQFLNEQKRAVEAALSSYMARLRGPETLKKAMAYSLEAGGKRIRPLLLLATIQALGKDPAIGLPVACAIEMIHTYSLIHDDLPSMDNDDLRRGKPTNHKVFGEAMAILAGDALLTYAFQLIAEVDDDRVPPSVRLQLIEQLAKAAGPEGMVAGQAADMEAEGKTLALAELEYIHRHKTGKMLQYSVHAGALLGGADGRQTRELNEFAAHLGLAFQIRDDILDIEGMEEKIGKRVGSDRDNKKATYPALLSLGGAKEKLAFHIDAAKRHLQQAKIDDAVLVYICELVAVRDH

SEQ ID NO: 71799 - protein, 606 aa, Oryza sativa Japonica Group
MGIAEVALHSMPGAFAAHSPASNLPLAADAARGRRRRSANSLHSSRALQGPVRFPGLRAAVECQCQRIDDLARVTEGNGAWVKDAVDKASHALGDVRVPGQAVGGNGSVNGSAAKPPPQRRKASSVEDEAWELLRESVVYYCGSPVGTIAANDPNDANPMNYDQVFIRDFIPSGIAFLLKGEYEIVRNFILHTLQLQSWEKTMDCHSPGQGLMPASFKVRTIPLDGDEDATEEVLDPDFGEAAIGRVAPVDSGLWWIILLRAYGKCSGDLTVQERIDVQTGIKMILKLCLADGFDMFPTLLVTDGSCMIDRRMGIHGHPLEIQALFYSALLCAREMLTPEDGSADLIRALNNRLIALSFHIREYYWVDMQKLNEIYRYKTEEYSYDAVNKFNIYPDQVSPWLVEWIPPKGGYFIGNLQPAHMDFRFFSLGNLWSIVSSLATTHQSHAILDLIESKWSDLVAEMPLKICYPALENQEWKIITGSDPKNTPWSYHNGGSWPTLLWQLTVASIKMNRPEIAAKAVEVAERRIAIDKWPEYYDTKRARFIGKQSRLYQTWSIAGYLVAKQLLDKPDAARILSNDEDSEILNALSTNRKRGKKVLKKTFIV

SEQ ID NO: 71800 - protein, 530 aa, Streptomyces coelicolor A3(2)
MSEPEEQQPDIHTTAGKLADLRRRIEEATHAGSARAVEKQHAKGKLTARERIDLLLDEGSFVELDEFARHRSTNFGLDANRPYGDGVVTGYGTVDGRPVAVFSQDFTVFGGALGEVYGQKIVKVMDFALKTGCPVVGINDSGGARIQEGVASLGAYGEIFRRNTHASGVIPQISLVVGPCAGGAVYSPAITDFTVMVDQTSHMFITGPDVIKTVTGEDVGFEELGGARTHNSTSGVAHHMAGDEKDAVEYVKQLLSYLPSNNLSEPPAFPEEADLAVTDEDAELDTIVPDSANQPYDMHSVIEHVLDDAEFFETQPLFAPNILTGFGRVEGRPVGIVANQPMQFAGCLDITASEKAARFVRTCDAFNVPVLTFVDVPGFLPGVDQEHDGIIRRGAKLIFAYAEATVPLITVITRKAFGGAYDVMGSKHLGADLNLAWPTAQIAVMGAQGAVNILHRRTIADAGDDAEATRARLIQEYEDALLNPYTAAERGYVDAVIMPSDTRRHIVRGLRQLRTKRESLPPKKHGNIPL

SEQ ID NO: 71801 - protein, 329 aa, Saccharomyces cerevisiae
MTTVSINKPNLLKFKHVKSFQPQEKDCGPVTSLNFDDNGQFLLTSSSNDTMQLYSATNCKFLDTIASKKYGCHSAIFTHAQNECIYSSTMKNFDIKYLNLETNQYLRYFSGHGALVNDLKMNPVNDTFLSSSYDESVRLWDLKISKPQVIIPSLVPNCIAYDPSGLVFALGNPENFEIGLYNLKKIQEGPFLIIKINDATFSQWNKLEFSNNGKYLLVGSSIGKHLIFDAFTGQQLFELIGTRAFPMREFLDSGSACFTPDGEFVLGTDYDGRIAIWNHSDSISNKVLRPQGFIPCVSHETCPRSIAFNPKYSMFVTADETVDFYVYDE

SEQ ID NO: 71802 - protein, 275 aa, Corynebacterium glutamicum ATCC 13032
MDARGMLAIAEAVVDDAEALFMQGFGAAPAHMKSPGDFATEVDMAIESHMRSMLNMMTGIAVIGEEGGGATSGTRWVIDPIDGTANFAASNPMSAILVSLLVDDQPVLGITSMPMLGKRLTAFEGSPLMINGEPQEPLQEQSSLVSHIGFSSMASPRNTAFPVELRRDLLTELTESYLRPRITGSVGVDLAFTAQGIFGACVSFSPHVWDNSAGVMLMRAAGAQVTDTEGHPWAPGRGVVAGTKRAHDVLLSKIEKVRLMHADAGNDQSLNEEYK

SEQ ID NO: 71803 - protein, 233 aa, Oryza sativa Japonica Group
MMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQVCKQNVLSSSLLNDNGTAFINQCLLNTPTFGSQFIFMHNLFCLLIPELQVSCYHSFVDKCHAVVLQTFCATTPTLC

SEQ ID NO: 71804 - protein, 640 aa, Neisseria meningitidis FAM18
MIEIKNLTLQRGLKVLLDKANATVNPGQRVGLIGKNGTGKSSLFALIKGKITQDGGDVSIPKNWRLASVSQETPDLDISALDYVLQGDAELQAFQTALRQAEAQNDGMKQAEYHAKLEEIDAYTAPARAAKLLNGLGFSQEEHSRPVKSFSGGWRMRLNLAQALICRADLLLLDEPTNHLDLETVLWLENHLASLPCTQIIISHDRDFLNAATTQTIELSQQKLTQYGGNYDFYQNERAQRLAQQQAAYVKQQAQIKHLQSFIDRFKAKATKAVQAQSRMKALAKLERVAPAHLDSEFSFEFYHPDHLPNPLLKLEHADLGYEGKTVLHDITLSLESGARYGLLGVNGSGKSTFIKALAGKIDLLSGSIVRSEKLNIGYFAQHQLDTIRADQNPVWHIQQLSPKVREQEIRNFLGGFNFVGDMALQKTEPFSGGEKARLALAMIIWQKPNLLLLDEPTNHLDLDMRHALTLALQSFQGALIIVSHDRSLLEATTDSFLLIDKGRLKNFDGDLNDYRQWRLAQENAAAAPAASAQSQSRKDTKRIEAQIRQEKARRGKPIQQKIDRAEKEMAQLSEIQTACEAFLAQEDAYLEANKEKLQNTLSQLAKVKTQLAQIEEVWLACQEELERIETEIEKQFAER

SEQ ID NO: 71805 - protein, 323 aa, Mycobacterium sp. MCS
MARYDSVLEALGNTPLVGCPHLSPRWDDDENGPHVRLWAKLEDRNPTGSIKDRPALRMIEQAERDGLLQPGSTILEPTSGNTGISLAMAALLKGYQMICVMPENTSIERRQLLELYGARIIFSPAEGGSNTAVAHAKELAAANPDWVMLYQYGNPANADAHYYGTGPELLADLPEITHFVAGLGTTGTLMGTGRFLREKVPGVQIVAAEPRYGEGVYALRNIDEGFIPELYDPDVLTTRFSVGSFDAIKRTRELVTKEGIFAGVSTGAILHAALGMAAKAIKAGERADIAFTVCDAGWKYLSTGAYTGSLVDAEDALEGQLWA

SEQ ID NO: 71806 - protein, 487 aa, Ralstonia sp. SJ98
MQTQLFIDGRFVAALSGETLATLNPHDNSEIAQVSMAGREDVDRAVQAAKKAFPAWSAMAAADRGRLLLKLADAIEANADELARLESMDTGHPIRDTRNLDVPRTAATFRYFGGMADKFEGSVIPVEASFLNYLTREPVGIVGQVVPWNFPLMFTSWKMAPALAAGNCVVMKPAELTPLSSLAIAQLMAEVGFPAGVVNVLPGFGHVAGQYIAEHPEIGKVAFTGSTAVGRKIVQASSGNLKKVQLELGGKGANVVFGDANLDAVVQGSAFGIFHNQGQACIAASRLIVHESIADDLLERFTSLARSIRIGDPLDPSTEMGPLTSQMHRDRVLSYVDVAREQGGRVLAGGKSPDAAGLAKGCYVEPTIVQAKPTDRVAQEEVFGPFVTVSTFKSDEEGLAIANGTEYGLGAGLWTRDLQRAHLFARQLKSGMVWINCYKRVNPGSPFGGVGASGYGREMGFEVMREYTQAKSVWVNVDANIPPYYPR

SEQ ID NO: 71807 - protein, 324 aa, Oryza sativa
  misc_feature (278)..(278): Xaa can be any naturally occurring amino acid
MALHAAPPPPPPFTAGRLPTTSRRPCFSAGRIFRCSLPAAAARPRNAAFLAPLRTSSAVCTKAVSNSDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLNSYDPNLRVPLWSSADDARDGILSIWETADVIKIKEKEVSLFXQKGEETQDKDFFKKKKPPALQLLKKAFFFSPGKGAQKGVGEKLFFL

SEQ ID NO: 71808 - protein, 251 aa, Idiomarina baltica OS145
MFKRDVIRIAREAGAAIMRVKQEHSLQVSTKADESPVTQADLAAHHVIVDALRKLATTYPVISEECCDISWSQRKNWHRYWLVDPLDGTQEFIKGNDEFSVNIALIEQGVPILGVVYAPALDDLYYGERDVGAELNGQSITAVTRVPETLRVMISRSHPSEETLTWLEQLTVPYETIAVGSALKLCWIAAGKADLYPRLGPTSEWDIAAGQAVLLSAGGVVNKINGEPLRYNQKESFLNPSFIAKTRAYVI

SEQ ID NO: 71809 - protein, 500 aa, Idiomarina baltica OS145
MLKIKSTDSNRTLLSLDDSYLFDDVHDWRAQRLTEIDLKPAKQQLVIGEYKNVTEGRKVTHTLCRSRAAIEALQQPTHSFTAIVNKIRSSQWLGVTGKPITDVVNIGVGGSDLGPQMASFALKEFDDESSSSAVDVHFVSSMDGGQLYAVLPIVDPETTLFVIASKSFGTIDTFANVDTVKCWVNHVMSESAWLEHHVIGVSSNKEKMTAYGIPEHHQLSFDEGVGGRFSLWSTIGLSIAVSIGMAPFCKMLAGALAVDEHFLTVPDNDNVPVRLALNGVYLRQQKGINNLAILPYDGRLRMLPSYLQQLDMESNGKQATRDNKSLHQPTGPILWGGFGPNGQHAFYQHLHQGYDDFAADFVLVLNRSATRFPPQVAASLQQQQRLSVANCLAHRRLLWWGDKSVESPRDNYPGSHASNLLLLDELTPESFGALIAVYEHKIFIQGLLWDVNSFDQPGVEKGKKYALSVLDALSDNQSEDFDDVTNALIDYYRQHINRDS

SEQ ID NO: 71810 - protein, 177 aa, Nitrosomonas europaea ATCC 19718
MTKTTKSANTKTPDEVKTDGLKEKMVSVNRVTKVVKGGRILGFAALTVVGDGKGSVGMGKGKSREVPLAVQKAMDEARQRMVRVNLINGTLHHSVIGRHGAARVYMQPASEGTGIIAGGPMRAIFEVMGVHNILAKCLGSTNPYNIVRATLDGLSKVQTPAMIAAKRGKSIDEITGA

SEQ ID NO: 71811 - protein, 340 aa, Idiomarina baltica OS145
MNKSILLTGGTGYIGSHTTLELLNNGYEVVVIDNLSNSSRESLKRVEQLTQKSVTFAQVDVRDAEALNQVFENHNIQSVLHFAGHKAVGESVEKPIQYYQNNVAGTLTLCEVMARNNVFELIFSSSATVYGANAQSPISESMPIGATTNPYGTSKYMVERMLMDLAASDPRWRIATLRYFNPVGAHRSGQIGEDPNGIPNNLVPFVSQVAVGKLDQLQVFGNDYDTTDGTGVRDYIHVVDLALGHIAALRYMDSHQGFEAFNLGTGKGYSVLEVVDAFEQQSGLNIPYTVAQRRPGDIAKCFANPEKASKLLGWQAKCELAEMMRDTWHWQSQNPNGYDQ

SEQ ID NO: 71812 - protein, 301 aa, Shewanella sp. MR-4
MNKLTDFERYVIEEKGTERPFSGEYYKHDAKGVYLCKKCHAPLYRSEDKFNAHCGWPAFDDEIPGAVSRHVDADGRRTEIVCSQCGGHLGHVFEGEYLTPKNIRHCVNSVSMVFQAADEVTISTHKTAFATFGAGCFWCVEAIFKSLKGVLNVSSGYSGGEASDADYKSVCSGLTGHAEVVHIEFDPAQISFTTLLQVLFESHDPTTLNRQGNDKGPQYRSVVFAHDAAQIEETNAMITKLTEARVFDAPIVTQVVAFESFYPAEDYHNDYFALHGEQPYCQIVVRPKVEKIRALFAELQA

SEQ ID NO: 71813 - protein, 388 aa, Idiomarina baltica OS145
MKITVAGTGYVGLSNAVLLSQNNEVVAYDIDPEKIDSINRRQAPIVDTELQQYLTEKPLFLNATNDAAEAFSDCDWVIVATPTDYDPMTNHFNTASVESVIQQVITVNPDAVIVIKSTVPVGYTEKIKRQFNTNNIMFSPEFLREGRALFDNLYPSRIIVGERSERANLFAGLLQQGAIKQDIPVLTTDSTEAEAIKLFANTYLAMRVAYFNELDTYAEVHGLDTRQIIEGVCLDPRIGDHYNNPSFGYGGYCLPKDTKQLLANYHQVPQTLIQAIVDANTTRKDFVAHQIAAKQPEHVGIYRLVMKTGSDNFRASAVQGIISRLKERQLNVVIYEPVLEEENFLGCEVIRDLSVFKSKADLIVSNRLTEELFDVADRVYTRDLFNAD

SEQ ID NO: 71814 - protein, 436 aa, Bradyrhizobium sp. ORS278
MAVAMTVATEPNKPKTSAGSFFRLLGPGLVTGAADDDPSGIATYSQAGAQFGYGLLWTVFLTTPFMIAIQLVSARIGRVTGKGLAANITAVAPRWIVFGLVALLVGANTFNIAADIAAMAESLSLVIGGLNHEHALIFAAASTLLQVFLPYRRYAPFIKVLTLSLFAYVATALMVKVPWGTALLAAVWPNPSTDADYLLTVVAVLGTTISPYLFFWQASQEVEEMNQGKVDRPLRELSRKNHPELRRMRIDTTIGMIFSNAIAFFIILTTATVLHGSGITKIDSATQAADALRPLAGDFTFLLFALGIIGTGLLAIPVLAGSAAYGVAEIFGWHATLEAKPDEAAGFYSIIAAATLIGFGLGFTGIDSIHMLVWSAVLNGIAAVPIMAMMMVIVSNVGLMGRFRARSWLIGLGWVGTAIMAVAVLALLWSFVTGQG

SEQ ID NO: 71815 - protein, 543 aa, Bradyrhizobium sp. ORS278
MSAPTHSTHSPRGLTLLRDPLLNKGTGFTEQERDALGLRGFLPAGVMSMQAQAERILVNLRSLSNDLEKYVALNALHDRNEALFFRVVCDNIDEIQPLIYTPTVGLACQKYGLIFQRPRGLFISANDRGRIAEILANWPYRARLIVVTDGERILGLGDLGANGMGIPVGKLSLYSACAGIHPEECLPVMLDVGTNNEELLADPYYIGLRQKRLTGEAYDAFVDEFMTAARTAFPGVLIQFEDFANHAAFKLLHKYRDEACVFNDDIQGTAAVALAGLFSALRITGGKLRDQTVLFLGAGEAATGIADLVVSAMMAEGLSEAEALRRNWLTDSRGLVIKGRENLHGHKLRYAHDQAPIGDFLSAIKTLKPTAIIGVAAVGGAFTPEVLQAMAELNERPIIFALSNPTSKAECSAEAAYRYTQGRALFACGSPYDSVKLDGKTFVPRQGNNSYIFPGVGLGAIASGARLVTDEMFMAAAHTLANCVTGADLEQGSLYPALPRIREVSAHIGAAVAGVAYQNGLATGPAPNDLLGFVESKMYDARY

SEQ ID NO: 71816 - protein, 355 aa, Vibrio fischeri ES114
MAFQTMVEIKNWLNTFTHSQLCEGWADISNVVSIEATGNINVVFPFVSKSLQTDFNHWLEGQKLELALPDLSVFVSSKTSSLKTNQPAVKGVKNIIAVSSGKGGVGKSTTAVNLALALHHLGARVGILDADIYGPSVPLMLGVEDKKPAIVDNNRMMPIEAHGLYSNSIGYLVEKGEAAVWRGPMASKALSQLLNETWWPDLDYLIIDMPPGTGDIQLTLSQQVPTTGAVIVTTPQDLALTDAIKGVNMFTKVDVPVIGVVENMSIHICSNCGHQEAIFGTGGALTMAQRYSIPLLSQLPLHIDIRSETDSGTPSVAINSTSPHSKLYINLAEQVSSRLYWQGEVIPDQIMFKSL

SEQ ID NO: 71817 - protein, 574 aa, Exiguobacterium sibiricum 255-15
MAQHIKGIGASAGIAIAKAFVMETPVFDIPTHKIEDSAAEKERFQAAIVKSKGELEIIRENTLKELGADKAEIFSAHLLILEDPEIVSQVNAKIDDEKTNAAQALDEVSQMMVMIFESMDNEYMRERAADVRDVTKRTMAHLLGITFVTPAQINEEVIIIAEDLTPSDTAQLNRKYAKGFATNIGGRTSHSAIMSRSLEIPAVVGTKVVLTEVKHGDFLILDGTEGDVIVNPSSEQIAEYEEKRSAYIAQKEEWKKLKNEKTVTADGHHVELAANIGTPNDVKGVLENGAEAVGLYRTEFLYMDAETFPTEDEQFTAYKTVLESMGDKKVVIRTLDIGGDKELSYLDLPHEMNPFLGYRAIRLCLDQTDLFRTQLRALLRASAYGKLAVMFPMIATLEEFRAAKALLLEEKANLQAEGVTVSEDVEVGMMVEIPSTAVMAKQFAKEVDFFSVGTNDLIQYTMAADRMNEKVSYLYQPFNPAILNLLNNVITEAHKAGKWVGMCGEMAGEELALPILLGLGLDEFSMSASSVLRARSLMTRLNKAECEAIVEQVLDMDTAEDVVNFLSTTFDIKK

SEQ ID NO: 71818 - protein, 61 aa, Mesembryanthemum crystallinum
HVMFLKVDVDELESVSEQYKIEAMPTFVYLKDGEEVERLVGVTKNKIVAAILKHATEAVAA

SEQ ID NO: 71819 - protein, 475 aa, Burkholderia sp. 383
MSTQPQIVPTILCGGAGSRLWPVSRESHPKPFIRLEDGESLLQKAFKRGTQLPGVTEVVTVTNRELYFKTSDEFSTVNTGHLSTSFILEPFGRNTAVAIAAAALRVAATLGENAILLVLPADHLVTDDAAFATAVQEAAALALKGALVTFGITPTFAETAYGYIEADGTRVKRFVEKPTVDVARQYVESGSFLWNSGMFCFTAAFLLAEMAKHCPDVLEATRACIAQSRQSEGGGVSLVELNGDLLNRSPDISIDYALMERSDKVAVVRCDIGWSDIGSWNALGDLLKPDDHGNRVDGEALLHDVSNCYIRSDNRLVGAVGVKDLLVVDTPDALLIADRNRAQDVRHVYAALKSQGHETFRVHRTVGRPWGMYTVLEESTRFKIKRIEVKPGASLSLQLHHHRSEHWIVVSGMALVVNNDEEFYLRTNESTYIPAGHKHRLTNPGVVDLVMIEVQSGDYLGEDDIVRFDDNYGRS

SEQ ID NO: 71820 - protein, 83 aa, Glycine max
  misc_feature (70)..(70): Xaa can be any naturally occurring amino acid
MKETTKVINKPMITIPIVNNDPNLTTSDSEFRQTSISLVAKFMRVKALLEPLSFKDIYSILNPISGHYIXFKPTTTIPNKRKA

SEQ ID NO: 71821 - protein, 129 aa, Brassica napus
  misc_feature (3)..(3): Xaa can be any naturally occurring amino acid
  misc_feature (14)..(14): Xaa can be any naturally occurring amino acid
  misc_feature (16)..(16): Xaa can be any naturally occurring amino acid
  misc_feature (19)..(19): Xaa can be any naturally occurring amino acid
  misc_feature (22)..(22): Xaa can be any naturally occurring amino acid
  misc_feature (25)..(25): Xaa can be any naturally occurring amino acid
  misc_feature (33)..(33): Xaa can be any naturally occurring amino acid
  misc_feature (36)..(36): Xaa can be any naturally occurring amino acid
  misc_feature (41)..(41): Xaa can be any naturally occurring amino acid
  misc_feature (49)..(49): Xaa can be any naturally occurring amino acid
  misc_feature (58)..(58): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(90): Xaa can be any naturally occurring amino acid
  misc_feature (98)..(98): Xaa can be any naturally occurring amino acid
  misc_feature (104)..(104): Xaa can be any naturally occurring amino acid
  misc_feature (111)..(111): Xaa can be any naturally occurring amino acid
  misc_feature (113)..(113): Xaa can be any naturally occurring amino acid
  misc_feature (115)..(115): Xaa can be any naturally occurring amino acid
  misc_feature (121)..(121): Xaa can be any naturally occurring amino acid
  misc_feature (125)..(125): Xaa can be any naturally occurring amino acid
MRXLSRVAAFLELXIXTRXMAXTAXPMADFLTXSPXTPPPXASHLRPLXSHTFSLAHXPTPIHRWNLPNLPNGTELWIKRDDFTXMXLSXNEVRKLEXLMADAXEQQADTXIXSXRIQSNXCRAXPVAS

SEQ ID NO: 71822 - protein, 434 aa, Rickettsia akari str. Hartford
MNITFIGSGYVGLVSGIIMSYLGHNVTCLDNDEVKISKLNKQILPIYEAKLDEYLKQALEANRLKFTNIYNNELQNAEAIFITVGTPSKESGEADLKYVYDAINKVSKHINKDCLIVIKSTVPPGSCSNIIASLNSQGFLFNVASNPEFLREGNAVEDFLYPDRIVIGVHDKESEEILRKIYAPLIEQGAKFVITDLVTSELIKYASNSFLATKIAFINEMADLCEKIGGNIKDLSKGVGLDQRIGQDFLNAGPGFGGSCFPKDILALNNLVENHHIDCKILKAVITSNKQRPSNMVDKIATLLDGDLKGKNIAILGLTYKAGTDDVRASPAIEIVKILLNKDVYVKAFDPIGLENAKKNLEHKNLLYLDSVDEACKSVDIIVIATEWLEFKELNWHGIYNLVQSTIIIDLRNILDNEAMRKIGFRYYAVGSKM

SEQ ID NO: 71823 - protein, 638 aa, Mycobacterium tuberculosis CDC1551
MLQQIRGPADLQHLSQAQLRELAAEIREFLIHKVAATGGHLGPNLGVVELTLALHRVFDSPHDPIIFDTGHQAYVHKMLTGRSQDFATLRKKGGLSGYPSRAESEHDWVESSHASAALSYADGLAKAFELTGHRNRHVVAVVGDGALTGGMCWEALNNIAASRRPVIIVVNDNGRSYAPTIGGVADHLATLRLQPAYEQALETGRDLVRAVPLVGGLWFRFLHSVKAGIKDSLSPQLLFTDLGLKYVGPVDGHDERAVEVALRSARRFGAPVIVHVVTRKGMGYPPAEADQAEQMHSTVPIDPATGQATKVAGPGWTATFSDALIGYAQKRRDIVAITAAMPGPTGLTAFGQRFPDRLFDVGIAEQHAMTSAAGLAMGGLHPVVAIYSTFLNRAFDQIMMDVALHKLPVTMVLDRAGITGSDGASHNGMWDLSMLGIVPGIRVAAPRDATRLREELGEALDVDDGPTALRFPKGDVGEDISALERRGGVDVLAAPADGLNHDVLLVAIGAFAPMALAVAKRLHNQGIGVTVIDPRWVLPVSDGVRELAVQHKLLVTLEDNGVNGGAGSAVSAALRRAEIDVPCRDVGLPQEFYEHASRSEVLADLGLTDQDVARRITGWVAALGTGVCASDAIPEHLD

SEQ ID NO: 71824 - protein, 680 aa, Oryza sativa Japonica Group
MEVEEEAFFDTREELLPPSPAAALPWSGGLDSVRQRRERFMRSMGLERSPSLRQADFADVVGDVEEEGEVAAEAEIGRWSSQSDENECSMSSWSTEETTSYDDGASDDNSVSGSGKASRSFSSLSFIQRLMSRNGKPSGAPKTIDRRRNGWLRRLGVSACVVDSGAADEASTSSSDSEQIGAGRYERIKVHSYRKRSKELSAVYQGQVIKAHDGAILTMKFSPDGQLLATGGEDGVVRVWAVMQSEDCKIPLDDPSCVYLKARRKYGLAPVNAESEKKSKINGLKKSDSACIVVPTMVFQISEEPVHEFRGHSGDVLDLSWSSDKHLLSASTDKTVRMWEIGYANCIRVYPHSNFVTCVQFNLADENLFISGSIDGKIRVWDITRSSVVDWVDIRDIVTAVCYRPGGKGVVVGTITGNCRFYEISDNLLKLETQIALNGKKKSSLKRITGFQFCPSNPSKLMVTSADSKIRILDGTNVIQNYSGLRSGSCQLSATFTPEGQHIISASEDSNVYVWSHENQYECACKQAKTTQTSEHFRSNNAAIAIPWNGTKPRSPVPLSSQILPPQGDTFWSMSKAIKYNSSLCGKDSSIKKIVSTPAAPGIFNLNQEFFIESSCKSSATWPEEMLPSTTASVNLDESQFKLLRNCFQGTSNSWGQVIVTAGWDGRIRYFQNFGLPVHQ

SEQ ID NO: 71825 - protein, 418 aa, Saccharomyces cerevisiae
MSTIKPSPSNNNLKVRSRPRRKSSIGKIDLGDTVPSLGTMFETKESKTAAKRRMQRLSEATKNDSDLVKKIWFSFREISYRHAWIAPLMILIAVYSAYFTSGNTTKTNVLHRFVAVSYQIGDTNAYGKGINDLCFVFYYMIFFTFLREFLMDVVIRPFAIRLHVTSKHRIKRIMEQMYAIFYTGVSGPFGIYCMYHSDLWFFNTKAMYRTYPDFTNPFLFKVFYLGQAAFWAQQACILVLQLEKPRKDHNELTFHHIVTLLLIWSSYVFHFTKMGLPIYITMDVSDFLLSFSKTLNYLDSGLAFFSFAIFVVAWIYLRHYINLKILWSVLTQFRTEGNYVLNFATQQYKCWISLPIVFVLIGALQLVNLYWLFLIFRVLYRILWRGILKDDRSDSESDEESDESSTTPTDSTPTKKDI

SEQ ID NO: 71826 - protein, 393 aa, Physcomitrella patens subsp. patens
MNYGFVWYVCVFAVKPGRNDLVVCFGELLIDFVPTVGGVPLADAPAFKKAPGGAPANVACGIAKLGGNSAFVGKVGDDEFGYMLCDVLKDNKVETKGIRFDSQARTALAFVTLREDGEREFMFYRNPSADMLFEVHELDTDLLKQASILHYGSISLITEPSRSTHLEAMRIAKEAGALLSYDPNLRLALWPSAAAAKEGIKSIWERADIIKVSDEEVVFLTDGDPKDDQNNMKMFHPRCKLMLVTEGGEGCRYYTPKFRGHVNGVKVQVVDTTGAGDAFCAGLLSQLAVVPSIIDDEPKLRNALTFANACGAITTTERGAIPALPDKDTVLRLIRKTPRLFGYLMICLLPNLFPVPVKYSISTKRVSCKVATAICKRWSIYFGLVDLIIYFLP

SEQ ID NO: 71827 - protein, 376 aa, Candida albicans SC5314
MLAARSSIRRCFSTSSTTLKSLKIGLIPGDGIGREVIPAGKAVLENLPAKHDLQFEFVNLDAGFELFKKTGTALPDETVDVLKKECDGALFGAVSSPTTKVAGYSSPIVALRKKLGLYANVRPVKSVEGIGRPVDMVIVRENTEDLYIKEERVYKKEDGTKVAEAIKRITETASTRIAKMAYEIALQREAVRKGTSGKQLHEKPSVTVTHKSNVLSQSDGLFRETCRAVYDANANEYGGIEYKEQIVDSMVYRMFREPEIFDVVVAPNLYGDILSDGAAALVGSLGVVPSANVGDNFAIGEPCHGSAPDIEGKGISNPVATIRSTALMLEFMGYPEAAATIYQAVDANLAEDKIKTPDLGGNSTTQEVIDDIIRRF

SEQ ID NO: 71828 - protein, 337 aa, Frankia sp. EAN1pec
MTAPAGGVPTGGVAADAARLDRIALTGLRVHGRHGVLPAERELGQFFVVDATLWLDTGPAAATDDLTLTVHYGELAQALADIVAGEPVELIETLAHRLVRACLAADPRVAAAEVTVHKPAAPITVAFTDIAVTVARSRDAAVTTGPSREVAATCSRDVAAAAGPSAAGASASAGHAVVAIGSNIGDRLAHLRGAVRDLDARLGVLAVSAVYETEPVGGPEQDDYLNAIVLVGAAPPRDLLAAARAAERTAARERTIRWGPRTLDVDIIACGDTRSDDPEILLPHPRAHERLFVCVPWLDVEPDAMLPGHGRVADLVARLSVVPGAAALRRTPHGLGR

SEQ ID NO: 71829 - protein, 334 aa, Idiomarina baltica OS145
MKTIDVIGIGNALVDQEFEVSEDFLAKHHLEKGMMALIEEEDQNKLIAELSTMGDLKKQCGGGSAANSLVAFAQFGGSAFYCCKVANDEAGDFYQRDLEHVGIQTNLTSQNNDGTTGRCLVMVTPDAERTMRTHLGITADLSTHELHPEAIAAAKYLYIEGYLITSEIAREAIAEAKRVARENDTKIVMTCSDPAMVKYFRDGIDEILDGGVDLMFCNREEAELLTGETDPHAAAQRLLNCASTVAITLGKEGALIADSERQIHIPGVPVQAVDTNGAGDMFAGAMLYGITQDMELEQAGRLASLAAAELVTEFGARLSKERQQQLLEKLLSYA

SEQ ID NO: 71830 - protein, 388 aa, Nocardia farcinica IFM 10152
MDLFEYQAKELFVKHGVPSSEGRVTDTAEDARAIAAEIGKPVMIKSQVKVGGRGKAGGVKYAATPEDAFTHAQNILGLDIKGHITKKILVAEAKDIAEEYYISFLLDRANRTYLAMCSVEGGMEIEEVAATKPERLAKVPVDAVKGVDLAFARSIAEQGHLPAEVLDAAAVTIQKLWEVFVAEDATLVEVNPLVRTPQDEILALDGKVTLDENAGFRHPEHDEFADVDATDPLELKAKENDLNYVKLDGEVGIIGNGAGLVMSTLDVVAYAGENHGGVKPANFLDIGGGASAEVMAAGLDVILNDAQVKSVFVNVFGGITACDAVANGIVKALEILGDEANKPLVVRLDGNKVDEGRKILVEAAHPLVTLAQTMDEGADKAAELAAAR

SEQ ID NO: 71831 - protein, 333 aa, Oryza sativa
MVKVGVNGFGRIGRLVTRAAVLSGKVQVVAINDPFIDLNYMVYMFKYDSTHGHFKGTVKAENGKLVINGHAITIFQERDPSNIKWADAGAEYVVESTGVFTTMEKAGAHLKGGAKRVIISAPSADAPMFVMGVNHEKYDKSLKIVSNASCTTNCLAPLAKVIHDNFGIVEGLMTTVHAITATQKTVDGPSGKLWRDGRGAAQNIIPASTGAAKAVGKVIPELNGKLTGMAFRVPTPNVSVVDLTCRLEKPAKYDDIKRVVKAAADGPLKGILGYTEDQVVSCDFNGDSHSSTFDAGAGIALNDHFVKLVSWYDNEFGYSNRVVDLMVHMASKE

SEQ ID NO: 71832 - protein, 776 aa, Zea mays
MDSSRSWIFTELGQPTYCPETFPEVPFERPTPPIIFFDEEHIFEEESSSSTTATPRNPSDPKQAGGDLDSIATAALSASEEIPQSLLVIDLERATSKCIRTHAVNDVPAVHSIIKGLQLERIGLAGSAPDLDTLTTARHCGSELSCQLGSNKRDVSLRVGCDQSYEWVDPETLDRSFVVLDNACATHEVFEVLPLSFPAAWVNVGKLPTTLCWKIPWPPPVLWVNLHAGGRYITSLLEECQLVFTIFFGGVCSLAKIQWPYMVLEYLANLHVIHGKIHMHPVQVCVRSYAVMPSAKGLVAETHLHFIGTYRGVVSTAFCTEIVESADAYIFAGSIFKDYSSVGYSFLLKKAKAIIVQPERVGVGNGLSFRCLMMKEYWTEIAKKVKKNTTTYENYKRNFVPEGQALESEPNEPLRVNVLFKYIQKMMTVNSVVMAETDDSWFNCHKLKLPESCGYQFQMQYGLIGWSMGALLGYAQGANHKILSPLTALHPLVAVCYDHDIIMDAAGFGDELVVISLGADCQIIASYHRWPFGQTGTGHFSPIGGYQVRQDMVLILDVARFIPLQFFWEAMNTTNDSTLRGSMLISRKVAESSLLYTVSCRDENWKIMPKFCVEDLPSLLKAGIGACVGLVTSGLSVVSSGQGNFSVFVWDPGDSGLVTSSLSAVSSDQGKFSVFVWDPGDRGLVTYGLRVVSIARVTAIMSGTYARGAATTSSPKMRQTQFRWRAEERHDAFNNDANPQIKLILHRQRLGGKPYFKEWGMLDILGVVDELWVMWA

SEQ ID NO: 71833 - protein, 118 aa, Panax ginseng
LCEGGELFDRIVARGHYSERAAAAVARTVAEVVRMCHDCGVIHRDLKPENFLFANKKENSPLKAIDFGLSVFFRPGEKFSEIVGSPYYMAPEVLKRNYGPEVDVWSAGVILYILLCGV

SEQ ID NO: 71834 - protein, 340 aa, Burkholderia sp. 383
MTAKGTILVTGGAGYIGSHTAVELLDNGYDVVIVDNLVNSKAESVRRIERITGKTPAFHQVDVCDEAALAKVFDAHPITGTIHFAALKAVGESVAKPLEYYQNNIGGLLAVLKVMRERNVRQFVFSSSATVYGVPERSPIDESFPLSATNPYGQSKLIAEQILRDLEVSDPSWRIATLRYFNPVGAHASGLIGEDPAGIPNNLMPYVAQVAVGKLERLRVFGSDYATPDGTGVRDYIHVVDLAKGHIAALDALAKRDASFIVNLGTGQGYSVLEVVRAFEKASGRPVPYELVARRPGDIAECYANPQAAADIIGWRATLGIEEMCADHWRWQEGNPRGFV

SEQ ID NO: 71835 - protein, 485 aa, Vibrio fischeri ES114
MSFWNSLSITTRYSRLPRCFFTYVQPTPLDNSRWLIWNSELAKQFDLPENVHNHSELLDAFSGETVPSVFSPLAMKYAGHQFGCYNPDLGDGRGLLLAEIKDKKGNSFDLHLKGAGLTPYSRSGDGRAVLRSTIREYLCSEAMAGLGIPTTRALGMMTSDTPVFREGYETGALLIRMAETHIRFGHFEHLFYSNLLEELKLLSDKVIEWHFPCCLGEDKPYLAMFNNIVDRTAYMIAQWQAVGFAHGVMNTDNMSIIGQTFDYGPFGFLDDYEPGYICNHSDYQGRYAFNQQPRIGLWNLSALAHSLSPLIDKSDLEKALEQYEIKLHDYFSQLMRKKLGLLSKQEGDTRLFESMFELLSQNAVDYTRFMRALSYLDSQDKQTVVDLFVDREAATLWIDLYLTRCKLEVDSFDMRCSKMRKVNPKYVLRNYLAQQAIVKANEGDFSDVKILSTLLASPFDEHPDFERYAELPPEWGKRMEISCSS

SEQ ID NO: 71836 - protein, 388 aa, Arabidopsis thaliana
MATMISNLPRDLMEEILSRVPLKSMRAVRLTCKNWHTLSITISESLAKMYISKTTRESREGESTIITLMNYKLCLTSLVVDVDPYIEHKDDTITTRLVVWNPYWGQTRQIKTRYSHHAFSGRDSTYMFNYSLGYENKNSCRSHKLLRFIDYHWNYRGLHQFFWYEIYDFDSDLWTTLDVTPHWFIVISQSGVSLKGNTYWCARKRSGGYSDHIICFDFTRERFGPLLPLPFSFIDRHHSCVILSCVSEEKLAVLFQYKDHYYKNVVEIWITAKLEAEMVSWSKFLRINTGPIIHTSFFINEEKKVAIGFNDNRKTINIIGEAGYFRELDLGEHAEPYRRRHVFSYVPSSVQIKETAPGNIKKHQSSIETRLFDRNMLRLVAFEKKVSE

SEQ ID NO: 71837 - protein, 413 aa, Eurotium herbariorum
MSSVSHYQRKHKVTVVGSGNWGCAIAKIVAENTASNPSLFEKDVQMWVFEEKVEIPKDSRHYDPSSPLCQGQQNLTEVINQTHENIKYLPGVSLPHNLKANPSIVDAVQDSTILVFNLPHQFIVRTCEQIKGKILPYARGISCIKGVDVNEEGAHLFSETIGNTLGTYCGALSGANIANEVAREKWSEPTIGYDTPHLDSKAPARSAESTAGVVHFEHKDVSGQYSKTKLQPLPNEFPPVDHETLKTLFHRPYFHIRVNSDVAGVSLAGALKNIVALAAGWVDGLGWGDNAKAAIMRVGLLGMVKFGERFFGATIDNRTFTDESAGVADLITSCSSGRNFRCAKLSIQRKQHISEIEKTELNGQSLQGTLTAIEVNHFLKKQGSESDFPLFTACYHILQGTMQPEVIPSYIER

SEQ ID NO: 71838 - protein, 333 aa, Pseudomonas fluorescens Pf-5
MGLLIEGRWHDQWYESGKDGAFQREQAQRRNWVTADGRPGPSGEGGFAAEAGRYHLYVSLACPWAHRTLILRKLKGLEQLIDVSVVSWLMRENGWTFDSAHGSSGDALDHFDFMHQRYTADTADYTGRVTVPVLWDKQQQRIVSNESAEIIRMFNSAFDGLTGNGLDFYPQPLRARIDELNARIYPALNNGVYRAGFATSQQAYETAFDDVFAELDALEALLDKQRYLAGEYLTEADVRLFTTLIRFDAVYHGHFKCNLRRIADYPNLSNWLRELYQWPGIAETVDFAHIKGHYYASHTTINPTGIVPKGPLQDFSRAHDRQRLSGQGVWCRG

SEQ ID NO: 71839 - protein, 153 aa, Vitis vinifera
MEKPKEQKRDKSEEEAKSRIWDCDSSLYDSFELKSFKRQLDSAIVSSSRTLSMPHLSDRRPPPPPQVAPSKKPSKFSRSFNKLLRSVFRSKPHPTSLFRVQEPFFFYDKSDALSTIPEASEIDYAGVSPDVNSLVKRSTSDRFSASSLGISCA

SEQ ID NO: 71840 - protein, 355 aa, Chlamydomonas reinhardtii
PNGNVVAAASGGDHTCVLLGGSGAISCWGSNAYGQLGFGDKTDRPSPPVSLAEGQLTLSVVDLGPEARAVQLAVGGFHVCALLSDSRIKCWGHNDYGGLGLGDVSRRGDQAGEMGANLPAVDLGLSSLPGVGVASITAGCYHSCALLTNGRVKCWGNNVYGQLLGLGSGNNRGDQAGEMGTGLPFVNLGTGVVATSVTAGCQHTCALLANGTVKCWGFNFYGQLGLGHNTTKQGNTPADMDAALPAVDLGPGELATAVVAGGFHTCALLANSSAVKCWGRNDYGQLGYGDKKNRGERAGQMGAALPVVSLGPAGTQVQDLSAGLLHTCALLAGSNAVKCWGANDSGQLGLGDTDN

SEQ ID NO: 71841 - protein, 482 aa, Oryza sativa Japonica Group
MKLRLRSMDQRGGAGGAAETHRVQLPDTATLSDVKAFLATKLSAAQPVPAESVRLTLNRSEELLTPDPSATLPALGLASGDLLYFTLSPLPSPSPPPQPQPQAQPLPRNPNPDVPSIAGAADPTKSPVESGSSSSMPQALCTNPGLPVASDPHHPPPDVVMAEAFAVIKSKSSLVVGDTKREMENVGGADGTVICRLVVALHAALLDAGFLYANPVGSCLQLPQNWASGSFVPVSMKYTLPELVEALPVVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQGESSQVGRNWKERFGAAWKVSNNKGQKRPSPFFNYGWGNPYSPHGFPVIGGDSDMLPFIGHPNLLGRSFGNQRRNISPSCSFGGHHRNFLG

SEQ ID NO: 71842 - protein, 242 aa, Neisseria meningitidis FAM18
MTAYRIAPSILSADFARLGEEVESVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYLLENVLDRLDMVLLMSVNPGFGGQSFIPHTLEKIRRVRAMLDRYEAQSGRHIAIEVDGGIKTDNIAAVARAGADTFVAGSAIFGKPDYKAVIDAMRAELEKSGRLNLAPMIEIEMPSEN

SEQ ID NO: 71843 - protein, 809 aa, Oryza sativa Japonica Group
MKLRLRSMDQRGGAGGAAETHRVQLPDTATLSDVKAFLATKLSAAQPVPAESVRLTLNRSEELLTPDPSATLPALGLASGDLLYFTLSPLPSPSPPPQPQPQAQPLPRNPNPDVPSIAGAADPTKSPVESGSSSSMPQALCTNPGLPVASDPHHPPPDVVMAEAFAVIKSKSSLVVGDTKREMENVGGADGTVICRLVVALHAALLDAGFLYANPVGSCLQLPQNWASGSFVPVSMKYTLPELVEALPVVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQDTCGCMMCKCIYSDQRKDIVLADKYTCGNYMQKPVTQPGRWLIILVYHSLLCQYITIGLSLLWYHLVDLVQDAPAAGIHFDCIIPLPINPYQLPPSAGACCSTTQASASAKDGGNMYSPPCSAAASSQGHCFAVGANQLASLDLAMDFDEPILFPVHNASLQEGIQFYNPTGDTQLSRNMSIDKCLKGSKRKGSGEGSSSLHSQEETGEMPQRELSMEHAGEKAGDADASREEYVHVRAKRGQATNSHSLAERFRREKINERMKLLQDLVPGCNKITGKAMMLDEIINYVQSLQRQVEFLSMKLSTISPELNSDLDLQDILCSQDARSAFLGCSPQLSNAHPNLYRAAQQCLSPPGLYGSVCVPNPADVHLARAGHLASFPQRGLIWNEELRNIAPAGFASDAAGTSSLENSDSMKVE

SEQ ID NO: 71844 - protein, 428 aa, Arabidopsis thaliana
MSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDDSCIRISYATSLDVLQAAVEKIRKALEPLRATVSV

SEQ ID NO: 71845 - protein, 277 aa, Mycobacterium tuberculosis CDC1551
MAENLAAEAAAFVRGRRAEVFGISRAGDGDGAVRAKSSPTDPVTVVDTDTERLLRDRLAQLRPGDPILGEEGGGPADVTATPSDRVTWVLDPIDGTVNFVYGIPAYAVSIGAQVGGITVAGAVADVAARTVYSAATGLGAHLTDERGRHVLRCTGVDELSMALLGTGFGYSVRCREKQAELLAHVVPLVRDVRRIGSAALDLCMVAAGRLDAYYEHGVQVWDCAAGALIAAEAGARVLLSTPRAGGAGLVVVAAAPGIADELLAALQRFNGLEPIPD

SEQ ID NO: 71846 - protein, 153 aa, Glycine max
  misc_feature (45)..(45): Xaa can be any naturally occurring amino acid
  misc_feature (53)..(53): Xaa can be any naturally occurring amino acid
  misc_feature (110)..(110): Xaa can be any naturally occurring amino acid
MTHALPRGGGIRLEFGFLLYPFSNFIHPDAFAEKLLSILGPMFLXGPLDIMRXWCFCLFYAMAASRGSEVISALFWAVANHITTMEKAERSHPLVGLAANVTLMFSGRTXDIFCNLRQTSCSGVHGWAISLKAMTNIPAGMGLAVRFLPWWGN

SEQ ID NO: 71847 - protein, 425 aa, Frankia sp. EAN1pec
MTLAPERATLPSPDAANPAVSLSCRHCGATYPLSATHVCVECFAPLEIAYDEDRLRKVTRASIEAGPSNLWRYVGLLPAGHVAERRVSLDAGWTPLRPAQRLAAELGMRTLWVKDDSANPTHSFKDRVVSVALTAARELGFHTVACASTGNLAQSVAAHAASAGLRSVVLVPHDLEAGKTVSTAVYGGTLVAIKGNYDDVNRLCSELAGEYEWAFVNVNVRPFYAEGSKTLGYEVAEQLGWRIPGQVVVPIASGSLLTKVDKAFGELGRLGLVEPTPYKVFGAQAAGCNPVAAAYARGADTVAPVKPSTIAKSLSIGNPADGPYALDVARRTGGAITDVTDDEIVDGIRLLARTEGIFGETAGGVTVACLRRLLNEGLLDPDVETVIYNTGDGLKTLDPLVSTGGPTATIPPSLSAFEAAGLGDD

SEQ ID NO: 71848 - protein, 192 aa, Idiomarina baltica OS145
GKDNDFQWVIDPLDGTTNYLRGVPHFCISIAVVHKGTVQQGVVYDPVREELFTASRGAGAQLNGRRLRLSPLTELNGALLATGFPFKAKHRYDEYQAMFGRLFERCADMRRAGAAALDLAYVAAGRYDGFFELGLKPWDLMAGDLLVREAGGIVTDFEGGHNYVQSGHIVAGAPKVLKQMLAQLRKKPESND

SEQ ID NO: 71849 - protein, 483 aa, Nocardia farcinica IFM 10152
MVSVPELLESVPTQLWIGGPVDATGGATFPVHDPATGEVLTHVADATPEDAVRALDAAVAVQDEWAATPARTRGEILRAVFDAITARAEDFALLMTLEMGKALGESRNEVRYGAEFFRWFSEEAVRVHGRYQHAPSGTGRIIVHKQPVGPCLAITPWNFPLAMGTRKIGPALAAGCTMIVKPASETPLTMLLLARLCSEAGLPDGVLSVITTKHSSAVTKPLLDDPRLRKLTFTGSTEVGKKLVEQSANKLLRTSMELGGNAPFVVFDDADVDAAVQGAMLAKLRNGGEACTAANRFHVQRGVAEEFTDKLVEAMRSSVRLGPGTDPETTLGPLVNADQLATVTELVDDAVSAGARVRLGGEAPGGPGWFYPATVLSDVPDRARILNEEVFGPVAPVVTFDTEEQGLAAANDTRFGLVSYIYTRDLDRALRVAEGLESGMVGINRGVISDPAAPFGGVKESGFGREGGFEGIEEYLSTKYIAL

SEQ ID NO: 71850 - protein, 551 aa, Nocardia farcinica IFM 10152
MSTLADVSSDITASAAWRKLHDHHGALAQRHLREIFAEDPERGRELTLQVADLHIDYSKHRATRETLQLLVELAREAGVEAHRDAMFAGEHINTSEDRAVGHVALRLPAGRTMTIDGADAGAQVHEVLRRMGEFTDALRSGQWRGATGERIETVVNIGIGGSDLGPVMVHQALRHYADAGITARFVSNVDPADLVAELTGLNPATTLFIVASKTFSTLETLTNATAARRWLVAALGEDAVAKHFVAVSTNAERVSAFGIDTANMFGFWDWVGGRYSVDSAIGLSVMATIGKERFAEFLAGMHAVDTHFATAPLEANAPVLLGLLGIWYANFFGAESRAVLPYSNDLARFPAYLQQLTMESNGKSVRADGTPVTTATGEIFWGEPGTNGQHAFYQLLHQGTRLIPADFIGFARPTDDLPTADGTGSMHDVLMSNLFAQTKVLAFGKTAEEIAAEGTAPNLVPHKVMPGNRPSTTILAPQLTPAVVGQLIALYEHQVFVEGVIWGIDSFDQWGVELGKQQALALAALLTAAEDPAPQDDSSTDALIRWYRAHR

SEQ ID NO: 71851 - protein, 227 aa, Nicotiana tabacum
RFLQVLHNPTGIDPTIEQWEKIADVIQEKNHIPFFDVAYQGFASGGLDEDASSVRLFAARGMELLVAQSYSKNLGLYGERIGAINVPCSSADAATRVKSQLKRLARPMYSNPPIHGARIVANVVGIPEFFDEWKQEMEMMAGRIKSVRQKLYDSLSAKDKSGKDWPYILKQIGMFSFTGLNKAQSENMTNKWHVYMTKDGRISLAGLSAAKCEYLADAIIDSYYNVS

SEQ ID NO: 71852 - protein, 580 aa, Nitrosomonas europaea ATCC 19718
MICSICLNGCQPVLRLKSRPDEVWREAGNRKSNIDINSLAGEYKMKPLRGKALLNDPVQNKSTAFTREERERYGLQGLLPYSVTDIGKQQQRVLANLRSKNSNIEKYGYLNDLLERNQRLFYRTLIDYIGEIMPLVYTPTVGEACMKFTQIFRKPQGFYITPEDRGKILPLFENWPENDVRIIVVTDGERILGLGDLGANGMGIPIGKMALYVACAGIRPEYCMPVMLDVGTSNQILREDPLYLGYPRPRLTGQDYLSLVEEFVAAVQNKFPQALIQFEDFSSQNAFRLLDRYAGSVRCFNDDIQGTAAVTLAGIYASCRITHKPFVDLKIMLLGTGSAATGVAELLLSAFMMAGLSEAEARSRISFVDRQGLVVTVREEIKPRVRSFASEHAAMDFVGAITAIRPDVLIGATGTAGAFDEIAIRQMARCQEHPVIIALSNPTSHTECTADQAYRWSDGRAVFASGSPFAPVTLDGRTRYPAQGNNVYIYPGIGLGMVASHARLVVEHMFLATAEELANCVLPEEIERGSIYPEIARVRDVSQKIAVKVCQVARQEGLAGVDLPDDLETYVYTLMYEPGY

SEQ ID NO: 71853 - protein, 142 aa, Helianthus annuus
MAAATTTLTGTMASTSFLRPQPTTSMKPSVMFGLKSSNRGGVTMMATYKVTLITPEGKTEFDCADDTYILDHCEDAGIDLPYSCRAGSCSSCTGKVISGTVDQSDQSFLDDDQIEAGWVLTCVAYPTSDVVIETHKEEEMTG

SEQ ID NO: 71854 - protein, 324 aa, Bradyrhizobium sp. ORS278
MTNAIRFHKTGGPEVLTWEQVEVGKPGPGEARIRHTAVGLNFIDIYNRSGLYPVQLPSGLGSEGAGVVEEVGEGVTDLKVGDRVAYGSSPLGAYSEARLMPAALLLKLPDEIDDKTAAAMMLKGLTAQYLIRQTYRVKAGETILLHAAAGGVGLILSQWAKHLGVTVIGTVSSDDKAQLAEAHGCEHTIVYSREDFVARVNEITGGKKVPVVYDSVGKDTFLKSLDCLAPLGYAVLFGQSSGSVDPLNLGLLAQKGSLFVTRPTLFTYAAKRESLVAMANELFDVVKSGTVKIEVNQTYPLKDAAKAHADLAARKTTGSTVLLV

SEQ ID NO: 71855 - protein, 418 aa, Frankia sp. EAN1pec
MILGTGSAWDTACVQLADAAQHLGLDDGMHDLLRTPRRSITVSVPLLRDDGQLLVLSGYRVQHNLARGPAKGGLRYHPACDLDEVKALAMWMTWKCALMGIPYGGAKGGIAVEPGLLSRQERERMTRRYAAELVPLIGPDKDIPAPDVGTDEQTMAWIMDTYSTHTGHTAPGVVTGKPLSIGGSAGRAGATSRGVQLAAFAALRELGRDPRETTVAVQGFGKVGALAAQYLHDAGCRLVAVSDVKGGIHNRAGLNPSALIRHLARGADTVVGYPGTDTITNTELLELNVDMLVPAALEGVINTGNADRVRAPLIVEGANGPVTAEADHVLTGKGTVIVPDILANGGGVAVSYFEWVQDIQAYFWTEDQVNDRLRALMQRSYQEVSALARERRVSLRTAAHIIGVARVAEAHRTRGLYP

SEQ ID NO: 71856 - protein, 158 aa, Saccharomyces cerevisiae
MEEQEIGVPAASLAGIKHIILILSGKGGVGKSSVTTQTALTLCSMGFKVGVLDIDLTGPSLPRMFGLENESIYQGPEGWQPVKVETNSTGSLSVISLGFLLGDRGNSVIWRGPKKTSMIKQFISDVAWGELDYLLIDTPPGTSDEHISIAEELRYSKP

SEQ ID NO: 71857 - protein, 325 aa, Eurotium herbariorum
MSSGQTFKLNNGVTIPGVGFGTFASEGSKGESYNATLHALRTGYRHLDCAWFYQNEEEIGEAIRDFLKENSSVKREDIFVCTKVWNHLHRYEDVIWSVENSLKRLQLDYIDLFLVHWPIAAEKETQEQPKIGADGKYVILHDLTENPEPTWRAMEKIYEDGKARAIGVSNWNISDFEKLFKFAKVKPTVNQIEIHPFLPNEELVQYCFKHDVLPAAYSPLGSQNQVPTTGERVSENKTLNDIAQKGGNTLAQVLIAWGLRRGYVVLPKSGNPARIESNFKSINLSDEDYEAVNAVAKGRHFRFVNMKDTFGYDVWPEETAKQLSA

SEQ ID NO: 71858 - protein, 289 aa, Streptococcus suis 89/1591
MVASKLQRLEETMADFYQPQVAERLNQSVLYSLQAGGKRIRPLLLLTILESFGMELKQAHYQVAACVELIHTGSLIHDDLPAMDNDDYRRGRLTNHKVYDEATAILAGDSLFLDPFGFLAQVDLPAETILALVRELSQASGTFGMVAGQVLDMAGEGQNLTLEQLQAIHANKTGKLLTFPFVAAGLIAGQSDVVINHLRQAGQLIGLAFQVRDDILDVTATFEEIGKTPQKDVLAEKSTYPALMGLEASKVFLEDSLNQAINELDQVAKQVPFSTEKIKEIIESLRING

SEQ ID NO: 71859 - protein, 117 aa, Glycine max
  misc_feature (105)..(105): Xaa can be any naturally occurring amino acid
MSRRGDWVYENNGGTCVAIAGADYCVVAADTRLSVGYNILTREHSKICELADKCVIASSGFQGDIKALQKNLAARELLYQHQHNKRMSCPAMAQLLSNTLYYKRXFPYYAFNVLGGL

SEQ ID NO: 71860 - protein, 338 aa, Metarhizium anisopliae
MAPVKVGINGFGRIGRIVFRNAAEHPEIEVVAVNDPFIDTEYAAYMLKYDSSHGIFKGDIKKEADGLVVNGKKVKFFTERDPSAIPWKSAGAEYIVESTGVFTTTDKAKAHLAGGAKKVVISAPSADAPMYVMGVNEKTYDGKADVISNASCTTNCLAPLAKVIHDKFTIVEGLMTTVHSYTATQKTVDGPSGKDWRGGRGAAQNIIPSSTGAAKAVGKVIPDLNGKLTGMSMRVPTANVSVVDLTARIEKGASYDEIKEAIKEAANGPLKGILAYTEDDVVSSDMNGNTNSSIFDAKAGISLNKNFVKLVSWYDNEWGYSRRVLDLLAYIAKVDAGK

SEQ ID NO: 71861 - protein, 368 aa, Glycine max
DNDAFRRMARLTDGTLSEVLPRISDTDVQISRQRISAFLSSHTAYELLPESGKVVALDVDLPVKQAFHILHEQGVFMAPLWDFCKGQFVGVLSASDFILILRELGNHGSNLTEEELETHTISAWKEGKSYLNRQNNGHGTAFSRCFIHAGPYDNLKDIAMKILQKEVSTVPIIHSSSEDASFPQLLHLASLSGILKCICRYFRHCSSSLPVLQLPICAIPVGTWVPKIGESNRRPLAMLRPTASLASALNLLVQAQVSSIPIVDDNDSLLDIYCRSDITALAKNRAYTHINLDEMTVHQALQLGQDAYSPYELRSQRCQMCLRSDPLHKVMERLANPGVRRLVIVEAGSKRVEGIVSLSDIFKFFIGG

SEQ ID NO: 71862 - protein, 437 aa, Sodalis glossinidius
MRRSPLQNCFDYAAHPTRIQGNIIEASLPAAAIGEVCEVLSSINDTSLAGYARVIGFNGSRTMLSLLCDSAGFSQHHLLVPTGKAFPIPLGEALLGAVLDPLGNICARLDGATETALIATEHRPIDVEALHFSEREPIAEKLITRIRAIDGLLTCGHGQRLGIFAAAGCGKTSLMNMLIEHSEADVYVVGLIGERGREVTEFVETLRHSPRRHKCVLVYATSDYASLERCNAALVATTVAEYFRDQGRRVVLFLDSLTRFARALRDVALAAGEAPARRGYPASVFDALPRVLERPGNSLSGSITAFYTVLLEGDDEPDPDAPDENPLRFSDGHIYLSRKLSAASHYPAIDILHSASRVAGQVTDARQQALAGAMRGLLTRLEEMQTLIDLGEYRLGDNAENDRAHAQKQALWDFLRQDADQAEEFGQTLRLMHAFDA

SEQ ID NO: 71863 - protein, 418 aa, Pseudomonas fluorescens Pf-5
MGYKKIQVPAVGDKITVNADHSLNVPNNPIIPFIEGDGIGVDISPVMIKVVDAAVKKAYGGERKISWMEVYAGEKATQVYDQDTWLPQETLDAVKDYVVSIKGPLTTPVGGGIRSLNVALRQQLDLYVCLRPVRWFEGVPSPVKKPGDVDMTIFRENSEDIYAGIEWKAGSAEATKVIKFLKEEMGVTKIRFDENCGIGVKPVSLQGTKRLARKALQYVVDNDRDSLTIVHKGNIMKFTEGAFKEWAYEVAAEEFGATLLDGGPWMQFKNPKTGKNVIVKDAIADAMLQQILLRPAEYDVIATLNLNGDYLSDALAAEVGGIGIAPGANLSDTVAMFEATHGTAPKYAGKDQVNPGSLILSAEMMLRHMGWTEAADLIIKGTNGAISAKTVTYDFERLMDGATLLSSSAFGDALISHM

SEQ ID NO: 71864 - protein, 138 aa, Gluconobacter oxydans 621H
MTQSCGPNGQTGGGCGVGLTPEQRRILHEHGTERPGSSPLNDEKRAGIYACAACGRPLFASETKYDSGSGWPSFFQALPDGVETTQDSRYGMVRTEVHCANCKGHLGHVFPDGPPPTGLRYCMNGLALDFRPAEGEKA

SEQ ID NO: 71865 - protein, 445 aa, Neisseria meningitidis FAM18
MTDTAGLRRRNLRQWIAEHYGGLQTRFAEAVALNTGELSALLKNKSFGEKKARKIEQAAKMPAFWLDTEHTARPPEHTGKHTMSHISPIPEILADIKAGKMVIITDAEDRENEGDLLMAAQFVTPEAINFMIKHARGLVCLPMDGEMVEKLGLPMMTQKNGAQYGTNFTVSIEAAHGITTGISAADRALTIQTAVSPTAKPADIVQPGHIFPLRAQKGGVLVRAGHTEAGVDLAQMNGLIPAAVICEIINDDGTMARMPELMKFAEEHNLKIGTIADLIEYRSRTESLLEDMGNAPVQTPWGEFQQHVYVDKLSGETHLALVKGTPAADTETLVRVHEPFSVMDFIQANPRHSWSLPKALERVQQAESGVVILLHRTEDGASLLDRTLPKGANQAYKWDSKSYGIGAQILVGLNVKKLRVLGQPSSFTGLTGFGLEVVGFEEAEK

SEQ ID NO: 71866 - protein, 510 aa, Gluconobacter oxydans 621H
MSASSTPRPVMLVILDGFGWREDESDNAVRLANTPTFDTLWATSPHAFLKTSGEDVGLPDGQMGNSEVGHLNIGAGRVVMQELPRISRSARDGSLAQNPALLEFIAALKASGGTCHLMGLISPGGVHAHQDHVVALTKIVSAAGVPVAVHIFSDGRDTAPRSGEDFIGKFLKELPDSVQIATLSGRYYAMDRDRRWERVALAVEAIRDAKGPHAKDALSALQASYASDKGDEFVLPTVLGDYAGMKDGDGILACNFRADRIRQLLDVLVLPDFTEYDSGRKVKFAAVCGMSRYSDHLAPYMSILFPKVPLDDLLGDVVAKAGRTQLRMAETEKYPHVTYFLNGGREVQFDGEERILVPSPKVATYDLQPEMSAPELTDKAVAAIESGKFDMIVLNFANPDMVGHTGSLSAAIKACETVDQGLGRINDAIVKAGGVLLVTADHGNCETMRDPVTGGAHTSHTLNVVPVILAHARGETIHDGRLADLAPTMLALMGVKQPDAMTGVSLLESA

SEQ ID NO: 71867 - protein, 125 aa, Glycine max
GRRDAGRYKDTNIFFYFIRYLYDLLTKGSVVRKKIPMLILCNKTDKVTAHTKEFIRKQMEKEIDKLRASRSAISAADIANEFTLGVPGEPFSFTQCSNKVTTADASGLTGEISQLEEFIREHVKR

SEQ ID NO: 71868 - protein, 72 aa, Triticum aestivum
  misc_feature (58)..(58): Xaa can be any naturally occurring amino acid
MIIPVRCFTCGKVIGNKWDLYLDLLQADYSEGDALDALELFRYCCRRMLMTHVDLIEXLLNYNTLEKTETIK

SEQ ID NO: 71869 - protein, 209 aa, Zea mays
  misc_feature (58)..(58): Xaa can be any naturally occurring amino acid
  misc_feature (132)..(132): Xaa can be any naturally occurring amino acid
  misc_feature (145)..(146): Xaa can be any naturally occurring amino acid
  misc_feature (152)..(152): Xaa can be any naturally occurring amino acid
  misc_feature (158)..(158): Xaa can be any naturally occurring amino acid
  misc_feature (166)..(168): Xaa can be any naturally occurring amino acid
MGSGSNSKEGEERVLSHGDVVLIRSDLAILRGPCFINDRIIAFYFAHLSASLQDDDLXIAEGGSHWTLLILDNITSPSVPRFVHHDSIAGAPNLPIAARLADALRPLLSGSNSKRDTVPLIEGPTPRQTNGXTGGVYVMAIARAXXAWWKSXARTNEXGDWFQAVXXXVDAHSVEAMRTDLLQLISTLIQEKANANSTPMGDTDPGSLE

SEQ ID NO: 71870 - protein, 612 aa, Mannheimia succiniciproducens MBEL55E
MAKFFLAPADNYDVKIGELVDKFVNKVRSFPPGTCPLVVQYASLRSSMSQTCGKCVPCRDGIPHLSFLLRDILAGEGDDSTMRQIRELAEMIRDGSDCAIGYQPAIEILDSIEEFKEEYESHIHNKSCQKVIGQRIPCINMCPAHVDIPGYIAHIGDGNYAEAINLIRKDNPLPTACGLVCEHPCEERCRRRLIDDAINIRGLKKYAVDQVAADVVKVPQALPDTGKKVAVIGGGPAGLTCAYFLAQMGHRVTIYERQKALGGMLRYGIPNYRFPKDRLDQDLNAILSAGRIEVKYGVMVGDDIAIEDIYNSHDAMFVGIGAQKGKTLRIKGSEANNVFSAVEMLDDIGNGKIPDYTDKVVVVIGGGNVAMDAARSAVRCKAKDVRIVYRRRQDDMTALHAEIEAAIMEGIELITLAAPVAIEKDEQGNCTGLTVQPQMTGPYDHGGRPSPVAVKKPPFTIGCDVILIAVGQDIISLPFEEFGMPANRGIFQADLTTAVPDMDGVFVGGDCATGPATAIKAIAAGKVAAHNIDEYLGYHHEFPCETKAPPPKENVRIQVGRANTTERPAYIRKCDFEHVENPYTYEEAMQEAERCLRCDHFGCGVLQGGRDL

SEQ ID NO: 71871 - protein, 386 aa, Physcomitrella patens subsp. patens
MAIFLFPTILRLLLLATSSVVSLALSVQPDAAAMINALEVDSIGYDVTTVLNGNLRGLSFYCIDEATDRAPAWAIVLDSTKSKVLRVQLPLSQDSVVEHIAGSLEGKAGYQDGRGGDALFNHPKMLTLDSDGNIYVADVRNTAIRMITTQGKHSFVTTIAGGMNRTGHNDGEGRVVTFSNDFGVTYLRKNCTLLIVDRGNRMVRAMKLPHLVGRCHDSPSDVPGGFTNGKTLLVAVGILLYSGIILGASTGWLKKLQSKLPWSDTQRSRTQPAITPIESHDIEGQTPFLIPADDEPVLRNSAEIFHREEFANHPQDDSHSENLIDFTDNISRKAPSQHDQNSDSEGESETTTEFTPEVHVVTREERLDSMMQQCLVCLTTPSAKTQ

SEQ ID NO: 71872 - protein, 576 aa, Zea mays
  misc_feature (149)..(149): Xaa can be any naturally occurring amino acid
MGMAATVRRAASSVLSRFLLTKPSPSPASAAGNKSALLGAGDGLYGPYYFLGSSLPVIAIELWFSTAPASAAAAAEEPIQPAVEVKHTQLLINGNFVDAASATDVCLSPGKTFPTLDPRTGEVIARVAEGDSEDIDRAVAAARRAFDDXPWPRMTAYERCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 71873 - protein, 441 aa, Vigna unguiculata
MSQPKIKRRVGIYEVGRTIGEGTFAKVKFARNSETGEPVALKILDKEKVLKHKMAEQIRREVATMKLIKHPNVVRLYEVMGSKTKIYVVLEFVTGGELFDKIVNHGRMSENEARRYFQQLINAVDYCHSRGVYHRDLKPENLLLDTYGNLKVSDFGLSALSQQVRDDGLLHTTCGTPNYVAPEVLNDRGYDGATADLWSCGVILFVLVAGYLPFDDPNLMNLYKKISAAEFTCPPWLSFSARKLITRILDPDPTTRITIPEILDDEWFKKDYKPPVFEENGEINLDDVEAVFKDSEEHHVTEKKEEQPTSMNAFELISMSKGLNLENLFDTEQGFKRETRFTSKSPADEIINKIEEAAKPLGFDVQKKNYKMRLANVKAGRKGNLNVATEIFQVAPSLHMVEVRKAKGDTLEFHKFYKKLSTSLDDVVWKTEDDMQMRETN

SEQ ID NO: 71874 - protein, 885 aa, Oceanobacillus iheyensis HTE831
MRKTINIFFLIVLICGLILPSTQVHADNTGYEPENPGIKDEQTDEGNLGMVVTAHPLASEVGSEVLKQGGNAVDAAVATQLALNVVEPMMSGIGGGGFLMHYDAASEDISIVNSRERAPQGATPDMFIDKSNIVTDPGKFLFGAIDLNGDSGGAKFHVDDIQILDLQSSEVVFEEDFEGGEGSWDADQFNIYERGTTFSETSGLGEILFGPPYGNNSSSFGQTTAIMDEIEDSELSLRFRTDDPGEDRRLRLWLRADEYRSTGTTYVKNGYGIEINTNTNEVRILQSKDSTTSTLGSFSLSGTTDWQNLRFQVEENQLRVKLWEDNASEPDDWNIDTFAGEVIPFSERVQSGLSVGVPGTLKGLEDALAQQGTMELAELIQPAIDLAADGFPVNWALADAIESNQDKLSKTAAKDVFLPNGTPLKEGDLLVQEDLAKSFRLIQEQGTEAFYHGEIGEALAEEVSDRGSSMELSDLSNYQTTSETPVWGDYMRYDIASMPPPSSGGITMLQLLEMFEQLELTQFDIRSMEKYHYMAESMHLAYADRGAYMGDPEFIDVPSEGLLHPDYVAERIELISPDRANDQVEPGNPYEYQDGQPSSIIDQPDDKVDGQTTHFTIADRWGNLVSYTTTIEQVFGSGIMVPEYGIMLNNELTDFDAIPGGANEVQPNKRPLSSMTPTIVLDEGKPYMTVGSPGGATIITSVTQTIVNTIGYEMDIKDAIEEPRIYSSSYPSIRWEYGIGESVRERMEQLGHRFETSPREIGNVNSIVLDQESGMYFGAADSTREGKAIGLTLDDFPGISELIDLVESNVERGEISSDAGKTLLTHLSAVQHYEKTNQMNKAIKHLENMELLVNHFYDNGKISEDVYHRLLRETYLILDLWEIDA

SEQ ID NO: 71875 - protein, 423 aa, Streptomyces sp. NRRL 5331
MGLVVQKYGGSSVADAEGIKRVAKRVVDAKRNGNQVVVVVSAMGDTTDELIDLAEQVSPIPAGREFDMLLTAGERISMALLAMAIKNLGHEAQSFTGSQAGVITDSVHNKARIIDVTPGRIRTSIDEGNIAIVAGFQGVSQEGKNITTLGRGGSDTTAVALAAALDAEVCEIYTDVDGVFTADPRVVKKAKKIDWISFEDMLELAASGSKVLLHRCVEYARRYNIPIHVRSSFSGLRGTWVSNEPQGDQKVEHAIISGVAHDVSEAKVTVVGVPDKPGEAAAIFRAIANAEVNIDMVVQNVSAASTGLTDISFTLPKAEGRKAIDALERAKGSIGFESLRYDDQIAKISLVGAGMKTNPGVTAGFFEALSDAGVNIELISTSEIRISVVTRADDVNEAVRAVHTAFGLDSDSDEAVVYGGTGR

SEQ ID NO: 71876 - protein, 350 aa, Shigella flexneri 2a str. 2457T
MSSAKKIGLFACTGVVAGNMMGSGIALLPANLASIGGIAIWGWIISIIGAMSLAYVYARLATKNPQQGGPIAYAGEISPAFGFQTGVLYYHANWIGNLAIGITAVSYLSTFFPVLNDPVPAGIACIAIVWVFTFVNMLGGTWVSRLTTIGLVLVLIPVVMTAIVGWHWFDAATYAANWNTADTTDGHAIIKSILLCLWAFVGVESAAVSTGMVKNPKRTVPLATMLGTGLAGIVYIAATQVLSGMYPSSVMAASGAPFAISASTILGNWAAPLVSAFTAFACLTSLGSWMMLVGQAGVRAANDGNFPKVYGEVDSNGIPKKGLLLAAVKMTALMILITLMNSAGGKASDL

SEQ ID NO: 71877 - protein, 122 aa, Glycine max
QLLPESSPLSKQEDLIVWMRTAALPTFRKLYGKIEVDLNAGDQINVTLQNNYNTYSFNGKKKLVLSTTSWLGGKNDFLGIAYLTVGGLCFFLALAFTVVYFVKPRQLGDPSYLSWNRNPGGH

SEQ ID NO: 71878 - protein, 459 aa, Rickettsia akari str. Hartford
MEQYDVAVIGGGPSGYVAAIRAAQLRKKVVLIEKEHLGGVCLNWGCIPTKSLLKSAEVFEYTKHAKDYGIDSEGAEINIKKIVERSREISNKLAGGVKLLLKKNKVTVIDGVASLAGNKVVNINNKSTVKAENIIIATGARSRVLKGFEPDSKQIWTSKEAMIPRHVPKSMIIVGSGAIGIEFASFYNSIGVDVTVIEAHNRILPAEDTEISGIAHKNFEKKGIKIITNAKLIKQTKSKDKIEVELELSSKTQKLQAEILLMAVGITANTESLGLEKTKVKVENGYIVTNGLMQTAELGIYAIGDVAGVPCLAHKASHEGIIAAESIAGLKPYAINKHNIPGCTYSSPQIASVGLTEEAAKALGYELKIGKFPFMANGKALVIGDSDGLIKTIFDAKTGELLGAHMIGLEVTELIQGYVVSKNLEATELDLINTIFPHPTLSEMMHESVLAAYDRVVHV

SEQ ID NO: 71879 - protein, 750 aa, Candidatus Kuenenia stuttgartiensis
MINFQMHTIKLKRASVILLIFLFYFYGIWLPQVKAEKVSITKDSEQVPANNKKETLETQSAPIEQCEIQSPALDEKPFQAIVVEKTPPSGTVTAEGETLKENTSIREDGQEIATEEEIYDVTSPIILSNPSPDGEVSSIEEEKGDQTSVVDNEQQENTPDEGKASSHEEEKSPISHQVNTDEGEFQDIKEMGVSSYLPEPSPATAREEGPFPEFDVANNESSEETSPTNEDKEDIVIDKDMLSDVKEEETLSIAPTSTPSTPSPGEEMVLVKEEKGTQSSVVPDEESISLLQEEKLPIEYQSVRNEEISLQKPVGDIAESEGSGHVWEIWHKDPTHAVILAIAIILIAAKIAEWLARRLRLPGVVGKLIIGMILGNVITFTGWDFFDFLRTMPFVKMISYFGTLILLFTAGLNTDLRALLRVGTSSLLVCLGGIIAPAGLGLMVGHFLLPDISSGTKLLLAIVLCNSSTGLLLAVLSELKAINTLEGRVIAGATILTDIIVILTFGVVSGFVVKGGGSLVGMSLSFGIAITSLIISLIVIVKYGDKFGNFLTKRLTEGLNIPIVVILSLLLAFMFGSVGLHTVIGAFVAGLFLRNVKLWNSDDGEHRNVESFIRPFYMLLVPILFVRVGAQVELGSFFNLNALLLGLAITGAAVIGKMFCSVCPIEKGINRLAIGIGMATKMEGTLILAGLGRDMGTLSDTVFSSVIMAIVFTSIICPSLLRNILLKKGCSPEILPVTKRKKELEGAVLN

SEQ ID NO: 71880 - protein, 572 aa, Mesorhizobium sp. BNC1
MTADIITVPPKPAPSFSELFTPKLVTVLREGYSLASFRADAVAGLTVAIVALPLSMAIAIASGATPAQGLYTAIVGGFLVSALGGSRFQIGGPAGAFIVLVAATVQAHGMDGLILAVILSGLMLMAVGFLRLGTYVKFIPYPVTVGFTAGIAVIIFASQIRDILGLRLGGAEPGPLIEKLPVLWSGLPTANPATVFLAGATIALIIGFKRLQPRLPGMLIAVAVTGLATVGLGLPVATIGTAFGGIPSGLPIPALPAFDLEKVQTVLPSAVAFALLGSIESLLSAVVADGMTGRRHRSNCELVAQGVANVASGLFGGICVTGTIARTATNVRAGAHGPVAGMLHAVFLLLFVLAAAPLARYIPLASLAGVLAVVAWNMVEKHAVLTLLRASRGDAAVLIVTFALTIFRDLTEAIVVGFALGSILFIHRMSRMTAIEMRLPFVVEDRADEADGGRAPYDEAAGSDPDVVIYRISGAFFFGAAASIGSVLDRIADSYRALVIDFSAVPFLDSTAANTIEGLAHKAVRRDVKVYLTGTSHEMRKDLFAQGVKPPLVHYAGSIEDAVKKARGKHGG

SEQ ID NO: 71881 - protein, 539 aa, marine gamma proteobacterium HTCC2143
MTNRKDLTSWKQLESLALQKPLQLEGLFQADDQRFQNFSINACGVLFDYSKQLLSNEVREKLLSLAEECDVASWREAMFSGEVINKTENRAVLHTALRSSFAGDDASQQEVSAELEHVRVFSEAIRSGEKKGWTGQVFTDVVCIGVGGSNLGPQMVTDALSGVDSGSLRLHYISSVDAVPLVNLLASLNAERTLFVISSKTFTTSETVLNANTARRWFLQCASEEAVDVHFVAVTDSIAKAGTFGIAEENCFKMWDWVGGRFSLWSAIGLPIALYAGFDVFRELLDGASAMDQHFLDAPLSENMPVMMALVGVWNATFLNMDTLAVLPYDQNLHKLPAYLQQAEMESNGKSVNWNGEAVEYPTCPIVWGQTGINGQHAFYQLLHQGTHRVPADFIGSVHSHSDAAEHHETLLANFFAQPRALMNGVSLNEVERDLAIKGLDPLQVSELARHKVHSGNRPSSSILIDRLDAFHLGALIALYEHKIFTQGILWQVYSFDQWGVELGKVLASNVLTSVLSDAEVSDYDDSTNGLINYYKAHR

SEQ ID NO: 71882 - protein, 408 aa, Nostoc sp. PCC 7120
MDLLEYQVKEWFGEIGIPVLPSQRIDHPTDLKRLKIRYPIVLKSQVHAGEREKVGGVRMVETTIDAIAAAQTIFNLSIWGELPEVLLAESKYNSHQEFYLAVVLDTAVCRPVLLGSTEADIDLELADQKMQYVVVEQEFSPFYARRLALKMGLQGTLMQSVSTVLEKMYQLFVQKDLDLVEINPLGVNLAGEVMALNGKVGVNERAIGRHPEIAAMAAKIVPRHYDKSFSNGRDWNNLEKQRRISILGNGTGSILATYDLVASGGGKPGICLNLRHAAITDLSPTKFGDRLTKGLNTLSADKNTQVILINLLGSIPQPEEAAQAIAQFIQQNKGEYPPSIAKSNGKNLSQHQSPQLVIRLAGSELNVAKEVLAALQTREEGLILVEDLDEAVATAVRLTKSHAYKKVS

SEQ ID NO: 71883 - protein, 590 aa, Candida albicans SC5314
MGQILSQPVVEKHSDEHKDKYLAYGISCMQGWRINMEDAHATILNLYDLPLKKSLSSNSEQDEDEEDEEEEADSQDSTTTNTTKSQQQQNQKEDLQQNNDKQNSQQDIKDGDNDTQMSDSDENHHHAAPQQQHIAFFGVYDGHGGEKAAIFTGEKLHHLIKETKEFKQKDYINALKQGFLNCDQEILKDFYMRDDDSGCAATSAIITPDLIVCGNAGDSRTIMSTNGFAKALSFDHKPSNEGEKARICAAGGYVDMGRVNGNLALSRGIGDFDFKKNVDLPAEEQIVTCYPDVIQHNIDYKSDEFVVLACDGIWDCLTSQKCVECVRRGIYERKSLSIICEEIMDLCCAPTSDGSGIGCDNMSIAIVALLDYTKNETLDQWYEKIISRVEQQQQQKNDPNSLNKYGPISQPYNELYKEMYGEYYDIGQQGQGGNGRSNIGSGNGSGRGSGASGSSSGGGASINGNSIFGRSGYDDEDDDDDEEKNIERRRRDQDESNLNGGAISLQKLLASNAITNENGVIYLDTSSAQSLLAHFGVADAGAHGDEEDEEEEGEGEDVHQGLAHEEEEEEEEEKEGSKIEEISEKIDDEV

SEQ ID NO: 71884 - protein, 415 aa, Sulfolobus tokodaii str. 7
MIKVADLNIPVIEDFDINGRKVLLRIDINSPVDRKTGKLLDDSRIKAHAETIRELLDKQNSVVIISHQGRPGDDDFISLEEHSKILSKYVGREIEFVDDVIGPYAREKISKLGKGEAILLENVRIVSEELIEAPPQQQSKTFLVRKLAPLVDFYINDAFATAHRSQPSLVGFPLVKPSAAGRIMEKEVSALSKIFNKEDSPKIFVLGGSKVSDTLKIIEHLAKNRVADRILTGGLVAELFAVAKGINLGKPNMQVLENKGLLSLIPRARKILLSGAPIEIPVDFTVEKPSGELSNDPENNVSGIIKDIGNTTIEIYSSFIKEGKVITLRGPMGVIEDERFRIGTKSLLKASIESPGYVIIGGGHMISMLDKDVEINPNKIHVSTGGGALLLFLAGDKLPALEALHMSWVMQSGKS

SEQ ID NO: 71885 - protein, 249 aa, Zea mays
  misc_feature (70)..(70): Xaa can be any naturally occurring amino acid
VDPRVRTQTDMSKTMRAILIDWLVEVTEEYRLVPETLYLTVNYIDRYLSVKEISRHRLQLVGVACLLIAXYEEICPPLVEELCYITDYSYTKEEVLQMEASVLNNLKFEMTVTTAKCFLRRFVRVAQVPDKGSSLHLEFLVNYICELSLLEYSLLCYLPSMVAASSVFLAKFILMPIKNPWNSSLSYYTRYTPSELRGCVRVLHRLFRLGPGSNLPAIREKYSQHKYKFVAKKYCPQSIPTKFFQDLTS

SEQ ID NO: 71886 - protein, 383 aa, Nostoc sp. PCC 7120
MRLNLIPLFCFGLCGVMVLISPPQVNANTPLTRAEIQSIRNFVQLIQRASRNKRPAQKSDAIIPGDGLSTGRASLADLRFNDGSLARVGEQAVFQFMPRTRNFRLSNGTVLLLIPPGRGQTRIQTPSATAAIRGSALFIRYDQKTDTTIIGALTNSGIAVSNKDASQTQPLKAGQLLVLVKGKIQSLYDFDLQNFYETSDLTEGLDLTGKNSSATLDPAMIAVREEIKAALAAQSPVAGQGVMENPAFLELSTTSSEVIDEDNDEDDFITNDFPINSLVDIGEFLFQNGQQLGNDGDINDINNNINNVQPDPPPPSDPPPPPDPPPPPDPPPPDPPPPDPPPPPDPPPPPDPPPPPPPDPPPPPDPPPPDRPPPPPPEPPPPP

SEQ ID NO: 71887 - protein, 95 aa, Triticum aestivum
RHSQSEADTKRAKQQYAQRSRVRKLQYIAELEKRVQALQTQGIEVSAEMDFLGQQNIMLDLENKSLKQRLESLSQEHVIKRVQQEMFEREIGRLR

SEQ ID NO: 71888 - protein, 292 aa, Oryza sativa
  misc_feature (105)..(105): Xaa can be any naturally occurring amino acid
  misc_feature (118)..(118): Xaa can be any naturally occurring amino acid
  misc_feature (129)..(129): Xaa can be any naturally occurring amino acid
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSXGGHINPVRVTALXPSSLDAGQVSXLVRALLYIAAQCLGAICGVALVQGFQSSLYDRYGGGANELAAGYSTGTGLAAEIIGTFVLVYTVFSATDPKRNARDSHVPVLAPLPIGFAVFMVRLATIPITGTGINPARSLGAAVIYNNNKAWGDQWIFWVGPFIGAAIAALYHQIILRASARGYGSFRSNA

SEQ ID NO: 71889 - protein, 496 aa, Coccidioides immitis RS
MKAPKSKTKAPKADDKVLSKVKNGGVTKPSTTPKAKSKEIAKKVASKAEKKLEKKKKAPTPSESSESDSDEEMKSVSSSSESESESESEVNVPKAAADSESESASGSESESESSESSSEEDEKPVQKSGMAKVAESESESESESEEESESEEEQKVAKKNVKASSSESESDSASQSESESESESEEAPAKAKKATKEESASEESEEESEEESGSEEESSEESSSEEAEEPAKTQKRKAESDETPVAKKVKKETADEASAESSNLFVGNLSWNVDEEWLRSEFESFGELSGVRIVTDRDSGRSRGFGYVEFTNAEDASKAFKAKKDAEIDGRTINLDFANARQNAGGARDRAQSRAKSFGDQTSPESDTLFIGNISFNADENAVQETFSSHGSILGIRLPTDPESGRPKGFGYVQFSSVDEARSAFNALQGTELAGRAMRLDFSTPRQNSGGSFGGRGGRGGRGGGRGGARGGGRGGRGGFASRGGFGDFSGKKTTF

SEQ ID NO: 71890 - protein, 360 aa, Mycobacterium sp. MCS
MSTPVNAVHRRWPGLIEAYRDRLPVGDDWTPVTLLEGGTPLIHAKRLSEFTGCTVHLKVEGLNPTGSFKDRGMTVAVTESAASGKQAVLCASTGNTSASAAAYAARAGITCAVLIPQGKIAMGKLAQAVMHGAKIIQIDGNFDDCLELARKLTADFPTVALVNSVNPYRIEGQKTAAFEIVDVLGTAPDIHALPVGNAGNITAYWKGYSEYHRDGLSDRLPRMLGTQAAGAAPLVTGEPVKNPETIATAIRIGAPASWASAVEAQQQSDGRFLAATDEEILAAYHLVARTEGVFVEPASAASIAGLLKSVEDGWVAKGSTVVCTVTGNGLKDPDTALKGMPTVTPLAVDPVAVAAELGLV

SEQ ID NO: 71891 - protein, 315 aa, Raphanus sativus
MASNIAILVIVITLLLQGGEAQLTTNFYSTSCPNLLSTVKSGVKSAVSSQPRMGASILRLFFHDCFVNGCDGSILLDDTSFTGEQNAGPNRNSARGFNVIDNIKSAVEKACPGVVSCADILAIAARDSVVQLGGPNWNVKVGRRDAKTASQAAANSNIPAPSMSLSQLISSFRAVGLSTRDMVALSGAHTIGQSRCTNFRTRIYNETNINAAFATLRQKSCPRAAFRRRKPQPLDINSPTSFDNSYFKNLMAQRGLLHSDQVLFNGGSTDSIVRGYSNSPSSFNSDFAAAMIKMGDISPLTGSSGEIRKVCGRTN

SEQ ID NO: 71892 - protein, 287 aa, Mesembryanthemum crystallinum
MTKDVEVAEQQAPEFSAKDYHDPPPAPLIDFEELRKWSFYRAVIAEFIATLLFLYITVLTVIGYKSQTDPNTNADQCGGVGILGIAWAFGGMIFILVYCTAGISGGHINPAVTFGLFLARKVSLIKAVLYMVAQCLGAICGVGFVKAFQKAYYVRYGGGANEMASGYTKGTGLGAEIIGTFVLVYTVFAATDPKRNARDSHVPVLAPLPIGFAVFMVHLATIPITGTGINPARSFGAAVIYNQQKAWDDHWIFWVGPFIGAAIAAFYHQYILRAAAIKALGSFRSSA

SEQ ID NO: 71893 - protein, 296 aa, Arabidopsis thaliana
MLRSGLASLIVDVNLRRTLRPSPTFSFPAHLSRCIITSRYSSRTSLRFPIQISRHQHRLSYFSSSSSSEQSRPTSSSRNSFSGHGQLDSDDNSSPPPSQSSSKVLTLPTVLTLGRVAAVPLLVATFYVDSWWGTTATTSIFIAAAITDWLDGYLARKMRLGSAFGAFLDPVADKLMVAATLILLCTKPIQVAELGPLPWLLTVPSIAIIGREITMSAVREWAASQNGKLLEAVAVNNLGKWKTATQMTALTILLASRDSNVGWLVASGAGLLYVSVGLSVWSLAVYMRKIWKVLMK

SEQ ID NO: 71894 - protein, 194 aa, Xylella fastidiosa Temecula1
MLLMLDNYDSFTYNLVQYLQTLGAEVMVIRNDAMTVEQIAALKPERIVISPGPCTPNEAGVSLKLIEQLGSSTPILGICLGHQSIGQAYGGDVIRATNIMHGKTSAIYHNGKGVFVGLPNGYDATRYHSLVVDKTTLPDVLEVTAWTENQDGTIEEIMGLRHREYFVEGVQFHPESILTAHGHALLKNFLEHPL

SEQ ID NO: 71895 - protein, 434 aa, Oryza sativa
MKNTSSLCLLLLVVLCSLTCNSGQAQVLFQGFNWESWKQQGGWYNMLKGQVDDIAKAGVTHVWLPPPSHSVARGYMPGRLYDLDASKYGTAAELKSLIAAFHGKGVQCVADVVINHRCAEKKDARGVYCVFEGGTRDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAPGMIGWLPEKAVTFVDNHDTGSTQKLWPFPSDKVMQGYAYILTHPGVPCIFYDHMFDWNLKQEITALAAIRERNGINAGSKLRIVVADADAYVAVVDEKVMVKIGTRYDVGNAVPSDFHQTVHGKDYSVWEKGSLRVPAGRHL

SEQ ID NO: 71896 - protein, 370 aa, Oryza sativa
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTLIFGNYKPRTDLPNVVELYMKKELELEKFITSVPFSEINTAFDLMLKGRVSAAS

SEQ ID NO: 71897 - protein, 1030 aa, Candidatus Kuenenia stuttgartiensis
MSSYKSSLVFLIVFISLYCTDMLGAPVLEAKHLEPSNDSQPIHADTQKERVSLAVEENGTQTIAGDNQPIQTPVIEHPSPTTVDMRDVGIQTPNSNSDVITTEKEEPYTSEHAENKYSQKIAHTNKDDRPIVHAEEALSDTTGRDNIVATPTPIPSVTPTGYGQSLVEEEKEIHTPSPEGELSQAIPIARRDPHATEEHPGEESSIKEVPPQHAITTESRSDTDILAKEALSDTTAQDNTIATPMPILPVTPTGHEQSLIEEEREIHTPSPEGELSQAIPIENETPHGTEEHPEEESSIKEVPPQHAITTGSRSDTDILAKEALSDTTAQDNTLVTPMPILPVTPTVHGQSLIEEEREIHTPSPEGELSQAIPIENETPHGTEEHPEEESSIKEVPPQHAITTGSRSDTDILAKEALSDTTAQDNTLVTPMPILPVTPTVHGQSLIEEEREIHTPSPEGELSQAIPIENETPHGTEEHTRDESSIGEVPPQHSILTENHRDTEEKSVLSDTPAPAPTPTYSAASVDVEESLITGEKEEPSPYGGSKSSPNASVERLPSTPLEGFLQGKEDRDTEPPRKDAGESTTVIASGERRIAAVKKGKDSGNGWEIWHKDPTHAVILAVAIILIAAKIAEWLARRLRLPAVVGKLIVGMILGNVITFTGWDFFDFLRTMPFVKMISYFGTLILLFTAGLNTDLRALLRVGTSSLLVCLGGIIAPAGLGLMVGHFLLPDISSGTKLLLAIVLCNSSTGLLLAVLSELKAINTLEGRVMAGATILTDIIVILTFGIVSGFVVKGGGSLVGMSLSFGVAITSLIISLIVIVKYGDKFGNFLTKRLTEGLNIPIVVILSLLLVFMFGSVGLHTVIGAFVAGLFLRNVKLRNSDDKEHRNVESFIRPFYMLLVPILFVRVGAQVELGSFFNLNALLLGLAITGAAVIGKMFCSVCPIEKGINRLAIGIGMATKMEGTLILAGLGRDMGMLSDTVFSSVIMAIVFTSIICPSLLRNILLKKGCSPEILPVTKRKKELEGAVLN

SEQ ID NO: 71898 - protein, 483 aa, Oryza sativa
MNVLASKIFPSRSNVVSEQQQSKREKATIDDAKNSSKNKNLDRSVDESVLGIILGGGAGTRLYPLTKKRAKPAVPLGANYRLIDIPVSNCLNSNISKIYVLTQFNSASPNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLLAEQLYEVAA

SEQ ID NO: 71899 - protein, 575 aa, Rickettsia akari str. Hartford
MNDHILINVIILLGTAVFIVAILKRLRLSPVLGYLIAGAAIGDHGLKIVTYDQTKLLGELGVVFLLFAIGLELSFERLKAMRRYVFGLGSLQVVTTAIVIAGAMVLIDGNSSAAIITGGGLALSSTALVMQVIEENRSQSTQIGRISLAILLLQDLAVVPLLVIVPLLAGNNKASLAGALGIALLKAVTALLTIFIVGRVFLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALIGIKTLIITAFCLLFGFNKGVAFYSGLLLSQGGEFGFILFSLGKDSGVLEESTADILLLVVTFTMALTPLLAALGKKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIPVVVKLKNLKNAREFYDLGATTIIPESYEAGLQIGGTVLKNIGISEQEINRIKVQFRLGNYIIAKKEDALSEVEDND

SEQ ID NO: 71900 - protein, 302 aa, Burkholderia mallei ATCC 23344
MRNFSGKVAAITGAGSGMGRSLAVELARRGCHLALGDVNERGLAQTAAICAAHGVKITSQRLDVASRDAVFDWARRTRDAHGKVNLVFNNAGVSLAAPAETARIEDFEWIMGINFWGVVHGTQAFLPYLRESGDGHVINTSSLFGLVAMPTQSAYNATKFAVRGFTEALRMELELEGAPVSVTCVHPGGVATNIATASRIDSSIAGLTGQDIETHRRAANRLINVTTPEAAARQIIAGVERNARRVLVGADARRIDKLARLFGSAYQVFVLRFVRKSRERNLARQPAAARPTPPSSISKDPA

SEQ ID NO: 71901 - protein, 278 aa, marine gamma proteobacterium HTCC2143
MRLANKFALVTGGASGLGAAAVERFIAEGCAVCICDIQDEAGEKFAATFADKAFYRHCNVTVEDHVSDAVDAAVERFGQLDIVFHSAGIVGAVGPIATTPGDEWRFSIDVLLNGTFYALKHAARVMAPQGSGSIISMASTAGLMGGLGPHAYAAAKHAVVGLTKNVGVELASKGVRVNAIAAASMATPMVASVLTGDPTDLAGARATLAAVSPLHGRAGLPEDVANAALYLASDESGYTTGHTLTVDAGFTVGATFEGPAFAEYAPIVREAGKSGLDD

SEQ ID NO: 71902 - protein, 373 aa, Francisella tularensis subsp. holarctica
MALHGKKDTIDNLDFFEQSLPKFKLPLNSQDPLEVYQEIKDELMLDGNSKQNLETFCQTEVDDFIHKLMDDCIDKNMIDKDEYPQTAEIESRCVNILANLWNSSAENAIGCSTTGSSEAAMLGGMAMKWRWRDKMKAQGKDYTKPNLVTGPVQVCWHKFARYWDIELREIPMSNESLIMTPEAVLERCDENTIGVVPTLGVTFTGQYEPVEQVCKALDDFERQTGVDIPVHVDAASGGFLAPFVEPELKWDFRLPISPLGVGWVIWADKKYLPDDLIFNVNYLGGNMPTFALNFSRPGGQIVAQYYNFVRLGFEGYKKVHQLCYDIAEYIAKELRKMEIFEIIHAGEGGIPAVSWSLKATKEYSLFDISESSR

SEQ ID NO: 71903 - protein, 92 aa, Picea sitchensis
MARECKVSLKSSDDELFDVNEAVAFESQTIKNMIEDTGTASAIPLPNVSSKILSKVIEYCKYHVEAQKPADEKSAISEDEIKTWDQEFVKVD

SEQ ID NO: 71904 - protein, 356 aa, Neisseria meningitidis FAM18
MTKHIAILRGDGIGPEIVAETVRVLDKLIAQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKQYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENAVQKVLQQGLRTSDIYEEGTKLVSCSEMGDAVLAAL

SEQ ID NO: 71905 - protein, 160 aa, Picea sitchensis
MSSTSTPNRGLTKIATNRLQKELLEWQVNPPAGFKHKVTDNLQRWIIEVTGAPGTLYANETYQLQVDFPEHYPMEAPQVIFLPPSPLHAHIYSNGHICLDILYDSWSPAMTVSSICMSILSMLSSSTVKQRPPDNDRYVKNCRNGRSPKDTRWWFHDDKV

SEQ ID NO: 71906 - protein, 403 aa, Streptomyces coelicolor A3(2)
MQVIQSTKLANVCYEIRGPVLEEAMRLEAAGHRILKLNTGNPAAFGFECPPEILEDILRNVSTAHGYGDAKGLLAARRAVVMHNQTLGIETDVEHVFIGNGVSELIVMAMQGLLDDGDEVLVPAPDYPLWTAAVSLSGGTAVHYRCDEQSDWMPDLADVERKITDRTKALVIINPNNPTGAVYDDAMLRGLTDIARRHNLLVCSDEIYDKILYDDATHTPTAAIAPDLLTLTFNGMSKAYRVAGYRVGWMSISGPRAHAESYIEGLTILANMRLCANMPGQHGVVAALSGRQTINELVLPGGRLREQRDAAHEALTSIPGVTCVKPKGALYLFPRLDPKVFKIKDDRRMVLDLLRQEKIMVVQGTGFNWPEPDHFRVVTLPTAADLREAVDRIGNFLDGYSQP

SEQ ID NO: 71907 - protein, 205 aa, Idiomarina baltica OS145
MSNDIQDPMAQLVPMVVEQTSKGERSYDIYSRLLKERVIFCCGQVEDHMANLIVAQLLFLESDNPDKDIYLYINSPGGVVTAGMAIYDTMRFIKPDVSTVCMGQAASMGAFLLAGGAQGKRYCLPNSRVMIHQPLGGFQGQASDFEIHAKQILDLKERLNRMLAENTGQDYEKVARDTDRDHFLTAPEAVDYGLVDGILNKRGEE

SEQ ID NO: 71908 - protein, 284 aa, Mesembryanthemum crystallinum
MSKEVNEEAQGLGHQHGKDYVDPPPAPLFDMGELKLWSFYRALIAEFIATLLFLYVTIATVVGNNKADTGVCGGVGLLGIAWSFGGMIFILVYCTAGISGGHINPAVTFGLFLARKVSLIRAVSYMIAQCLGAICGVGLVKAFMKGYYNSVGGGANSVAHGYSKGTALGAEIIGTFVLVYTVFSATDPKRSARDSHVPVLAPLPIGFAVFMVHLATIPITGTGINPARSFGAAVIFNSKKNWDDHWIFWVGPMVGALAAAAYHQYILRAAAIKALGSFRSNPTN

SEQ ID NO: 71909 - protein, 313 aa, Zea mays
MDAGRGSSATIFPVPQVPALALLFPPPPPAAAALPSSSLSLSSSSSSRHAPSITSFPILVLTVLGILAACVLILAYYVFVIRCCLTWHRDRSASDAVSRRPQRARARVRTSTGGTPASSAEPRGLEDAVIRALPAFSYRKKPADLPPSAPAPASECAVCLGEFEEGDSVRMLPACLHVFHVGCVDAWLQGNASCPLCRARADVDAASCCRLLPPPPPEEEEDVAAIQVVVVVPGAEEDDRQGTVPQRQRETTVAPAAAAEVEGEDPPQVGGEKERRKDGDVAPRTRSFSTDGDGGEEAIEGSVDRDFSGSSGD

SEQ ID NO: 71910 - protein, 265 aa, Bacillus subtilis subsp. natto
MTNWTEIDEIAKKWIREAGARIKQSMHESLTIETKSNPNDLVTNIDKETEKFFIDRIQETFPGHRILGEEGQGDKIHSLEGVVWIIDPIDGTMNFVHQQRNFAISIGIFENGEGKIGLIYDVVHDELYHAFSGRGAYMNETKLAPLKETVIEEAILAINATWVTENRRIDQSVLAPLVKRVRGTRSYGSAALELANVAAGRIDAYITMRLAPWDYAAGCVLLNEVGGIYTTIEGEPFTFLENHSVLAGNPSIHKTIFEEYLHAGK

SEQ ID NO: 71911 - protein, 366 aa, Gluconobacter oxydans 621H
MRRPILSALLAACTVLAPLAAANAAPASSPAPNYVVLDNDFLGPGGSNIQSIIPLLNRPGVTLLGLTSVIGDDWENAGTAHALRFLEIARQTQIPVADGATTPLVNTVAETKLREQQFGVIPWKGAWGGLGSIEHVPATQPPVGKLPEGAPHIAADPLPAAMFLIREVHAHPHQVTVIAAGPLTNLALAIRIDPTFAATAKQLVFMGGLLDASMMSVTGNADFASDFNMIMDPEAARITLTAPWASITCVGNVSNDIMMTPELADRIDEKHNAVTDYLKKYQAPLPLWDELTSAIAVDPTLVTKSVTAVMDINIEHGMDYGHAHIWPDSTAPKAMGLRKVKIVQSIDKTRFINDFVSQSQNALGTH

SEQ ID NO: 71912 - protein, 483 aa, Oryza sativa
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLVAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLLAEQLYEVAA

SEQ ID NO: 71913 - protein, 462 aa, Magnaporthe grisea 70-15
MAAATKTAPAFRAAGALASNARPAAKQLRFVSSSQQQQFAHGSKGRKMPAQRSRATAPVAGLDATFTIRDGPVFHGTAYGANSNISGEAVFTTSLVGYPESMTDPSYRGQILVFTQPLIGNYGVPSKERDEYNLLKYFESPHIQCAGVVVSDIAEKYSHWTAVEGLNEWCAREGVPIISGVDTRAIVTHLREQGSSLARITIGQEYDADEDESFVDPGLINLVKRVSTKAPFVVESPDPTFHIGLIDCGVKENILRSLVSRGASVTVFPYDYPIHKVASNFDGVFISNGPGDPTHCQETIYNLRRLMETSPVPIMGICLGHQLLALAVGARTLKLKYGNRAHNIPALDLTTGQCHITSQNHGYAVDTSTLPSEFIEYFVNLNDGSNEGMMHKTRPIFSTQFHPEAKGGPMDSSFLFDKYLANVKMFKNSEKVFRDNRPSQLLLDILSKERVGVEPTPLASTA

SEQ ID NO: 71914 - protein, 231 aa, Gluconobacter oxydans 621H
MSDLIAQNLISGNLAAIRHRIAQACEKAGRAEADVSLVAVSKFHPIESVEAALNAGQHLFGENRVQEAASKFPELRQRWPDLRLHIIGGLQTNKAAEACQIADMIESLDRPSLSDSIEKGAQKAGRLPELLVQVNTGDEPQKSGVPREEADAFIEASLERFGPKIRGLMCIPPEGEDPTPHFRLLRQMGHRHGLPVLSMGMSADFEKAIAENATLVRVGTAIFGSRPAPQS

SEQ ID NO: 71915 - protein, 173 aa, Glycine max
MQQAIPYRSWQPLITPTNANTTHFTISPHTLVTFSTVSTTELSLKDDIGSEPNNNIHNSDNPFFVSSKMVPNMVLESAIIVFARRGCCMSHVVKRLLLGLGVNPAVHEVEESDEVGVVRELEAIVGANNGGNKMQFPAVFIGGKLFGGLDKVMATHISGELVPILKEAGALWL

SEQ ID NO: 71916 - protein, 447 aa, Oryza sativa
MAAAAAACVESPDEGVEIREVWAGNLEAEIAAIRDEVDRYPYVAMDTEFPGIVCRPVGNFRTTDEFNYANLEANVNMLKLIQLGLTLSDEGGDLPRRGTGGRRCIWQFNFRGFDPRTDPSNADSIQMLRTCGIDFDRFAAEGADPIRFAELLMSSGVVLNADVQWITFHSGYDFGYLLRLLTGRNLPDNMPAFFDLIRIYFPVLYDIKHLMRFCSNLHGGLSRLGELLDVKRVGTCHQAGSDSLLTLGCYNKIKEEVPPLSCLHPPWAQSRRLLEHRPEGSEVNERLHVSVIVLAVTVAWVPADMVQSDVIFCQRWHFLETSHAGARWETPNVGWIWAAQRRGEGLHWGVVKGDVGEALRRERRALRRLRRSHGGARHAAVRHKRSGEAHAQRRDARTAARLKHGTVHRYATELKHVTDAKVQMEANVARHKEQMEAMGKQKDAGKC

SEQ ID NO: 71917 - protein, 385 aa, Thermus thermophilus
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 71918 - protein, 355 aa, Aspergillus oryzae
MSSFNAHNVDLDTASQADILCYLALSENDYNGHLGARISSIFVIFITSTFFTVFPVIAKRAPGLKIPYHVYLFARYFGTGVIVATAFIHLLDPAYSSIGPNSCIGVSGHWGDYSWCAAIVLVSVVTIFLLDLGAEVYVEYKYGVQRNDDATEAFITHSCASDSDSTSHAVESGTPIRKSTDIHTEVAWVRSERAFRQEIAAFLILEFGIIFHSVIIGLNLGVTGEEFTTLYPVLVFHQAFEGLGIGARMSALHFGSRRWLPWVLCLLYGLTTPISIAIGLGVRTSYNPGSKTAMIVQGVLDAISAGVLIYSGLVELLARDFLFDPDRTKRRSHLFVMVGCMLLGAGIMALLGKWA

SEQ ID NO: 71919 - protein, 443 aa, Oryza sativa Japonica Group
MATGRRLSMILLLLLLGLASGDKILFQGFNWESWRQSGGWYNLLMGKVDDIVAAGVTHVWLPPPSHSVSTQGYMPGRLYDLDASRYGTSMELKSLISALHGKGIQAIADVVINHRCADYKDSRGIYCIFEGGTPDGRLDWGPHMICRDDTQFSDGTGNLDTGADFAAAPDIDHLNGVVQRELTDWLLWLKSDEVGFDAWRLDFARGYSPEVAKVYIEGTTPVGLAVAELWDSMAYGGDGKPEYNQDAHRQALVDWVDRVGGTASAGMVFDFTTKGIMNTAVEGELWRLIDQQGKAPGVIGWWPAKAVTFVDNHDTGSTQQMWPFPSDKVMQGYAYILTHPGNPCIFYDHFFDWGLKEQIAALVAVRQRNGVTATSSLKIMLHDADAYVAEIDGKVVMKIGSRYDVSSLIPPGFHLAAHGNGYAVWEKSAAAAADHRTSSSASL

SEQ ID NO: 71920 - protein, 502 aa, Xylella fastidiosa Temecula1
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVTANPERAANAFDIVPTQVLPIWDWVGGRYSLWSAVGFPIALAIGSQRFEELLAGAAEFDAYALRVPLEENVAVLHGLTAVWNRNFLGCATYAVMAYDQRLALLPTYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 71921 - protein, 648 aa, Robiginitalea biformata HTCC2501
MINVHKLTVSFAGEDLFSEVSFRLGAGDRVGLIGKNGAGKSTLLRLLSGETQPTSGTIAREKGLRVGYLKQDIDFEKGRTVLEEAYQAFGEIKALEKELERVNQALAERDDYESEAYHDLMVSLSDTTQRYDLIGGYRYEGETEKVLLGLGFKRSDFNAPTETFSGGWRMRIELAKLLLQENDLLLLDEPTNHLDIDSIIWLEEFLQQFQGAVLLVSHDKMFLDRVTNRTIEISLGRIYDYPKPYSEFLELREEIREQQLNAQKNQQREIEQAERLIERFRAKSSKASMAQSLIKKLDKMERIEVDREETGVMSLRFPLSVRPGKVIAELEGLSKAYGDNQVLRDIDLLIERGKKIAFVGQNGQGKTTLARILVGELDHKGTCKLGHNVQLGYFAQNQAEFLDGEKTVEETMVDAADEKSRPRVRDILGSFLFRGEEVEKPVKVLSGGERNRLALARMLLQPFNVLVMDEPTNHLDIASKRVLKEALQHFEGTLILVSHDRDFLQGLTGEVYEFRDGGIKPYLGDIDFYLEQRQAEDFRAIEKRSPESPEGKKQAGTPNDGNGGAAGGADAHANRKRKKSLGNKLGNLESRIHSLEKEIGEIDHQLLMDYDATIAHPGFFDDYQQKKQDLEKLMKQWEAVAAEIEALG

SEQ ID NO: 71922 - protein, 554 aa, Arabidopsis thaliana
MTMPDLPPDLVEEILSRVPATSVKKLRSTCTQWNAIFKDERFTEKHFSKAPKESMVLMLKEHRVCPVKEVVSLKGNTYLLAYDVEENSRVVLMFDFTTERFKRLRLPHFQDVGNMDLSVVREEQLSILHWTRNTSKMEIWITNNIDTDATLLWRLHLHTQVFSRNCVRVFSSLYIDKEKKVVLCCNVNDDATSKNIGRRSLSSSLGDQITNREPLMMSNLPLDLVEEILSRVPATSLKRLRSTCRQWNALLKDRRFTEKHFRKAPKESLVLMLKEISVNLNVTPPSIEFKDALGLKDSHSNSEQVDIVQVLHCDGLLLCTTKDNRHVVWNPCLGETHWIQFKVDYGRVYSSFALGYIQNNESCRSYKILWRWKSNDYKSSPRQRGFEIYEFISDKWRVIDDVNHDSLVNHNYLGRCCRVSLKGNIYWLVDDVEDNSRSLLMFDFKTERFKRLCLPHFENVGHMVLSFVREEQLSVLYWSRATPKMEIWITNNIDTDATLLWRLHLDTRFNCVRIFSSLYFEEEKKVVLCCNVKLLMMIRSARTWYTLSERTMDI

SEQ ID NO: 71923 - protein, 249 aa, Polaromonas sp. JS666
MNQPTVLVTGALTGIGRATAIAFAKQGANVVVSGRREEAGQSLAAELRTLGAKAEFIKADVANEAEVRSLVEKAVSLFGQLDIAINNAGTEGALGPITEQSTENVHATFSTNVLGTLLSMKHEIRAMQAQGHGSIVNLSSIAGKVGMAGASVYVASKHAVEGLTKSAALEGAAFGVRVNAVAPGPVQTDMLDRFVGRDESVKAGFMAGVPAKRAATVDEIAETIIFVASSKAPYLTGQSIAVDGGFTIQ

SEQ ID NO: 71924 - protein, 351 aa, Streptomyces coelicolor A3(2)
MTVDGPRSTAPDVVDVVALGESMVTFLPSRPGRLADVPSFDRAIGGAESNVACVLAAAGHSARWAGRVGADGFGDHLVEAIGAYGVDVSAVRRDPARPTGVYFRTAGDRATDAHEVAYYRAGSAASAMSVDTMDLDAIRSGRVLHLSGITPALSAGCLGLMRELTARRPGRPLVSFDVNHRPGLWRDARHGHGPEVLLELARGADLVFVGDDEARDAWGLGGPEAVRAALPEPELLVVKQGASGATAFHGTDATSVPALHVDVVAAVGAGDAFAAGFLSATLRGKPVRERLRHGHLWAAAALTVPADLAAPPARGHADRLVALDDTAWGRLRLGPGWTHAEEGAEEEVRTP

SEQ ID NO: 71925 - protein, 400 aa, Oryza sativa Indica Group
MASSCTVVPADLVEEKAAAAAVEEDAGSYLRADQVDLMSLDFEIEERMADRFRKLNSGGVERGDEGPKAAWEIDLSKLEIGHVVEHGDHGTLFRGKYYGQDVAVKLLDWGAEGDSSEDQIAHFRTSLKEVVAVWHEFNHPNITKFIGASMGTTNLNIPKDIPDHSSRKGARTDLPDRACCVVVEYLTGGTLKQHLIKHYRKNKKLLYEEVVRLALDLARGLSFLHSKKIVHRDVKSENMLLDPQLNLKIADFGVARLVEAQDPKDLTRTTGTLGYMAPEVLDGKPYNRKCDVYSFGICLWETYCCDMPYGPYSDLSFADFSSFVVHKNLRPEIPDCCPSAMASIMRRCWDANPEVRPEMEEVVRLLESLDTSNGGGMLLEKKKKKHPGGGCFCFFVPRAA

SEQ ID NO: 71926 - protein, 173 aa, Zea mays
  misc_feature (39)..(39): Xaa can be any naturally occurring amino acid
  misc_feature (112)..(112): Xaa can be any naturally occurring amino acid
  misc_feature (118)..(119): Xaa can be any naturally occurring amino acid
  misc_feature (122)..(122): Xaa can be any naturally occurring amino acid
  misc_feature (124)..(124): Xaa can be any naturally occurring amino acid
  misc_feature (127)..(127): Xaa can be any naturally occurring amino acid
  misc_feature (130)..(130): Xaa can be any naturally occurring amino acid
  misc_feature (132)..(132): Xaa can be any naturally occurring amino acid
  misc_feature (137)..(139): Xaa can be any naturally occurring amino acid
  misc_feature (142)..(142): Xaa can be any naturally occurring amino acid
  misc_feature (150)..(150): Xaa can be any naturally occurring amino acid
  misc_feature (156)..(157): Xaa can be any naturally occurring amino acid
  misc_feature (160)..(163): Xaa can be any naturally occurring amino acid
  misc_feature (168)..(168): Xaa can be any naturally occurring amino acid
  misc_feature (170)..(171): Xaa can be any naturally occurring amino acid
DVYAHWVPEDRILTTNLWSAELSKLAANAFLAQRISSVXAISALCEATGANVTEVAYAVGKDTRIGPKFLNASCGFGGSCFQKDILNLVYICECNGLPEVANYWKQVIKINXYQKSRXXERXVXFNXQNXPXKKIAXXXCLXKGKPGNKXNPGIDXXKGXXXXKAKLXFXXPS

SEQ ID NO: 71927 - protein, 191 aa, Gluconobacter oxydans 621H
MAREPREGGRGGREREQGDDLVDKLVTINRVAKVVKGGRRFAFAALVVVGDQKGRVGYGAGKAREVPEAIRKATERAKRTMIRVPMKEGRTLHHDTFGHYGAGKVVVRAAEAGTGIIAGGPMRAVFESLGVNDVVAKSLGTRNPHNMIKATFAALEKASSPRHVASRRGKKAAELFGKREQGQTEAEVTNG

SEQ ID NO: 71928 - protein, 522 aa, Synechococcus sp. RS9916
MLGDLWSFQGRYRTLHLTWIAFFLTFVVWFNLAPLATTVRADLDLTIGQIRTVAICNVALTIPARVLIGMLLDKFGPRITYSSILVFSVIPCLLFASAQDFNQLVVARLLLSIVGAGFVIGIRMVAEWFPPKEIGLAEGIYGGWGNFGSAFSALTMVLLAGYLSFSGGATLPTGEVLNWRGAIALTGIISALYGVFYYFSVTDTPPGKVYQKPAKTAGLEVTSMRDFWGLLGMNVPFAAILCVLCWRLTKVGFLTASTYPLALGAVAIWFAFQTWGIIRTNRDLILGNKTYPKEDRYEFRQVAILELTYIVNFGSELAVVSMLPTFFETTFDLPKATAGLLASCFAFVNLVARPAGGLISDKVGSRKNTMGFLTAGLGIGYLVMSMIKPGTFSGTSGIVVAVVITMLASFFVQSGEGATFALVPLVKRRVTGQVAGLVGAYGNVGAVAYLTTFSLLPMWMGGGKDPSPEVIAASNSAFFQILGIAGLVVAFFCFFFLKEPKGSFADLHEGEDASPELAAAGR

SEQ ID NO: 71929 - protein, 636 aa, Nitrosomonas europaea ATCC 19718
MIRISELTLQRGPLRLLENADLTLHPGHKVGLIGANGAGKSSLFALLRGELHPDAGDCVLPMNWRIAHMRQEIDAPDCNAIDYVLDGDGYLRDIQQQLVKAEQRQDGVELGRLYSELDNADAYTSDARARKLLAGLGFLEEQMGNQVNSFSGGWRMRLNLAQALMCPSDLLLLDEPTNHLDLDAILWLESWLQSYPGTLLLISHDRDFLDAVVGHIVHIDQQKLTLYCGGYTAFERARAARIMQQQQAHEKQRAQRAHMEDFIRRFKAKASKARQAQSRVKALERMEELAPAHFDSPFDFIFRVADKVSTPLLNLNEAELGYNVGQPILSNVKLQLVPGARIALLGPNGAGKSTLIKSIVDDLPLLAGQLTRSENLAIGYFAQHQLDSLDPKASPLLHFQRIAQDEREQVLRNFLGGFNFRGKRCDEPVLNFSGGEKARLALALIAWGKPNLLLLDEPTNHLDLEMRQALSMALQDFSGALLLVSHDRHLIKSTMDELYLVADGRVREFAGDLEDYSKWLNDYRLRQRPDNDATSPDKVDRRAQRQATAALRKQLAPLRKHTDTLEKQLDNIQKELQALETILADNNLYEQPQKDQLKQYLSQQTNLLQKQVKLEETWLNNLEELELLQSELGEDV

SEQ ID NO: 71930 - protein, 654 aa, Coccidioides immitis RS
MAPKDMKNQKSAHPYLLPDTVGPFKPAVQGHLKKIYDSIHPQSSNSSTEESSDHFLRVVQQDDSSDLQSPAKAPVLTTLDSFMEYMSTATAMPPGAREDDLSLPMTNYFINSSHNTYLTGNQLYSEASTDVYKDVLLKGCRCLEIDVWDGDLSSSSSSDSEDVEHKKKQKQKDKNLTRMDSKKRFNLNSLSDRLDRLKKDKTGDAMRAATTSATAVAAAVPLRPEPRVLHGYTLTKEVTFRDVCYAIRDTAFVTSDLPVIVSLEVHASHEQQETMVEIMMEAWKGMLVDFTPELAAELEKSDYKHLPSPDSLRNKILIKVKWAPDHGPETDVAFSEISRPPIAATEVSILPEGDAKSAASQAVKKKPVKILHALSRLGIYTRGYTFNGFSQPEATKPTHIFSLSEATLKDAHENQRKALFDHNKNFMMRVYPSGMRVNSSNLDPSFSWRQGAQIAALNWQNCDKGMMLNKGMFARSKGWVLKPEEYRGAERTDKQESPESGRGLKSRHTVHLSIQVYAGQNIPLPKGDEHDRSFRPYVSCQLHAERPKDSIHSKSDGDESGSAKYKRRTTTCSSADPDFGGQTLQFPSAPGVIEQLTFLRVKVKDDEFGRDDLAAWACLRLDDLRQGFRFIRLFDTNGSPTSGVLLVKISKQIT

SEQ ID NO: 71931 - protein, 497 aa, Bacillus subtilis subsp. natto
MCLLMKEAIRMAEIRKLKNYINGEWVESKTDQYEDVVNPATKEVLCQVPISTKEDIDYAAQTAAEAFETWSKVAVPRRARILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSEHLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARFPAPDFN

SEQ ID NO: 71932 - protein, 127 aa, Glycine max
CGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 71933 - protein, 267 aa, Mycobacterium sp. MCS
MMPRLLDKVVVVTGAARGTGRVHCERFAEEGADVIALDVAAVADELSGTAAAVARHGRRCVTGEADVRDFAALTAAIDRGVEELGRLDVVVANAGVHPAGAPAWELTGEAWRQALDVNVTGVWHTVKAAARHMDSGGGAVIVISSTNGLRGTPNSAHYTTSKHAVVGLARTLANELGPRSIRVNTVHPGAVATPMVLNEATFRRLRPDLEEPTADDAAEVLRARNLLPVPWVDPVDVANAVVFLASDEARYITGSQLVVDAGLTQKV

SEQ ID NO: 71934 - protein, 220 aa, Brassica napus
  misc_feature (6)..(6): Xaa can be any naturally occurring amino acid
  misc_feature (15)..(16): Xaa can be any naturally occurring amino acid
  misc_feature (18)..(18): Xaa can be any naturally occurring amino acid
  misc_feature (23)..(24): Xaa can be any naturally occurring amino acid
  misc_feature (27)..(27): Xaa can be any naturally occurring amino acid
  misc_feature (34)..(34): Xaa can be any naturally occurring amino acid
  misc_feature (40)..(40): Xaa can be any naturally occurring amino acid
  misc_feature (45)..(45): Xaa can be any naturally occurring amino acid
  misc_feature (48)..(48): Xaa can be any naturally occurring amino acid
  misc_feature (64)..(64): Xaa can be any naturally occurring amino acid
  misc_feature (67)..(67): Xaa can be any naturally occurring amino acid
  misc_feature (74)..(75): Xaa can be any naturally occurring amino acid
  misc_feature (79)..(79): Xaa can be any naturally occurring amino acid
  misc_feature (83)..(83): Xaa can be any naturally occurring amino acid
  misc_feature (88)..(88): Xaa can be any naturally occurring amino acid
  misc_feature (93)..(93): Xaa can be any naturally occurring amino acid
  misc_feature (97)..(98): Xaa can be any naturally occurring amino acid
  misc_feature (101)..(101): Xaa can be any naturally occurring amino acid
  misc_feature (103)..(104): Xaa can be any naturally occurring amino acid
  misc_feature (107)..(109): Xaa can be any naturally occurring amino acid
  misc_feature (114)..(115): Xaa can be any naturally occurring amino acid
  misc_feature (123)..(123): Xaa can be any naturally occurring amino acid
  misc_feature (127)..(127): Xaa can be any naturally occurring amino acid
  misc_feature (129)..(130): Xaa can be any naturally occurring amino acid
  misc_feature (135)..(135): Xaa can be any naturally occurring amino acid
  misc_feature (139)..(139): Xaa can be any naturally occurring amino acid
  misc_feature (143)..(144): Xaa can be any naturally occurring amino acid
  misc_feature (148)..(148): Xaa can be any naturally occurring amino acid
  misc_feature (153)..(153): Xaa can be any naturally occurring amino acid
  misc_feature (156)..(156): Xaa can be any naturally occurring amino acid
  misc_feature (166)..(166): Xaa can be any naturally occurring amino acid
  misc_feature (172)..(174): Xaa can be any naturally occurring amino acid
  misc_feature (176)..(177): Xaa can be any naturally occurring amino acid
  misc_feature (180)..(180): Xaa can be any naturally occurring amino acid
  misc_feature (182)..(183): Xaa can be any naturally occurring amino acid
  misc_feature (185)..(185): Xaa can be any naturally occurring amino acid
  misc_feature (187)..(188): Xaa can be any naturally occurring amino acid
  misc_feature (191)..(192): Xaa can be any naturally occurring amino acid
  misc_feature (194)..(194): Xaa can be any naturally occurring amino acid
  misc_feature (200)..(201): Xaa can be any naturally occurring amino acid
  misc_feature (205)..(205): Xaa can be any naturally occurring amino acid
  misc_feature (210)..(210): Xaa can be any naturally occurring amino acid
SPLKEXVEKEGKNLXXIXVGGPXXVGXWGYIEPXREIEDXFKCRXDTXKFDDIVVRCASGGPIXGIXLGSWLGXXKPKXNRSXVSDDXDSFSXFAKXXLDXLXXGVXXXDIVTXXNPKGKGYXMTRXEXXKFLKXIASXRSVXXDPVXSGKPXSGXINEMPKDPKXWEGKKXXXIXXGGXLXXYXKXXQLXXLXGTWTPXXVQEXGPKKXGVGKMFKLIL

SEQ ID NO: 71935 - protein, 351 aa, Gluconobacter oxydans 621H
MTDISPNRQTIPQSSTKGWQTVSPGMTAAIGGTPLIRLRRASEETGCDIYGKAEFMNPGGSVKDRAALAIIEDALKSGALKPGGTVVEGTAGNTGIGLTLVAHAVGCKAVIVVPETQSREKLDFLRMIGADLRLVPAKPYRDPGNYVHVSRRLAEEIGGFWANQFDNTANREGHRATTAREIWEQTGGKVDAFTCACGTGGTLAGIALGLRDQAQATGKTAPRIVLADPEGSALYGWVKSNDLTITGGSITEGIGQGRVTANLEGSHPDDAERIPDAEALEQIFSLTSEEGLSVGGSSGINVAAAIRTARRLGPGHTIVTILCDGGARYQSKLFNPEFLRAKNLPVPPWLA

SEQ ID NO: 71936 - protein, 376 aa, Issatchenkia orientalis
APDPVYDSRGNPTVEVELTTAEGCFRTIVPSGASTGVHEALELRDGDKSKWLGKGVTKAVDNVNKIIAPALVEAKIPVTEQLKIDQFLINLDGTPNKGKLGANAILGVSLAVAKAAAAYEKVPLYQYHHKISEFMIAPTGAESFSEALRMGSEVYHHLKSLTKKTYGQSAGNVGDEGGVAPDIHTPQEALDLIMSAIKAAGYEGKIDIAMDSASSEFYKNGKYDLAYKDPNSDGSKAITGSQLGDLYAELCKNYPIVSLEDPFAEDDWETWTNNFENVLFQIVADDLTVNQIGTLSESIQAANDSFAAGWGVMVSHRSGETEDTFIADLTVGLRTGELKSGAPARSERMAKYNQLLRIEEELGDKAVYAGKNFRIR

SEQ ID NO: 71937 - protein, 192 aa, Anabaena variabilis ATCC 29413
MFSSPFSEDNDNAPNGSITLTDEKGRSLECYVEHSLSVDGQEYVLLLPVDSPIEIFAWEGEDEDEEAVLVEFDDAIIDEIFATAQAVLAEQNLVLKQTAYALTVAGDLPPVEESELFTLEIEEEEAADLEPEQLQLLANFYHDEQEYAIYTPLDPLLFFAKITKTGQPVLLSPEEFRKVQPLLEEQLFNEVE

SEQ ID NO: 71938 - protein, 150 aa, Haloarcula aidinensis
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDAPWLYE

SEQ ID NO: 71939 - protein, 435 aa, Oryza sativa Japonica Group
MKNTSSLCLLLLVVLCSLTCNSGQAQVLFQGFNWESWKQQGGWYNMLKGQVDDIAKAGVTHVWLPPPSHSVAPQGYMPGRLYDLDASKYGTAAELKSLIAAFHGKGVQCVADVVINHRCAEKKDARGVYCVFEGGTPDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAPGMIGWLPEKAVTFVDNHDTGSTQKLWPFPSDKVMQGYAYILTHPGVPCIFYDHMFDWNLKQEITALAAIRERNGINAGSKLRIVVADADAYVAVVDEKVMVKIGTRYDVGNAVPSDFHQTVHGKDYSVWEKGSLRVPAGRHL

SEQ ID NO: 71940 - protein, 1071 aa, Shewanella sp. MR-4
MSYQVLARKWRPATFEQMVGQSHVLHALTNALTQQRLHHAYLFTGTRGVGKTSLARLFAKGLNCEKGVTASPCGVCGSCVEIAQGRFVDLIEVDAASRTKVDDTRELLDNVQYRPTRGRFKVYLIDEVHMLSRSSFNALLKTLEEPPEHVKFLLATTDPQKLPVTVLSRCLQFNLKSLTQQEIGTQLQHILTQEQLPFEHEALTLLAKAANGSMRDALSLTDQAIAFGGGTVMLNQVQSMLGSIDEQHVLRLLKALTDADIGVLMQSCAQVLAYGADAQEVLRSLLELLHQITLTQFAPAAAQQSLYSAQIQAFAEQLAPEQVQLYYQILLTGRKDLPHAPDPKSGLEMALLRAVAFVPEKPVKRWQVEDAAKVSLPAQQPSTIPAATEQAVNRVENQAEAEKKTPLTSTVDSQPAATEAVQSGFMSEPSVADPTLPQPEISKASQASQALVAEAAQQLLSDEDVSAVDGDDTAGEESALNAALIAEQQVILSQAQSQGFGASTEVVSSTEAVLISESSPNSKTDASSESSPEPSSVSTPVSNLDAEHNQAAMMDSASIAQKPSAAALTATVALSYDDAEENIQAGANQSTDALASDEYSAEDYGQYDYAAAPLDAYQDDYSQFMVEEQGRFSGMEDSSLMSDSIQSIDHSDVVHEPAAAAPKSQSFADNSVSTTPPVSTATVSLEDDDILSAVLAARDSLLSDLDALSTKEGDGKKLATEVKVKTPSQNVHTAPATKASASTPSETKTASGEAENDFELPFDDDFEIESLFEAQAGVINASLPAHVAPAPHPQFDPNDRPPWEEAPVDTLADVEPVATSYQGSETARAPQVSQTPQPIIAPQEPELATGIAHSASIPTLPTDTGAANTKTANSEETRVEQAIAPHPQRDTAAQPVTQTQTPPQSSEETQQSAPSTALTLAQSITGHPLDLHWYKLMASLEIGGRVRQLAVNSICQLQANPLPLLLKPDQKHLSAPVAIEQLEQALTAALGNPRQVEVVIGIDPTRETPLELRKRFHQELLQQARQSLMMDDNVQWLINRFGAELDQDTLVYPPELLAQRSGLIPALPEPE

SEQ ID NO: 71941 - protein, 431 aa, Burkholderia mallei ATCC 23344
MSRSAGDFATAGDASSRTVRAARDALEGRRKGVAAALPFVGPAVIASIGYMDPGNFATNIQAGAAYGYELLWVVLAANVIAMVFQAMSAKLGIVTGRNLAELCREHFPRPVVWGMWATSEIAAMATDLAEFLGGALAFGLLLHLPLIAGMAATAVLTCAILTLEKRGFRPLEAAIAALVGVIGASYLGELLIAPQDWHAAAYHLVVPQLRDGTALTLAVGIIGATIMPHTLYLHSGLTQRRTTPRDARERRLLLRFSNREVAVALGVAGFVNIAMVMMASSAFHRTAPGMADIGDAYHTLIPLLGPAAGALFLVALFASGVSSSVVGTLAGQVVMQGFLRRRVPIWVRRLVTIAPAFAIVALGCDVTRAMVLSQVVLSLVLPLPMAALLLLSSRRALLGEHALRAPTLVAASAAAAAIVALNVYLIWAAFN

SEQ ID NO: 71942 - protein, 271 aa, marine gamma proteobacterium HTCC2143
MATQPIAISPENDAIWQSIQTETQAAINKEPVLASFLHSTILNHKTLERALSFHLANKLDSPTVSALLVREVIEDALASDSTIAKAVRCDIRAVKERDSACSLYSVPFLYFKGFHALQAYRVAHWLWNQGREDLALFFQNCISTEFGVDIHPAAKIGHGILIDHATGVVIGETATVGNNVSLMHSVTLGGTGKEGGDRHPKVGDGVLISAGAKILGNIRIGSGAKVGSGSVVLQDVPAHTTVAGVPAKVIGKPGSDQPALDMNHGINCDMG

SEQ ID NO: 71943 - protein, 367 aa, Vibrio vulnificus YJ016
MHFVSYSLCYDVRSNIMEQPIYFYEPDENHGFLANFYPCSITVSGTCWPSSEHYYQAQKFDDVRLQEKVLRAEDAAQAFRLSREYQQWQRHDWYDIRVEVMRFIVREKFLQNTPLAHQLLATGDTELKEHSHKDAFWGDGGDGHGRNELGRILMMVREELQEHAPYNLVQFIDSAKLPTQWGTFQMYGFIEKATGKEHLALVYGDIEQQAAPLIRLHSECLTGDALFSARCDCGFQLAKALQNIVAEGAGVLLYLRQEGRGIGLINKIRAYHLQDDGADTVEANEQLGFGADMRDYAFCRGILSFLGIERVRLMTNNPRKVKALQLANIEVTERVPLQEGNNPHNHQYLRTKADKLGHMFDRNFVKP

SEQ ID NO: 71944 - protein, 273 aa, Arabidopsis thaliana
MTSNLFQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSSVEITYESSTIKPDQLMNIFRKNMDLLLGIFNPEGLFEISYLDEDLQVGRDGKGNVFVLERIEKP

SEQ ID NO: 71945 - protein, 324 aa, Zea mays
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERVGFTPLHFLYKKKSTSAPSS

SEQ ID NO: 71946 - protein, 271 aa, Arabidopsis thaliana
MSQTSYYRSPFGDTTYTKVFVGGLAWETPTDEMRRYFEQFGEILEAVIITDKNTGKSKGYGFVTFRESDSATRAVADPNPVIDGRKANCNIASFGRPRPSPPRGRGQTGSPSQYQSGGPSTYTGMAAPLPPAAAPQLMYPSYGYTYNPDQFGYHQALYNTQLQQAQYYQQQQQLYGGGATSPSSSGATIMPSPYYYGYSLQAPRVPYQHHHHLPQPYNPQQHHHQRFSSPSFLVYPSNSSFAPPLQGVLSSSTGTYLINSFFFFIFLWIYF

SEQ ID NO: 71947 - protein, 263 aa, Rickettsia akari str. Hartford
MTIKIHTEQDFIKMRRAGKLAAETLDFITGYVKPNVTTNSLNNLCHNFITSHNAIPAPLNYKGFPKSICTSINHVVCHGIPNDKPLKNGDIVNIDVTVILDGWYGDTSRMYYVGDVAIKPKRLIQITYDAMMKGIEVVRPGAKIGDIGHAIQSYAEKHNYSVVRDYTGHGIGRVFHDEPSILNYGRSGTGLTLEEGMFFTIEPMINAGHYDTILSKLDGWTVTTRDKSLSAQFEHTIGVTKNGFEIFTLSPKKLDYPPYEIVI

SEQ ID NO: 71948 - protein, 795 aa, Oryza sativa Japonica Group
MEQREDHTKSSVPGKEREYNAQPKDDMFPMMKQPGTNARVADPMDDVAQHLIGNLLPDDEELLAGVIEDFDHVKLRTQVEESEEYDVFRNSGGMELDIDPLESITFGTAKASLVNGTGSSTNQYSIQNGAGTVTGEHPYGEHPSRTLFVRNINSNVEDSELRSLFEPFGDIRSMYTATKHRGFVMISYYDIRHARNAKTALQSKPLRRRKLDIHYSIPKENPSDKDMNQGTLVIFNLEPAVSNEELLQIFGAFGEVREIRETPHKRHHRFIEFYDVRAAESALRSLNKSDIAGKRVKLEPSRPGGARRSFIQHFNHEFEQDETKHNSFQIGSPSANSPPSLWSQLGSPTDENKLNALNETAFNGGMSPLGSNHLSGFSSGYPPMKSPVGKSSYWNNRADNIFHGSPTLHNSHSFPEHHGGIISASPLVSSAASSASTASGFTALTGTSFLWGNNNNLRDHGQPSSIQSQALSNSLFPNNQPQRQSNLYQNLRGSFGASEHFSQFNVGSAPSVFPFESNFGYFSDSPDTSYMRQGKFGGTGPTRVSGSLMTNFGAYPRINVASMQNGSVGFEGLLDRGRNQTVGNSGCQEDSRVQYQLDLEKIIAGKDTRTTLMIKNIPNKYDILELIGVMLCYYSVMRSTFVAHILLNFRYTSNMLLEVIDETHEGTYDFFYLPIDFKNKCNVGYAFINMASPGYIVSFFKAFAGRKWEKFNSEKVVSLAYARIQGKAALVNHFQNSSLMNEDKRCRPMLFDPKHTENNNQVKILLNGIFISMAQQDATQERHDLPENPREDNFS

SEQ ID NO: 71949 - protein, 297 aa, Aspergillus oryzae
MHHLGKVLTAFAACAGLGVAAPSSAQITPREVSPQFLQQLTLYAQYAAAAYCSSNTNSPNTKLTCSVGNCPLVEGANTKTLAEFEDNKAFGDVAGFLAVDESNQQIVLSFRGTRSIETWAANVQLIKEDVDELCDGCKVHTGFWKSWESVATATLDGVKKAHQAYPGFKLAVTGHSFGGAVGTLAATVLRNSGSEVALYTYGSPRVGNQEFADYASGQGSNFRVTHSNDIVPRLPPRLLGYHQTSPEYWIPSGNNETVGTADIEMINEADSDMGNAGQKTQSIEAHKWYTDHIYECK

SEQ ID NO: 71950 - protein, 506 aa, Brassica juncea
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 71951 - protein, 267 aa, Yersinia pseudotuberculosis IP 32953
MSIPVFGLGTFRLQDQIVIDSVCQALTLGYRAIDTAQIYENEAAVGQAIQESGINRDELFITTKIWIANLSKDKLIPSLRESIQKLKTDYVDLTLIHWPSPNDEVSVAEFMSELLKAKGLGLTRQIGISNFTIDLMKQAIAAVGAEEIATNQIELSPLLQNRNVVDFAKQNGIAVTSYMTLAYGKALAEPVIKTIAEQHGATPAQVILSWAMQLGYGVIPSSTKAANLASNLLAQKLCLNAADMALIATLDRNERLVSPDGLAPKWD

SEQ ID NO: 71952 - protein, 193 aa, Magnaporthe grisea 70-15
MSSAKPQAKLPVAVNKPTPYSFDLALLLANDPNPVELDKTDLEGSLSSLARDGAQALINQLLTTCPIQSTPSGVLLSLPAQQTALPREKPLPAAKEPTKWERFAAKKGIKPKTREQRRNIQYNEEKGEWERKWGYKGANKQLEKDWLVEVDPAKEAKLKEGETLRGQTRRERVERQKRNERKMRKNERDAAKK

SEQ ID NO: 71953 - protein, 506 aa, Brassica juncea
MTSINVKLLYHYVITNFFNLCFFPLTAIVAGKASRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETYGPEGLLQVPPRKTFAAAREETEQVIIGALKNLFENTKVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMAKKLFKDKVKHYYVPDFKLAVDHFCIHAGGRAVIDVLEKNLGLAPIDVEASRSTLHRFGNTSSSSIWYELAYIEAKGRMKKGNKVWQIALGSGFKCNSAVWVALSNVKASTNSPWEHCIDRYPVKIDSDSAKSEVRVQNGRS

SEQ ID NO: 71954 - protein, 420 aa, Glycine max
  misc_feature (141)..(141): Xaa can be any naturally occurring amino acid
  misc_feature (212)..(212): Xaa can be any naturally occurring amino acid
  misc_feature (215)..(215): Xaa can be any naturally occurring amino acid
  misc_feature (218)..(218): Xaa can be any naturally occurring amino acid
  misc_feature (220)..(221): Xaa can be any naturally occurring amino acid
ERNMQQRLKLQQQQALMQQALLQQQQMYHPGMLAAAMSQMEPVPSGNVPPGFDTSACRSVYVGNIHVNVTDKLLAEVFQSAGPLAGCKLIRKEKSSYGFVDYHDRASAALAIMTLHGRQLYGQALKVNWAYANSSREDTSXDARVMWDHKTGRSKGYGFVSFRDHQDAQSAINDMTGKWLGNRQIRCNWATKGAGGSSNEEKINDSQNAVVXTNXSSXDXXFGFGISLSYGGQDNNNEDAPDNNPSYTTVYVGNLPHDVTQAELHCQFHALGAGVIEEVRVQRDKGFGFIRYNTHDEAALAIQMANGRLVRGKNMKCSWGSKPTPPGTASNPLPPPAQPYQILPTAGMNQGYSPAELLAYQRQLALSQAAVSGLSGQALLQMTGQHGLAPASMGINSGASQAMYDGYTGNSSRQQLMYYR

SEQ ID NO: 71955 - protein, 223 aa, Triticum aestivum
  misc_feature (213)..(213): Xaa can be any naturally occurring amino acid
  misc_feature (219)..(219): Xaa can be any naturally occurring amino acid
MAMRRLLQGVVLPRATGRCVGASSFSTSTEAIRATLFPGDGIGPEIAESVKQVINVAGVPIEWEEPCVGTEVDPGTQSFLTWESLESVRRNKVGLKGPMATPIGKGHRSLNLTLRKELGLYANVRPCNSLPGYKTRYDDVNLVTIRENTEGEYSGLEHQVVKGVVESLKIITRQASLRVAEYAFHYAKANGRERVSAIHKANIMRKTDGLFLXCCREVXAKYP

SEQ ID NO: 71956 - protein, 552 aa, Oryza sativa
  misc_feature (476)..(476): Xaa can be any naturally occurring amino acid
MGGGQSRSPRDGSGHGRYGHSPSFQQQWGGGGGGGGGGGGGYPYGQDAHGGGYYGAPAPQGGYAAPYPAYQQPPPPMPSPAATQPPARAGGASKPRLDRRYSRIADDYHSVDQVTDALAQAGLESSNLIVGIDFTKSNEWLGKFSFHGRSLHHISNAPNPYEQAISIIGQTLSKFDEDNLIPCFGFGDATTHDQDVFCFYPDLRPCNGFSEALSRYRELVPHLRLAGPTSFAPIIEMAMTIVEQSGGQYHVLLIIADGQVTRSVDTASGQLSSQEQKTVDAIVRASELPLSIVLVGVGDGPWDMMKEFDDNFPSRAFDNFQFVNFSEIMNKNMPQSRKEAAFALSALMEIPQQYKATVELGILGRRSFKSPERVPLPPPGGSHDAYSYGSKSFSKPSTYPQSSTSSSSYPHYETAQSSSPAVPSSTYDNQVCPICLVNPKDMAFGCGHQTCCDCGQSLESCPICRSPISTRIKLYXQWQFGSFANGWHTGDHLVSHWAMDCIGCFKCNPCKAFERLADKPVKYWVCIDKDRKASNPLLQDCGAGDVSSIETH

SEQ ID NO: 71957 - protein, 183 aa, Shewanella sp. MR-4
MAMNTETLSLIKQSIKTIPNYPKEGILFRDVTSLLENAAAYKATIDLLVEQYRNKGFTKIVGTEARGFLFGAPLALELGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 71958 - protein, 321 aa, Staphylococcus epidermidis ATCC 12228
MLNNEYKNSSMKIFSLKGNEPLAQEVADHVGIELGKCSVKRFSDGEIQINIEESIRGCDVFIVQPTSYPVNLHLMELLIMIDACKRASAANINIVVPYYGYARQDRKARSREPITAKLVANLIETAGANRMIALDLHAPQIQGFFDIPIDHLMGVPILAQHFENDPDINPEECVVVSPDHGGVTRARKLADILKTPIAIIDKRRPKPNVAEVMNIVGDIEGRTAIIIDDIIDTAGTITLAAQALKDKGAKEVYACCTHPVLSGPAKERIENSAIKQLIVTNSIQLEENRKPNNTKELSVAGLIAKAIIRVYERESVSVLFD

SEQ ID NO: 71959 - protein, 85 aa, Streptococcus intermedius
AKTVVWNGPMGVFENPDFQAGTIGVMDAIVKQPGVKSIIGGGDSAAAAINLGRADKFSWISTGGGASMELLEGKVLPGLAALTEK

SEQ ID NO: 71960 - protein, 96 aa, Raphanus sativus var. niger
ATYKVKFVTPEGEQEVECDDDVYVLDAAEEAGIDLPYSCRAGSCSSCAGKVVSGSVDQSDQSFLDDDQIAEGFVLTCAAYPTSDVTIETHREEDVV

SEQ ID NO: 71961 - protein, 96 aa, Raphanus sativus var. niger
AAYKVKFITPDEDKEVECDESEYVLDAAEESGIDLPYSCRAGACSSCAGKVVSGSVDQSDQSFLDDDQVADGFVLTCIARPTSDVVIRTHQEEEMV

SEQ ID NO: 71962 - protein, 615 aa, Xylella fastidiosa Temecula1
MLSGVLMSNPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVTKFFGRISNALVVGAEIDFYRKLLQRFESEHNVPAIEIAAALARLLQGDSPFLLSVPTRPQRERSELASEHHVKRPSSFKQTERPNNTEHPKRPQRNAPARNVPEFGMESYRIEVGRMHGVKPANIVGAIANEAGLESRYIGRIDIRDDHSVLDLPAEMPHEILQHLKKVWVSGQQLQMRRIDTTETTAPAREFKSKPGGAGKFPPKPHHNKSTKPKPPYSG

SEQ ID NO: 71963 - protein, 325 aa, Oryza sativa Japonica Group
MARSALDEVTDAGAFDRSPSTFRSSISRDSSARFPAVPGRYHLYVSYACPWASRCLAYLKLKGLDHAIGFTSVKPIFERTRETDDHLGWVFPATGDEEPGADPDPFNGAKTIRELYEIASPNYIGKPTVPVLWDKQLKTVVNNESSEIIRMLNTEFNEIAKNPDLDLYPAHLQTSVNEINELVYDAINNGVYKCGFAKKQGPYDEAVTRLYEALDKCEEILSRQRYICGNQLTEADVRLFVTLIRFDEVYAVHFKCNKRLLREYPNLFNYTKDIYQIPGISSTVNMEHIRKHYYGSHPSINPYGIIPAGPNIDYNAPHDRERFSA

SEQ ID NO: 71964 - protein, 531 aa, Oryza sativa
EVVQKEQKSTQHQNESIDLTGSNDPAEVKAEGNLVPKRLADEEKGVVEDGIANGSLKSSSALGKEHGIASASGSARLVGRSETGERGFSSSRCRPSTSSDVSDESACSSISSVTKPHKANDSRWEAIQMIRTRDGILGLSHFKLLKKLGCGDIGSVYLSELSGTESYFAMKVMDKASLASRKKLLRAQTEKEILQCLDHPFLPTLYTHFETDKFSCLVMEFCPGGDLHTLRQRQRGKYFPEQAVKFYVAEILLAMEYLHMLGIIYRDLKPENVLVREDGHIMLSDFDLSLRCAVSPTLIRSSNPDAEALRKNNQAYCVQPACVEPSCMIQPSCATPTTCFGPRFFSKSKKDRKPKPEVVNQVSPWPELIAEPSDARSMSFVGTHEYLAPEIIKGEGHGSAVDWWTFGIFLYELLFGKTPFKGSGNRATLFNVIGQPLRFPEYPVVSFSARDLIRGLLVKEPQQRLGCKRGATEIKQHPFFEGVNWALIRCASPPEVPRPVEIERPPKQPVSTSEPAAAPSDAAQKSSDSYL

SEQ ID NO: 71965 - protein, 308 aa, Candidatus Kuenenia stuttgartiensis
MNTIKYSQHLFTALSAAGKAGRAILEVYYTDFAVEHKDDTSPLTLADKHSHEVITKDLKTLTTGNNSGNANAVSSLPVLSEEGKEIPYTERRYWESFWLVDPLDGTKEFIKRNGEFTVNIALIHKNRPVLGCIYVPVKDVLYFACEGLGAYRRENNQGIANVLSLKELVDSSERLPSRHTHKKNVENNRSPDEDGIHLTVIGSRSHPSEQFAKFVESLRGEGRKIEIISAGSSLKFCLLAEGKADIYPRFGPTMEWDTAAGQAIVEQSNGKIMDAETNMPLKYNKENLVNPFFIGRGENSPFPPITGQ

SEQ ID NO: 71966 - protein, 623 aa, Arabidopsis thaliana
MGIANKLRLSSSSLSRILHRRILYSSAVRSFTTSEGHRPTIVHKQGLDILHDPWFNKGTAFTMTERNRLDLRGLLPPNVMDSEQQIFRFMTDLKRLEEQARDGPSDPNALAKWRILNRLHDRNETMYYKVLINNIEEYAPIVYTPTVGLVCQNYSGLFRRPRGMYFSAEDRGEMMSMVYNWPAEQVDMIVVTDGSRILGLGDLGVHGIGIAVGKLDLYVAAAGINPQRVLPVMIDVGTNNEKLRNDPMYLGLQQRRLEDDDYIDVIDEFMEAVYTRWPHVIVQFEDFQSKWAFKLLQRYRCTYRMFNDDVQGTAGVAIAGLLGAVRAQGRPMIDFPKMKIVVAGAGSAGIGVLNAARKTMARMLGNTETAFDSAQSQFWVVDAQGLITEGRENIDPEAQPFARKTKEMERQGLKEGATLVEVVREVKPDVLLGLSAVGGLFSKEVLEAMKGSTSTRPAIFAMSNPTKNAECTPQDAFSILGENMIFASGSPFKNVEFGNGHVGHCNQGNNMYLFPGIGLGTLLSGAPIVSDGMLQAASECLAAYMSEEEVLEGIIYPPISRIRDITKRIAAAVIKEAIEEDLVEGYREMDAREIQKLDEEGLMEYVENNMWNPEYPTLVYKDD

SEQ ID NO: 71967 - protein, 402 aa, Zea mays
MATKRSVGTLGEADLKGKKVFVRADLNVPLDDAQKITDDTRIRASVPTIKFLLEKGAKVIRASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADKMSHISTGGGASLELLEGKTLPGVLALDDA

SEQ ID NO: 71968 - protein, 253 aa, marine gamma proteobacterium HTCC2143
MTKSQTDSNSTHFGYKTVEKGNKEEMVAGVFHSVAAKYDLMNDLMSAGVHRIWKRFTIELSGVRPGHHVLDIAGGTGDLAAKFSKIVGQHGRVVLADINESMLRVGRDKMTDSGIVGNIEYTMANAECLPFPDNTFDCITISFGLRNVTDKDAALRSMNRVLKPGGRLLVLEFSKPGNALLSKAYDTYSFKLLPKIGKLITNDEDSYRYLAESIRMHPDQDTLKAMMEDAGFARCEYHNMTGGIVAVHKGIKP

SEQ ID NO: 71969 - protein, 338 aa, Aspergillus oryzae
MATPKVGINGFGRIGRIVCSYSIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTDINVLSNASCTTNCLAPLAKVINDNFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 71970 - protein, 283 aa, Arabidopsis thaliana
MFHSYLKVVEIVDRYDTDCIPTSSRNNMVAYIQGEGDKICKRTITVTKAMKHPVYVYYQLENFYQNHRRYVKSRNDAQLRSPKEEHDVKTCAPEDNVGGEPIVPCGLVAWSLFNDTYSFSRNSQQLLVNKKGISWKSDRENKFGKNVFPKNFQKGAPIGGGTLNISKPLSEQEDLIVWMRTAALPTFRKLYGKIETDLHAGDTITVLLQNNYNTYSFNGQKKLVLSTTSWLGGRNDFLGIAYLTVGSICLFLAVTFAVLYLVKPRQLGDPSYLSWNRSAGGLQ

SEQ ID NO: 71971 - protein, 203 aa, Zea mays
MWASPFALRAKLALNFKGLAYEYVEEDLRSKSDLLLSSNPVHKKVPVLIHNGVPVCESRVIVEYLDEVYSATGPRFLPADPYERAMARFWASFIDEKFLASWLKAGRGKTDEEKAEGLKLTLAAVETLEGAFMECSKGKPFFGGDSVGYLDIALGALVAWMRATEARHGLRLFDASRVRCWRSGWSASASWTRSWRSCRTSTG

SEQ ID NO: 71972 - protein, 171 aa, Sulfolobus tokodaii str. 7
MMVIEEYLGKKPKIADKVYIHPTAYVIGDVSIGEFSSLWHYVVVRGDNDSIEIGRETNIQENSTIHTDIGYKVIIGDRVSIGHNAVIHGAKISSNVIIGMGAILLNGSEVGEYSIIGAGAVVTQGTKIPPYSIAVGVPAKVIRKVSEEEIKLISENAEEYLKHVRRFLKIE

SEQ ID NO: 71973 - protein, 441 aa, Paracoccus pantotrophus
MKRETMVNAFDPEQAAGLDPDDLSLIERRGRVLGPAYRLFYQEPLHITKGEGVWLYDGSGRKYLDAYNNVASLGHCHPKVVEAVTRQLGTLNTHTRYLHEGIVTYAESLLATMPESLGHVMFTCTGSEANDLALRVARSYTGRQGVIVTKLAYHGLTEAVAEISPSLGDFVPRGPRVRLIPAPNALFVPPAEQGAKLAADLAQAIAEMRAGGIEPAAFIVDTIFSSDGLYPDPAGFLKPAADLIRAEGGLFIADEVQPGFARTGEAFWGFQRHGLSPDLVTMGKPMGNGFPMAGVAIRPEIVSEFGAKARYFNTFGGNPVAAAAGLAVLQVIRDEGLQENAREVGGFLKQGLADLTAEREDIGHLRGAGLFLAVECVTERETNAPNAALAGHIVNHLRRNGVLISATGPGANILKIRPPLVLGRAEAQIFLDAVEMALAAA

SEQ ID NO: 71974 - protein, 535 aa, Pseudomonas fluorescens Pf-5
MAILHTQVNPRSAEFVANSEAMLAQVDALHSLLAQVQQGGGAKAQERHTSRGKLLPRERINRLLDPGSPFLEISALAAYEVYGEDVPAAGVIAGIGRVEGVECMIVANDATVKGGSYYPLTVKKHLRAQTIAQQNRLPCIYLVDSGGANLPRQDEVFPDREHFGRIFFNQANMSAQGIPQIAVVMGSCTAGGAYVPAMADEAIMVREQATIFLAGPPLVKAATGEVVSAEDLGGADVHCKISGVADHYAESDEHALALARRSVANLNWHKQGQLQQRTPIAPLYARDELYGVVPADPKQPFDVREVIARLVDGSVFDEFKALFGTTLVCGFAHLHGYPVAILANNGILFAEAAQKGAHFIELACQRGIPLLFLQNITGFMVGQKYEAGGIAKHGAKLVTAVACAQVPKFTVIIGGSFGAGNYGMCGRAYDPRFLWMWPNARIGVMGAEQAAGVLVQVKREQAERGGQSFDAAQEAQIKQPILDQYEHQGHPYYSSARLWDDGVIDPAQTRDVLALALSAALNAPIEQSRFGVFRM

SEQ ID NO: 71975 - protein, 513 aa, Francisella tularensis subsp. holarctica
MKTIMIKTTSSSGEDYYKNIFSAICDKDGFMTKTDILDILVESGISNDDPRITKLIAKLNKFCDIDKIDFDTFQEITFENIGLIEKAINKGFIIPNFKDFKKEIEAIYNETKKNETGRNANYIPQLARVDPNLFAVAFCSVDGQIITLGDYLQPYCVQSTAKTITYCIATEENGEDKVHQHVGREPSGITFNAIALNKYDLPHNPMINSGAIMMCSLIKPEWNIADRFEYITNVWQDLAGGEPIGFDNAVYHSEKETADRNYALAHFMKEVGAFPEGTNIHTALDFYFQTCSIQVNAKKMAKIMASIANGGVCPFTSKKIFSPTTIRNCLSMMYSCGMYDFSGEYAFSVGLPAKSGVSGALAIAIPNVGGFAIFSPRLDPNHNSVRGVEFSKRLIEKFSFHNYDHITHCDKINPVENRMVVESNLTFELIWAASAGDLSEIKRAVALGVDINKGDYDKRTALHLAAAEGHEDIVKYLIRKGADINAIDRWGKKPLDDAIMNNNISIIELLDRT

SEQ ID NO: 71976 - protein, 582 aa, Gibberella zeae PH-1
MGFSFNQKSQATSQATSPGEVSESDSIIRDGELAFVRQTAGNGTSGYQEAVGAPVETRSPLGYNVNWITIIFLNLNHMVGTGIFSTPATILKLTGSIGLALVYWVIGFILAVAGLAVHMEFTSYFPNRSGSEVVWLEQGYPRPKHFFPVAFAVQSVLLSFSSSNAIVLSNYLWRIVGRAPDAWELKGVAIAAYTLAVITVLVHNRYSLWAINVFGALKLLLLLFIAISGLVILGGNFGSIPDPSLNFRNGFEGTTSSGYNLSQAMVNISFAFSGWQNAFSMANEIKNPIPTLKKNASASLLIVFVLYFLCNIAYFAAVPKDIFLESSELAAAVFFRTAFGKSAESALNFCVLLSSFGNLLAVLVSQSRQIREIARQGVLPWTEFWVSTKPFGTPVGPYLLKWAFTFLMIVAPPAGDAFQFVVSLKTYPDAIFFAAMGVGLLLIRRRRSRSNTPPSDFRAWHALVILYILSQIYLLVMPWIPPVGGIYGGTVSFLWCTYMIVGIAILGVCGLYYYVWMKLLPRWGGYKIRSQVISVDDNGANTHRLLKVPNDEVAEWDATHDDLGRDLPAGQRVTTEISNISK

SEQ ID NO: 71977 - protein, 173 aa, Helicobacter pylori
  misc_feature (1)..(1): Xaa can be any naturally occurring amino acid
  misc_feature (39)..(39): Xaa can be any naturally occurring amino acid
  misc_feature (94)..(94): Xaa can be any naturally occurring amino acid
  misc_feature (100)..(100): Xaa can be any naturally occurring amino acid
XNLEKLEVSHDADSLCVVIEISKHSNIKYELDKESGALXVDRVLYGAQNYPANYGFVPNTLGSDGDPVDALVLSDVAFQAGSVVKARLVGVLNXEDESGXDEKLIALPIDKIDPTHSYVKDIDDLSKHTLDKIKHFFETYKDLEPNKWVKVKGFENKESAIKVLEKAIKAYQG

SEQ ID NO: 71978 - protein, 367 aa, Medicago truncatula
MSDHSADLPAAAAALSAEDRAGLVNALKDKLQLLAGDRVDVMETLSPNVKQRVEVLKVLQSEHDELESKYLEERAQLEAKYQKLYEPLYTKRYEIVNGVIDVEGITNEAGQGEESKAAEEKGVPSFWLTAMKTNEILGEEITERDEEALKYLKDIKWSKLDNPKGFKLEFYFDSNPYFQNSVLTKTYHMIEDDDPILEKSIGTEIEWHPGKCLTQKVMKKKPKKGSKNAKPIIKTEKCDSFFNIFNPPHIPEDDDEIDDDVVEELQNLMEHDYDIGSTIRDKIIPHAVSWFTGEAGESDFDDIEVDEDDEDGDEEDDDDDDDDDDDEEDEDDEEEDEGKGKSKSKRGSKAKPGKDQSTERPADCKQQ

SEQ ID NO: 71979 - protein, 276 aa, Arabidopsis thaliana
MATAVGSGSDVEVGFAKLQGEDFEYYMQSYSIILGRNSKKSTVDVDLSSLGGGMNISRNHARIFYDFTRRRFSLEVLGKNGCFVEGVLHLPGNPNVKLDSQDLLQIGDKEFYFLLPVWSILGGPLGPRHHVLGKATVVPYHNYHSGPGSGSGKNGVRSRELYEYDDEDDDEEEDIRGSGKKTWRDGHEGVYASGEKKREGRSKADREILKEYGNVWHHSRVRRYLSQEDWAIPEAKGKPWYGLLMLLRKYPEHFVINTRSKGRVTLEFVSLVTLLS

SEQ ID NO: 71980 - protein, 689 aa, Oryza sativa
MRRRGDQCDDDEIDAAALGVAHRVVGRQQTFLGRPFSLAYLLSIFFPSAGAATARGDGMSVLSFALQGSSTARHGWYNIVCGVAIARYSGLVLVGSHVANVALDQSESYPLTRRSGHKRECHQVAVMASSALICDTEQWKGLQAHYDFVFRHACGGEQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 71981 - protein, 277 aa, Klebsiella pneumoniae
MRNDRSFIELRARERAHALLDDGSYRELLNPFDGIMSPWLGAQGIVPQSDDGMVVAKGTINGQPAVVIAIEGTFQGGSMGEVSGAKMAAALELAAEDNRNGIPTQAVLCLETGGVRLQEANLGLAAIADIHAAIVDLRRYTPVVGIIAGTVGCFGGMSIAAALCSYLIVTREARLGLNGPQVIEQEAGIEEYDSRNRPFIWSMTGGEIRAASGLVDALVNDGVNAVKTAMNEAIAKGVPVQHRSDNYDDYLRRLSQFDTRQQADTAQIKQLFAREDK

SEQ ID NO: 71982 - protein, 467 aa, Xylella fastidiosa Temecula1
MNDILPVILSGGSGTRLWPLSREAYPKQFLPLVGHHSMLQATWLRAAPVTTHSPIVVANEEHRFIAAEQLQHLGVYPSAILLEPTGRNTAPAIAVAALEATRTGNDPLLLVLPSDHVIRDETAFQTAVHVAAAAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 71983 - protein, 459 aa, Mycobacterium sp. MCS
MTLTNETTLPNGLSVDDARAEAARAYELDRKHVFHSWSAQAEISPMVITAAQGSYIWDGEGRRLLDFSCQLVNTNIGHQHPKVVAAIQAQAAKLCTVAPQHANDARSEAARLIAERTPGELNRIFFTNGGADAVEHAVRMARLHTGKYKVLSRYRSYHGGTETAINLTGDPRRWPNDHGNAGVVHFFGPFLYRSQFHATTEAEESARALAHLEDIVRLEGPSTIAAIVLESIPGTAGIMVPPPGYLAGVRDICDRYGIVMIADEVMAGFGRSGKWFSIDHFDVTPDLLTFAKGVNSGYVPLGGVAIGPAIAETFAHRPYPGGLTYSGHPLATAAAVATINAMEEEDIVGNAARIGAEVLGPGLAELAARHPSVGEVRGTGVFWAIELVANPQTREPLAPYGASSAAMNAVVAACKANGLLPFANFNRIHAVPPCTVTADEVREGLAILDQALDVADSHL

SEQ ID NO: 71984 - protein, 497 aa, Mycobacterium sp. MCS
MANTVQHWCNNDVFAGGSQATAPVTNPATGEVTGQVALAGVEDARTVIEAAAAAFPAWRDTSLAKRTSVLFNFRELLNARKHELAAIITAEHGKVLSDALGEVSRGQEVVEFACGIPHLLKGGFTENASTNVDVYSIRQALGVVGIISPFNFPAMVPMWFFPVAIATGNTVVLKPSEKDPSASLWLARLWKEAGLPDGVFNVLQGDKTAVDELLTHPKVKAVSFVGSTPIAQYVYATGTAAGKRVQALGGAKNHAVILPDADLDLAADAMVNAGFGSAGERCMAISACVAVGPIADDLVAKIGERARALRTGDGTKDSDMGPLVTKAHRDKVASYIDAGEADGAKVVVDGRQVSADGGENGFWLGPTLLDNVTPEMSVYTDEIFGPVLSVVRVETYDEALELINSNPYGNGTAIFTNDGGAARRFQNEVEVGMVGINVPIPVPMAYYSFGGWKNSLFGDSHAHGTEGVHFFTRGKAITQRWLDPSHGGINLGFPQNN

SEQ ID NO: 71985 - protein, 420 aa, Burkholderia mallei ATCC 23344
MPHRAGSLTILQGAALYIGAVLGTGVIALPALAAEVAGPASLLAWAALVMLSIPLAATFAALGARYPDAGGVSTYVRKAFGPKAAAVVGWCFYFAVPAGAPAAAMFGGAYVAAVTGGAHATMIASAAVLIALVAAANAFGVTVSGRMQLVLSALLVALLVAAVLASAPHARAANLHPFAPHGWLAVGEAAALLVWSFAGWEAITHLAAEFRRPARDLPRSTGIAVAVVGLLYLSVAAASVLVLGPAAGESGAPLAALIARGIGGNAQLIATAAALLFTLGTMNAYFAGAAKLGAALGRDGALPRWFAQGSQTGGVPRRSLAVVAALAGCALVAAVATGMGPKPLVLATSGNFVMVYVLGAAAATRLLPRGGLAHRASIVALLSALLLLATTGWYLLWPLLLTASAIGYLFITGRRAAAKR

SEQ ID NO: 71986 - protein, 261 aa, Triticum aestivum
MADAGAPRGGGGFGSRGDRGGDRGRGRGRGRGRRGGKSEEKEWQPVTKLGRLVKAGKIKSMEEIYLHSLPVKEYQIVDFFLPKLKDEVMKIKPVQKQTRAGQRTRFKAIVVIGDSEGHIGLGIKTSKEVATAIRAAIIIAKLSVVPIRRGYWGTNLGEPHSLPTKESGKCGSVTVRLIPAPRGTGLVASPAVKRLLQLAGVQDIYTASAGSTKTLENTLKATFVAVANSYGFLTPNLWAETKLIRSPLEEFSDVLREGKRY

SEQ ID NO: 71987 - protein, 669 aa, Agrobacterium tumefaciens str. C58
MTFKDKPKRDGGKTFGGDRKPKGPGKPAAEREKKPAQAKAAPASAATAEVVGAGKPERISKIMARAGVASRRDVERMIMEGRVSLNGVLLDTPVVNATLSDKIEVDGMPIRGAERTRLWLYHKPAGLVTTNSDPEGRPTVFDNLPGELPRVLSIGRLDINTEGLLLLTNDGGLSRVLELPTTGWLRRYRVRAHGEVDQAALDKLKDGIAVDGVLYGAIDATLDRTQGHNVWITMGLREGKNREIKNVLGALGLEVNRLIRISYGPFQLGDLPEGKVLEVRGRMLRDQLGPRLIEEAGANFDAPIYNTSVDDEEEAPAKRAKSEWAKSDAPEGKPRFEKAAGKPEDRREKALGRLDTKRSDKPAGKFGAKPAGKFGGKGRNDDEGDDRRPRPPAGTSRTANVWMAPGAKPTRDGKERKSSARAEAESLFKKPSAQDEARRNVVRHADAEGEWIRSDSPREEEGGRGRGDRPGRGEKSFGDRGGRGGKPFGDRPSGDRPFRDRPREDGDRPRGDRPARGTKSFGDRPARGDKPFGDRPFRDRPREDGDRPRSDRPRGEKSFGDRTARGEKPFSERPFRDKPREEGDRPGSDRPRGDRPFGDKPRGGKPGGRPASGKPSFGKSGERGERSGFSGKGKGPGGNGPGGGKPGGKGPGGKPSGGRGMTRNADRRR

SEQ ID NO: 71988 - protein, 87 aa, Glycine max
  misc_feature (52)..(52): Xaa can be any naturally occurring amino acid
MAALMISFPAVTTVNRAGAGMDVPFTGLKYMDGFPSMMSNIDITFIVSNGGXVQCMLDRSPYGKKKFETLFHLPDLDDAQLVKEVLF

SEQ ID NO: 71989 - protein, 573 aa, Burkholderia mallei ATCC 23344
MNATNRFKSTVLAALVSSALAGFLPSAPAHAKGPQQRVVLDGSAVAVADKYSADAAEEIFRQGGNAVDAAVAIAFTLAVTYPEAGNIGGGGFMTVYMGGKPYFLDYRERAPLAATKDMYLDKDGNVVKGMSLYGDRAVGVPGTVAGMWEAQKRFGKLKWKQVIAPAIRYARDGFVVDEQLAQRGVDASKEFGGKTNFDQYFSGLKAGATFKQPELAAVLARIANDGAKDFYDGKTADLIAASMKKGGGLITKQDLVQYKAVWRQPVQANWNGYRVITAPPPSSGGIGLVQLLTMKADRKADFDGVALNSPQYVHLIAEIEKRVFADRAQYLGDPDFYKVPVAQLTDAAYIAKRAAEVNPEKPSDTKSVLPGLGTSMPEKAETTHFSVVDKWGNAVSNTYTINGYFGSGVVAEGTGIVLNDEMDDFSAKPGVANMFGVVGSDANAIEPKKRPLSSMSPTVLTKDGKVALVIGTPGGSRIFTSIFQVITNLYDFKMPLKDAVGAMRFHHQLLPPNTIFWEPYHSIDGELAKGIEAKGYTLKGQDFSGDIQAIRIDGKTPEAVSDPRGRGVSRVIR

SEQ ID NO: 71990 - protein, 610 aa, Agrobacterium tumefaciens str. C58
MTEHDALFSEPLLLLAGAVIAASVFRKLGLGTVLGYLVAGIIIGPFLHLVTDAKDIFNVSELGVVFLLFIIGLELKPSRIWQMRRDILGLGLAQVLVTGSALAAIAWWAGLIDARGSVVAGFGLALSSTAFALQILEDDGDMNTRHGNRSFSILLFQDLAIVPLLALVTILSNRPDVPTDSMAYDLVASVVAVAGMVLAGRFLLTPMFQIIARTGAREVMIAAALFVVIGAAAIMEMVGLSMGMGALLAGLMLSESSYRHELEADIEPFRGLFLALFFMAVGMSLHINIVYEHIVLILIAVPVMMAVKAALIYGLCRIAGSSRYASSRIALLLAQGGEFGFVLFTTAAASGLFPQATASILVAVVTLSMALTPVLAVISRRLTAEDAEEDKLEEDFDGAGADVLMIGFSRFGQIASQILLAGGRDVTVIDSSADRVRQAARFGFRIFFGDGTRKDVLIAAGIERADLVAVCTHKKEVTDRIIDMIQSEFPSVRIYARSYDRIHSLDLRKKGVEYEIRETLESGLLFGRRILEGLDMDAERALAISDDIRERDEQRLELQAVEGLAAGRQMLHNKPVREVKPEPLMKPKNKAEKREEEEEDMEESETEVLL

SEQ ID NO: 71991 - protein, 103 aa, Pediococcus pentosaceus ATCC 25745
MVEAITDANFEEKTNTGVTLTDFWATWCGPCRMQSPVVEQLADEMGDKVSFSKMDVDQNPETARNFGIMSIPTLLVKKDGAVVDSIVGYHSKEQLAKILDQYI

SEQ ID NO: 71992 - protein, 130 aa, Zea mays
  misc_feature (54)..(54): Xaa can be any naturally occurring amino acid
CLAQILQARLLHCRHYVHILYVFSDGKMNTERLRKLVELVGKQRLVLDLSCRKXRLGIDEELVELLGHYSPIPVTYAGGVSTMDDLERIKKAGKSRVDVTIGSALDIFGGDLPYKDVVLWHRKQSMVGQV

SEQ ID NO: 71993 - protein, 86 aa, Zea mays
  misc_feature (72)..(72): Xaa can be any naturally occurring amino acid
CRYGTVMGGLLSEKFLDTNVSIPFAGPPLNTPSLQKYKKMVDAWGGWSLFQTLLQTLKKVSLKHGVTISTVXAVKYILNQASSLPS

SEQ ID NO: 71994 - protein, 403 aa, Polaromonas sp. JS666
MNLNFHPAGRHFLQIPGPSPVPDRLLRAMSYPTIDHRGPEFGALGRKVLSGIKDIFKTRHPVVIYPASGTGAWEAALVNTLSPGDAVLMFETGHFASLWNKMALRLGLKPEFIGLPGTEGWRNGVQADMIEQRLRNDAQHQIKAVCVVHNETSTGVTSNIAAVRRAIDAAKHPALLLVDTISGLASADYRHDEWGVDVTISGSQKGLMLPPGISFNALSPKAVAASRDALLPKSFWAWDEIVEMNQTGYWPYTPNTNLLYALSEALDMISAEGLPQVFARHERLGKACRNAVEAWGLEIQCADPAVYSPVLTGVMMPEGVDADRVRQIVYQHFNMSLGAGLGKVKGRMFRIGHLGECNDLTLLAALAGCEMGLKLAGVRLRESGTSAAMEFLAASAQPTATLG

SEQ ID NO: 71995 - protein, 318 aa, Ralstonia metallidurans CH34
MAIDPQLLSYYRQMADLYANEPIPEDAAARRSRFEDVAARSRQPDTEEISVTDLAIPVDGAALTVRLFRPANVEQPRLIVYFHGGGWVVGSPETHHTVAALLAADTQCVVASVDYRLAPEYAFPTPCDDAVAAVQWLAASRESLGVHPDFLAVAGDSAGAHLAAAAARVVNEQRRAHIVQAQLLIYPVAAPLLTTESYRAFANGPGLTRDEMAWYWTQFIGAEELAKGAEQDDPRIHLMASPPAMLPPASVVLVAANDVLRDDGLAYANFLVRHDAPVITIEASGMTHGFARLQPDAPRAREWMRRAAEAFTGVFDDL

SEQ ID NO: 71996 - protein, 658 aa, Oryza sativa Japonica Group
MASAAVIPSSAPGAAAAGAAAVESAGWVVDERDGFISWLRGEFAAANAIIDLLLLHLRSVGEPGEFEHVAAAVQQRRHHWAPVIHMQQFFPVGDVAYALQQAGWRRRAPPHHQQQGPGASPSPPPPPPRGRPSFSASHSHHRHGGHHHRSDSVRGGGTGATAGSDKDGREVHNKEEKGMKEAENVVEAKSSQLESLVSHEGEKTPRPQAVAEGSSKVVPTPVEYTVNDIIDGKTVNAVEGLKVYEGLVNENEKNKILSLLNETKASFRRGGLEAGQTVIIGKRPMKGHGREIIQLGIPIVEGPPEDDYPRETKVEAVPGLLHDLFDRLCQKEIIPTKPDYCVIDYYNEGDYSHPHQSPPWYGRPFCTFCLTDCDMVFGRVISGERGDHRGPLKLSLSTGSLLVLHGKSADVAKRAIPAACKQRILLSFGKSLSRKQVPSESVSRFTTPLTPPPMPWGPPRPANMARHSSSPKHFGYAPNSGVLPAPAIGAHHIPPSDGMQPLFVAPAPVAAAAMPFPSPVPLPNSTTAWMAEAAPRSAPQRLPVPGTGVFLPPGSGHALPHQMMTASQSPAEPISSTDSSAYVHNKSTSTMGEMANGDVSPKSSPAKQSDAVEQKPECNGSSNGGSSLVDKKSAVSKEQQNGGMKKVGSNKVQPNAAK

SEQ ID NO: 71997 - protein, 467 aa, Ralstonia metallidurans CH34
MSIGNIVQCIGAVVDIEFPRDAMPKVYDALVLEEGNDKSFAEKGLTFEVQQQLGDGVVRTIALGSSDGLRRGMSVMSTGAPISVPVGHGTLGRIMDVLGRPIDEAGPIEADEKRAIHQKAPKFDELSPSVDLLETGIKVIDLVCPFAKGGKVGLFGGAGVGKTVNMMELINNIAKQHSGLSVFAGVGERTREGNDFYHEMKDSNVLDKVAMVFGQMNEPPGNRLRVALTGLTMAERFRDEGRDILFFVDNIYRYTLAGTEVSALLGRMPSAVGYQPTLAEEMGKLQERITSTKTGSITSIQAVYVPADDLTDPSPATTFLHLDSTVVLSRDIAALGIYPAVDPLDSTSRQLDPQVVGTEHYEVARRVQQTLQRYKELRDIIAILGMDELSPEDKLAVSRARKIQRFLSQPFHVAEVFTGSPGKYVPLKETIRGFKMLVDGECDHLPEQAFYMVGSIDEAFEKAKKLQ

SEQ ID NO: 71998 - protein, 880 aa, Arabidopsis thaliana
MEYHPQAIRLCALIFISFYALLHLVEAQDQKGFISLDCGSLPNEPPYNDPSTGLTYSTDDGFVQSGKTGRIQKAFESIFSKPSLKLRYFPDGFRNCYTLNVTQDTNYLIKAVFVYGNYDGLNNPPSFDLYLGPNLWVTVDMNGRTNGTIQEIIHKTISKSLQVCLVKTGTSSPMINTLELRPLKNNTYNTQSGSLKYFFRYYFSGSGQNIRYPDDVNDRKWYPFFDAKEWTELTTNLNINSSNGYAPPEVVMASASTPISTFGTWNFSWLLPSSTTQFYVYMHFAEIQTLRSLDTREFKVTLNGKLAYERYSPKTLATETIFYSTPQQCEDGTCLLELTKTPKSTLPPLMNALEVFTVIDFPQMETNPDDVAAIKSIQSTYGLSKISWQGDPCVPKQFLWEGLNCNNLDNSTPPIVTSLNLSSSHLTGIIAQGIQNLTHLQELDLSNNNLTGGIPEFLADIKSLLVINLSGNNFNGSIPQILLQKKGLKLILEGNANLICPDGLCVNKAGNGGAKKMNVVIPIVASVAFVVVLGSALAFFFIFKKKKTSNSQESAIMTKNRRFTYSEVVTMTNNFERVLGKGGFGMVYHGTVNNTEQVAVKMLSHSSSQGYKEFKAEVELLLRVHHKNLVGLVGYCDEGENLALIYEYMANGDLREHMSGKRGGSILNWETRLKIVVESAQGLEYLHNGCKPPMVHRDVKTTNILLNEHLHAKLADFGLSRSFPIEGETHVSTVVAGTPGYLDPEYYRTNWLNEKSDVYSFGIVLLEIITNQLVINQSREKPHIAEWVGLMLTKGDIQNIMDPKLYGDYDSGSVWRAVELAMSCLNPSSARRPTMSQVVIELNECLSYENARGGTSQNMNSESSIEVSMNFDIGATPDAR

SEQ ID NO: 71999 - protein, 520 aa, Medicago truncatula
MEPLLLAFTLFLSSLICYIIFQPILNRHKNLPPSPLFKLPIIGHMHMLGPLLHHSFDRLSQKYGPIFSLNFGSVLCVVASTPHYAKQILQINEHAFNCRNESTAIKRLTYEASLAFAPYGEYWRFIKKLSMNELLGSRSISSFQHLRLQETHNLLKLFADKAKNYEAVNVTQELLKLSNNVISKMMLGEAEEARDVVRDVTEIFGEFNVSDFIWLFKKLDLQGFGKRIEDLFMRFDTLVERIISKREELRKNKGRKENKGEQGAEFRDFLDILLDCAEDQNSEIKVQRVHIKALIMDFFTAGTDTTSISTEWALVELMNNPSLLQKAREEIDNVVGKNRLVDESDGPNLPYIQAIIKETFRLHPPVPMVTRRCVTQCKIENYVIPENSLIFVNNWAMGRNSAYWDKPLEFNPERFLKNSTNSNGVIDVRGQNFQILPFGSGRRMCPGVTLAMQEVPALLGAIIQCFDFNFVGPKGEILKGGDIVIDVNERPGLTAPRVHDLVCVPVERFACGGPLQSLGC

SEQ ID NO: 72000 - protein, 516 aa, Streptococcus suis 89/1591
MTKQDVQKIIVLDYGSQYNQLISRRIREFGVFSELKNHKITAEEVRAINPIGIVLSGGPNSVYAENAFDIDPEIFELGIPILGICYGMQLITHKLGGKVVPAGEAGNREYGQSNLQLKTESALFAGTPEEQLVLMSHGDAVTEIPADFHLVGLSADCPYAAIENTERRIYGIQFHPEVRHSVYGNDILKNFAFGICGAKGDWTMENFIETEIEKIRQTVGDKKVLLGLSGGVDSSVVGVLLQRAIGDQLTCIFVDHGLLRKNEGDQVMEMLGGKFGLNIIRVDAAKRFLDLLAGVSDPEKKRKIIGNEFVYVFDDEASKLTDVEFLAQGTLYTDIIESGTDTAETIKSHHNVGGLPEDMQFKLIEPLNTLFKDEVRALGTALGMPDEVVWRQPFPGPGLAIRVMGEITEEKLQTVRESDAILREEIAKAGLDRDVWQYFTVNTGVRSVGVMGDGRTYDYTIAIRAITSVDGMTADFAKLPWDVLQKISVRIVNEVDHVNRIVYDITSKPPATVEWE

SEQ ID NO: 72001 - protein, 71 aa, Arabidopsis thaliana
MSKSEEKQELPLETSPYTKYEDIEDYKKNAYGTSGHQDVKPGHGGGTTDAPTPSGDAAPSAIDSANQKAKK

SEQ ID NO: 72002 - protein, 171 aa, Zea mays
GRVGAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANEEDMPGESMDHTSFIRQWSDYTI

SEQ ID NO: 72003 - protein, 568 aa, Staphylococcus epidermidis ATCC 12228
MDYQALYRMYRPQSFDDVVGQTHVTKTLRNAISKGKQSHAYIFSGPRGTGKTSIAKVFAKAINCLNSDDGEPCNECAICKGITQGTNNDVIEIDAASNNGVDEIRNIRDKVKYAPSESKYKVYIIDEVHMLTTGAFNALLKTLEEPPAHAIFILATTEPHKIPPTIISRAQRFDFKAISSDQIIDRLKYVANSQSLDYDDAALEFIAKASEGGMRDALSIMDQAIAFGDERLTLQDALNVTGSVDEAALNELFNDIVKSDVKAAFNRYHHFISEGKEVNRLINDMIYFVRDTIMNKTSNESVHFESLIHFDLDMLYRMIDIINDTLVSIRFSVNQSVHFEVLLVKLAEMIKTQPQTVQNVATASVANEPDNEMLLQRLEQLENELKTLKEQGIKTNKVSQQPKKPTRTIQRSKNTFSMQQIAKVLDKANKDDIKLLKNHWQEVIDHAKSNDKKSLVSLLLNSEPVAASEDHVLVKFDEEIHCEIVNKDDEKRNNIESVVCNIVNKTVKVVGVPADQWLRVRAEYLQNRNTNETHQSEKQSTQQSQQIDIAQKAKDLFGEETVHLVDED

SEQ ID NO: 72004 - protein, 334 aa, Prochlorococcus marinus str. MIT 9515
MKSYLPNSINNLHKISVAPMMDCTDKHFRMIIRQISSKALLYTEMIVAQSLVYTDKKEKFLNFNKEEHPLSIQFGGDNPQMLKEAAKMAQDWGYDEINFNVGCPSPRVCSGNFGASLMKEPAKVAKCIESLKNNCNLPITIKHRIGVDEEDSFDQLNTFVKEVANAGAERFTVHARKAILKGLNPKQNRTIPPLRYDVVQKLKENNPQLLIEINGGFTNIDQCIKALERLDGVMIGRSVYKYPLRWSQIDNKIYGKNITSKSASEIIFSLIPYIENHLQNGGKTWDICKHLINLVEGIPNAKIWRNQISSRSIKQELSIDALIKLTLELKKLGY

SEQ ID NO: 72005 - protein, 164 aa, Prochlorococcus marinus str. MIT 9515
MNQFLSRRSFILIPAMSILKFFLKPKKVLASSTASEEDWNLSKEEWKNKLSPESYYILREEGTERAFSSQLNNEKRKGIFACAGCNQHLFTSDTKFDSGTGWPSFWDPINGSVETKVDFKLIVPRTEYHCSRCEGHQGHVFNDGPLPTGKRYCNNGLALKFIAE

SEQ ID NO: 72006 - protein, 516 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGSADMKSNGSGEAPSLISLLGRINMEEGEGGELNHKT

SEQ ID NO: 72007 - protein, 431 aa, Oryza sativa Japonica Group
MDHIFSTNAWLTIALVFIITLAAKVVRSSVTLPAEKTSKPRPPPEAKGAPLVGIIPAVLRRGLQAVIREQHRALGSVFTLRSLGLAVTFLVGPECSDHFFHAPELEIAIDGLYEVTVPIFGKEVGYDIDLDTRNEQHRFFAKMLRPAKLRGHVLPMEYFGKWGECGVVDLMQEVDHVLMLIASRCLLGKEVRENMFDEVASLFHELMGGMHLISMFFPYLPTPGHRRRDKARAKLGEIFSQIVKTRKMSGRVEDDMLQDLIDSTYGDGRATTDTEVTGLLVALLFAGHHTSSTVAVWTALRLLTHPEHLRAVRAEQERLVAAAEQQRSHHGGGGGGGIDYGVLLQMDVLHRCIKEALRLHPGHADDPPARAPGLHRARQGRRRVQRPCRAVAGEPPGGQHPPPEHLQGPSRVRPGPVRRREGGGQGRCRRP

SEQ ID NO: 72008 - protein, 487 aa, Staphylococcus epidermidis ATCC 12228
MGEFKGFMKYDKQSLSELSLVDRLSNHEAFQQRFTKEDASIQGARCMDCGTPFCQTGQSYGRETIGCPIGNYIPEWNDLVYHQDFKAAYERLRETNNFPEFTGRVCPAPCEQSCVMKINRESVAIKGIERTIIDEAYENEWVHPAYPEDHKDQRVAIVGSGPAGLTAAEELNFKGYKVTVYEKAHEPGGLLMYGIPNMKLDKDVIRRRVSLMKDAGVLFKTGVEIGVDVSRETLEENYDAIILCTGAQNARDLPLEGRMGSGIHFAMDYLTEQTQYLNGEIESLSITAKDKNVIIIGAGDTGADCVATALRENCKSIVQFNKYTKQPEEITFESNTSWPLAMPVFKMDYAHKEYEAKFGQEPRAYGVQTMRYDVDELGNVKGLYTQILKETPDGMVMEDGPERFWPADLVLLSIGFVGTETTVPHAFDIHTERNKIVANDTNYQTNHAKIFAAGDARRGQSLVVWAIKEGREVAHSVDQYLSKEVLV

SEQ ID NO: 72009 - protein, 495 aa, Pediococcus pentosaceus ATCC 25745
MNQKALFIIFGGTGDLAYRKLYPALFNLYEKGYLKEDFAVIGTARRPWSNDHYHEVVMSAIEDAGRDSGRTNDDLPRKFASHFYYQSHNVDDVDHYVALRKLADELDEKYDLQGNRIFYLAMAPRFFGTIAGHLKDQALLTKGNGFNRLIIEKPFGRDYPSAKELNDSISGSFKEEQIFRIDHYLGKEPIQSIAGLRFGNALFNSLWNKEHIDNIQITLSESLGVEERAGYYETAGAMRDMVQNHIMQIVSLLTMERPDVFDSEHLRDKKIEALENIQMYTKEEAKKYFIRGQYGADEANTQLGYRDEEGTDNQSTVETFVAGKLITHNPSLDGVPVYIRTGKRLTKKSTQINIVFKNDDQNIFAKDASEKLKTNVLTMHIEPDQGFTLEFNTKTGNQGYNLSPVHLRYRKTATEKAQIPDAYEGLIRDALMGNKTNFAHWHEVSQAWKIMDVVREAWDEEEPAFPNYASGSMGPEAAMQLLADDGRKWVFNPRS

SEQ ID NO: 72010 - protein, 227 aa, Triticum aestivum
  misc_feature (174)..(174): Xaa can be any naturally occurring amino acid
MAVDYGSREERWSLAGATALVTGGSKGIGHAMVEELAGFGARVHTCSRNAAELEECRRRWEEKNLQVTVSVCDVSIRGSREKLMETVRETFNGKLDILVNNAGQLLFKPTAECTAEEYSNLMTTNLESSFHLSQLARPLLIHASIAGGGSIINMSSIGGSIGFAGSVIYAITKXDTEYLKKEHSKTPLGRSGKPMEIASAVSFLSMPAASFITGQVICIDGGRTISA

SEQ ID NO: 72011 - protein, 636 aa, Zea mays
MLSTRTAAVAASASPASPWKLGGRSEGGASCDGCRTYRNTLRRRAAPAKVRALPPRRVDAVAMVSNAETETEKEQEEAAAASEELPVMPWATSVASGYTLLRDPHHNKGLAFTEEERDGHYLRGLLPPAVLSQELQIKKFMNTLRQYQTPLQRYIAMMNLQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEFLLNDEFYIGLRQKRATGEEYDELIEEFMSAVKQFYGEKVLIQFEDFANHNAFDLLEKYSKSHLVFNDDIQGTASVVLAGLLAALKMVGGTLAEQTYLFLGAGEAGTGIAELIALEISKQTNAPIEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAGKAYELGLATRLPPPSDLVKYAENCMYTPVYRNYR

SEQ ID NO: 72012 - protein, 764 aa, Acinetobacter sp. ADP1
MSNMQLDTLRRIVQEINSSVSLHDSLDIMVNQVADAMKVDVCSIYLLDERNQRYLLMASKGLNPESVGHVSLQLSEGLVGLVGQREEIVNLENASKHERFAYLPETGEEIYNSFLGVPVMYRRKVMGVLVVQNKQPQDFSEAAESFLVTLCAQLSGVIAHAHAVGNIDVFRKPSNGATYKTFQGVPGSGGIALGRAIVLYPPADLASVPDREAEDISDELQLLDQAVSSVRTEIQQLDEKMQDSLMSEERALFSVFLRMLDENALPAEIKELIRAGNWAQGAVRRVIDKHITLFAQMEDDYLRERVSDLKDLGRRILASLQEADSSHREISPDSIIIGEEISTAALVELPVDNIAAIVTTEGAANSHMVIVARALGIPTVVGVTELPINTLDDAEMIVDAYQGRIFINPPRRMRQRYKEIQKEEEQIAKDLKQYETRDAITPDGVAVRLYVNTGLMIDVVRGVQRGAKGVGLYRSEIPFMLRDRFPGEEEQRAMYRQQLSHFANKPVTMRTLDIGADKDLPYFSIEEENSALGWRGLRFTLDHPEIFSTQVRAMLKASIGLNNLHILLPMVTSVSEVEEVLYLVERDWNAVQEEEQVKITKPKIGIMVEVPSVLLQIDEFSELVDFFSVGSNDLIQYLLAVDRNNPRVSSVYSHFHPSVLRALQRLVKDCHKYEKPVSICGEMAGDPLSAILLMAMGFNTLSMSSSNILRVRKAICHVAMSDAEKLLSEVVKMNNPLMVKSWIEYYFKNHGLGDMVKSNRLVSV

SEQ ID NO: 72013 - protein, 476 aa, Zea mays
MAQPHLVLPSPRPLLPAAATPSRRAVAVRAALSTASPPAKAAAGAEAVRSIRARQIVDSRGNPTVEVDLVAGDGRLHRSAVPSGASTGIYEALELRDGDKAVYGGKGVLQAVRNINEVIAPKLVGVDVRNQSDVDAIMLDIDGTQNKSKLGANAILGVSLSVCRAGAGAKGVPLYKHIQELAGIKEPVMPVPAFNVINGGSHAGNNLAMQEFMLLPVGAATFAEALRMGSEVYHVLKGIIKAKYGQDACNVGDEGGFAPNVQDNREGLVLLMDAIEKAGYTGMIKIGMDVAASEFLTKDGNYDLNFKNQPNDGVHVLSAQHLGDLYRDFVKDFPIVSIEDPFDQDDWSSWASLQSSVGIQIVGDDLLVTNPKRIADAIDRKACNALLLKVNQIGTVTESIQAALDSKAAGWGVMVSHRSGETEDNFIADLAVGLASGQIKTGAPCRSERLAKYNQLLRIEEGLGNVRYAGEAFRSP

SEQ ID NO: 72014 - protein, 283 aa, Medicago truncatula
MEVGMVEQGRERVGHVNKVCYVKRVIAKKRNKPYNHRRVKKHVPKALQELFDSCKQTFKGPGTVPSPRDVHKLCHILDNMKPEDVGLSRDLQFFKPGNIIKENQRVTYTTVYKCDNFSLCIFFLPERGVIPLHNHPGMTVFSKLLLGQMHIKSYDWVDHEASHNLLQPSSKLRLAKLKANKTFTAPCDTSVLYPTTGGNIHEFTAITPCAVLDVIGPPYSKEDGRDCSYYKDYPYNAFPNEEKIGEVKDKDDSYGLLEEIDMPENCQMDGIEYLGPPIDDTMF

SEQ ID NO: 72015 - protein, 484 aa, Shewanella sp. ANA-3
MKFKQDFFTQLPEFYAQVYPQGISNPHWLAWSEDAAKLIDLQQPTDVLLKGLSGNAAVEGASYYAQVYSGHQFGGYTPRLGDGRSIILGEALGPQGAWDVALKGGGPTPYSRHGDGRAVMRSAVREFLVSEALHHLGVPTTRALAVIGSDMPVWRESQETAAITVRLARSHIRFGHFEFFCHSERGQADKLTQLLNFTLKQHYPHLSCDLAGYKAWFLQVVQDTAKLIAHWQAIGFAHGVMNTDNMSILGDSFDFGPFAFLDTFQEYFICNHSDPEGRYAFGQQPGIGLWNLQRLAQALTPVIPSDDLIAALNQYQHALVQHYLMLMRAKLGLAERADSTAEQDQQDLELIGRFTVLMEKNQLDYSNTWRRFGQLDPSSAHSSLRDDFIDLNEFDVWYQAYQVRLGKVTDVEAWQQARNSVNPKYILRNYLAQEAIIAVEEGNLAPLERLHQVLRQPFAEQVEHEDLAKRPPDWGQGLIMSCSS

SEQ ID NO: 72016 - protein, 534 aa, Vitis vinifera
MGACLSATKVRSSNSNTTANAAATKNTRPRGSSKTSNKNQQKKPQEGDRNRSNQQHRNPQPQKAKDFDARYTIGKLLGHGQFGYTYVATDKANGDRVAVKRIEKNKMILPIAVEDVKREVKILEALTGHENVVQFHNAFEDDSYVYIVMELCEGGELLDRILAKKDSRYSEKDAAKVVRQMLKVAAECHLHGLVHRDMKPENFLFKSTKEDSPLKATDFGLSDFIKPGKKFQDIVGSAYYVAPEVLRRKSGPESDVWSIGVITYILLCGKRPFWDKTEDGIFKEVLKNKPDFRRKPWPTISNGAKDFVKKLLVKDPRARLTAAQALSHPWVREGGDASEIPIDISVLSNMREFVKYSHLKQFALRALASTLDDEELADLRDQFDAIDVDKNGSISLEEMRQALAKDLPWKMKESRVLEILQAIDSNTDGLVDFTEFVAATLHVHQLEEHDSDKWRQRSQAAFDKFDVDRDGFITPEELKLHTGLRGSIDPLLEEADIDKDGRISLAEFRRLLRTASISSRQVPSSSGFRNPRKI

SEQ ID NO: 72017 - protein, 494 aa, Photorhabdus luminescens subsp. laumondii TTO1
MKRLHDIEKEMLPVESYKMLIGGQWVDSVSKATTKSYNPATGELLAEYASGNAEDVDLAVSAAKKAFHAWSQTSAIERQSALLKIADLLEAEQKRFAILESLDTGKPLNESLYMDLPASIDQFRYFAGVIRSHTDEASVLDTNTLSLVIREPIGVVGQVIPWNFPLLMAAWKLAPALAAGNTIVINPATLTSITLLELGRILDKVLPAGVVNIVTGRGSVVGQAILDHEDVEKVAFTGSTKVGYTVAEAAAKKLIPATLELGGKSANIIFPDANMKKAVKYAAKAILLNQGQACESGSRLFLHKDIHDEFLKSLKTEFESIQVGDPLEKETQMGSQVSQEQMEKILEYVEIAKKEGATIFTGGKRITEKGYDEGFFIQPTIITDVTNDMRVAREEIFGPVLAVIPFSEEEDVIRMANDSDYGLAGAVWTQDIDRALRVAKAVRTGRMWINTYHELPAHAPFGGYKKSGIGRETHKMMLDAYTQVKNIYIKTSEE

SEQ ID NO: 72018 - protein, 162 aa, Coccidioides immitis RS
MVVFSLVIINKAGGLIYQREFQAGLQKLSTNDYLVLAGTFHGVHAITRSLTPRIATGSPSTSTSTSSTTPTTHSTLPNPGLPKTGLEVLETEKFRLTCFQTITGTKFLLFTDPLMPNVDTLMRKVYELYADYVMKNPFYQIEMPVRCEAFDRHLGTWLRSRG

SEQ ID NO: 72019 - protein, 819 aa, Anabaena variabilis ATCC 29413
MVTVSQNTLAKCSQEESLVLWLDKVGIKDIALVGGKNASLGEMIQQLTPKGVNVPTGFATTAYAYRYFIQSAGLEAKLRELFADLDVEDVRNLQERGLKARSLLMHTPFPVELQQAIASAYESLCKQYNPDTDVAVRSSATAEDLPDASFAGQQETYLNVVGAEEVLAACHKCFASLFTDRAISYRHTKGFDHFSVALAVGVQKMVRSDLATSGVMFSIDTETGFKDAALITAAYGLGENVVQGAVNPDEYCVFKPTLKAGFKPIIDKKLGSKELRMVYDEGSQSTKNEAVSIVEQNQFALNDADILQLAHWACLIEDHYSQAHGSYTPMDIEWAKDGITNQLFVVQARPETVQSQKNGNVLRSYRLGLGTGEKTQNISLLPLVTGRAIGEAISQGKARVILDAKQIEEFQAGEVLVTERTDPDWEPIMKRASAIITNSGGRTCHAAIIARELGVPAIVGCGNATQVLTTGQEVTVSCAEGEEGKVYPGLLPFEVKEVPLENLPRTHTQILMNVGNPQEAFSLSAIPNDGVGLARTEFIIANQIQVHPLALIHYDKLADAEQKAKVAAITATYEDKPQYFVDKLAQGVGRIAAAFYPKPVIVRMSDFKSNEYRNLAGGSQFEPDEENPMLGWRGAARYYDPGYREGFALECHAIKRVRDEMGLTNVIPMIPFCRTPEEGRLVLAEMAKHDLKQGVNDLQVYVMCELPSNVILAEQFAEVFDGFSIGSNDLTQLTLGLDRDSALVARLFDERSPAVKQMVKMAIASAKKQRRKIGICGQAPSDYPEFAQFLVEEGIDSISLNPDSVLKTMLEIAKVEQQS

SEQ ID NO: 72020 - protein, 340 aa, Prochlorococcus marinus str. MIT 9515
MTLRVAINGFGRIGRNFMRCWLSRGSYTNIEVVGINVTSDPKTNAHLLKYDSVLGKLDGVDIQYTDDTFVINNKTIKCFSDRNPMNLPWKDWGVDLVIESTGVFNTDVGASKHLEVGAKKVILTAPGKGSGVGTYVVGVNADQYNHSDYDILSNASCTTNCLAPVVKVLDQTFGINKGLMTTIHSYTGDQRILDNSHRDLRRARAAATNIVPTSTGAAKAVALVYPEMTGKLTGIAMRVPTPNVSAVDFVFESSKSVTSEEVNNALKESSLSSMKGIIKYGDEPLVSSDYAGTNESSIVDADLTMSIGDNLVKVLAWYDNEWGYSQRVVDLAEIVAKKWE

SEQ ID NO: 72021 - protein, 560 aa, Triticum aestivum
  misc_feature (290)..(290): Xaa can be any naturally occurring amino acid
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVAKNKETGWDVPIHVDAASGGFIAPFLQPELEWDFRLPLVKSINVSGHKYGLVYPGVGWVIXWRSKADLPDELIFHINYLGTDQPTVTLNFSKGVQAHHGELQAERGGAQGGHRRDGAVRRAVQGGRRAAGGHQAQGQHQLQRVRHLGEPEAVRVDRAGLHHAGGRGARGRPPHRHPGGLQPEPRAAAPHRHQQDRGRAGRARRPRHQAVHRRRRRGRVQEHRGRRHRGLQGPGREQEGRSLLKAGRGRACLLRRLVHSFITCLCCIILHCVIIVEGCICELSGPASSVFCTAYVRGLHSPFRPCWRLVLHRTPLHRGHYVSVVCFSCLSER

SEQ ID NO: 72022 - protein, 250 aa, Yersinia pestis KIM
MATPPLCSHDQESRMSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 72023 - protein, 376 aa, Paracoccus pantotrophus
MKMKAAVLFEQGLPAPYAISQPIQIEEVELDGPGEGEVLIEVVAAGLCHSDLSTIENLRPRKVPTVIGHEAAGIVREVGAGVRRLKVGDHVVATFVASCGCCRYCIDHRANLCTASWTSRAEGTLQSGARRLKFGKGDLHHYTGLSTFAEYAVVSESSLVSIRKDVPLEVAALFGCAVVTGVGAVFNTAALRPGQSAAVVGLGGVGLNALLGAVAAGAYPVIAIDMNPEKLELAKSLGASHAVLASDPNMAEQVKDLTNGGVDFAFEAAGSIPAVHTAYQCLARGGTVISSGLPDPTKTYAYNHAPLVSDEKSIRGSYMGGCDPRRDVPRYLNLYLAGKLPVDRLRSGDLTFEQINQGFDALALGKVVRQTLRPHQ

SEQ ID NO: 72024 - protein, 518 aa, Paracoccus pantotrophus
MPSPLARWCARPCARINKPLRNMEKKMTTQYKLYIDNQFVAPDGDDYFPAVNPYTGETHAMVPQASDAQVAAAVAAARRAYETVWSKTNGLERAKLMIRLADLLEANAERMGILETTDNGKVIRETGAQMLFAARAYRFFAGTADKIFGQTIPLDQKDVFDFTRREALGVCVLITAWNSPMGLLSNKLAPALAAGNCVIIKPSEHASCTTLEFAKLVDEAGFPPGVINIVTGDYRVGQALTRHGRVDRVSFTGSPEVGRKIAADAGERLIPVTLELGGKSPNIIFEDADLDKAVVGALAGIFAATGQTCIAGSRLLVQRGVYDEVVRRLAERAKTIKLGNPLDKTTEMGTAANEPQFKRILGKIDAAKAEGATIVTGGKAASGDGLEKGFFIEPTIFRDVSNKSELAQEEVFGPVLAVIPFDTEEEAVAIANDTKYGLASGVWTTNLSRAMRMVRAINAGTVWVNTYRAAQVMAPFGGFKDSGFGKERGVMALEEFLQTKNVMIDFSLEERDPFALKM

SEQ ID NO: 72025 - protein, 249 aa, Xylella fastidiosa Temecula1
MRPKIVAGNWKLHGSHAFAQALVAQVAAGLPLPGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 72026 - protein, 193 aa, Pediococcus pentosaceus ATCC 25745
MNLPNKLTIFRIILIPIFIILTVMPEVGGSVVWLGTSIAVTKIWGALVFAIASITDFLDGQIARRQHLVTNFGKFADPIADKMLVMTAFIVLVEMKMVPAWIAAIIVCRELAISGLRLIIVENDGEVLAAEMPGKIKTFSQMFAIIFLLLNNIFSSFLHFGLGTVLLYVCLFFTVYSGIDYFYKNRAIFSDSF

SEQ ID NO: 72027 - protein, 798 aa, Bacillus sp. KSM-LD1
MGKRLPKIFINLMVLSLIISMFAFGASANGGKQVEVKELPLAELFGEIELSSSKPTTVIVELQAESIVEAKHKGKSQSKGKLKAERDKVISSLQGKVSNAKVNREYDHVFSGFSVELPANEIIQLLATPGVKAVYPNVHYTADVISAEEISAETFSPAMMESAPFIGSNDAWDAGFTGEGVTVAIIDTGVDYTHPDLAHAFGDYKGFDFVDDDNDPQEGPGQYHGTHVAGTVAANGGIKGVAPEASLIAYRVLGPNGGTTEDVVASVELAVQDGVDVMNLSLGNTLNNPDWATSIALDWAMAEGVVAVTSNGNAGPNNWTVGSPGTSRDAISVGATQLPYNVYTSVISTSEGVSYPSAKVMGFPSDEELLALNEGEYEFVYVGLGAVSDFEGKDLDGKIALISRGEFAFVDKATNAKNAGAVGAIIFNNVAGEQPDVPGMAVPTIKTTLADGQKLLAELEAGNNTVSFNIEFDKAVGETMADFSSRGPVTLTWMIKPDVSAPGVNIVSTFPGEGYAALQGTSMASPHVAGAAALLLQAHPNWGTEDVKAALMNTAEDMINPATGKVYPHNTQGAGSIRVLDAINTKTLVAPGSHSFGKFVKESGKQVERQSFEIKNLSKERKRYSFDVQFDGNPTGIKVMTSNNLQVQPGKTQQVNFNVQVDTSKLEPGYYEGTITVSDGTQSIEVPTILFVGEPDYPRVTGAFMGKEADGSYYVGSYLPGGAEVIEYDIYVLGPGNTIGGFVDTIGSFENVSAPIHEFNWDGTVQNGIDLANGDWVLGVYVEKAGVTEYKAYLVTKN

SEQ ID NO: 72028 - protein, 359 aa, Acinetobacter sp. ADP1
MSKQILILAGDGIGPEIVGAAEQVLTKVNEKFELGLTWEHGLLGGSAIDAHGEPYPAVTSEQAKKADAILLGAVGGPKWDTIERSIRPERGLLKIRSELNLFANLRPALLYPQLADASSLKPEIVAGLDILIVRELTGGIYFGQPRGIRELENGEKQGYNTDVYSESEIKRIAKVAFELAALRGSKVCSVDKANVLEVTELWKQTVTELQQAQYPNIQLSHMYVDNAAMQLVRAPKQFDVIVTGNLFGDILSDEAAMLTGSIGMLPSASLDENGKGMYEPCHGSAPDIAGQNVANPLATILSVAMMLRYTFREEAAAKAIEDAVGQVLDQGLRTADIMSEGMQRVGTVEMGQAVVAALA

SEQ ID NO: 72029 - protein, 184 aa, Picea sitchensis
MEAVAAFTIRMPTAPQSLISPPRKANLPAAQSLRWRVRNPSPSSSRRTGALTISASVENSSSSKKAVPNSNYVVPLDIPPASSCITRPLAEILRDLNKRVPDKVVKGDGAVEANYIPWYHANRMLSFFAPGWCGELRNVIFSADGRSVSVVYRVTIRGSDGESTDYSSTRWNIDVTQVGFQPPY

SEQ ID NO: 72030 - protein, 317 aa, Bacillus clausii KSM-K16
MGYSIDKKKFKLFTVHSNPLLTNEIASLLGCAVGKSSVKRFSDGEVQINIEESVRGSKVFVVQSTSQPGNEHVMELLIMIDALKRASAKEINVVIPYFGYARQDRKARAREPIAAKLVANLLETAGADRILTVDLHAPQIQGFFNIPVDPLQGLPLLARYFLNKALKQPVIVAPNHSGLGRARRLAEYLDAPIAFIDKRHPEPGFPQAVNVVGDTEGREAIIVDDLIDTAATVTLAANALQENKVSAIYACCTHPVLTGPAIERLQMAPIKEIVVTNTIELDDDKKVGNLTVLSIAPLLAEAIYRVHREQSVSTLFQ

SEQ ID NO: 72031 - protein, 747 aa, Bacillus sp. KSM-LD1
MNSCRQFLIISIAVALFFSITQRTYAFQYPERPPLPVSQPISDEETQTVIIRTDEEMHEAIQQIIETQYPTLSIKYTYTEVFHGYSIEGPVLELEKLQKEEGILDVSPVSIYNPHIDESVPFIGGREIRGIFDEDGDRLTGEGVVVGIIDTGIDYTHPDLASNYIGGYDFVDQDDDPMETKREQGPPTLHGTHVAGIVAANGKMMGVAPEAKIMAYRALGPGGNGTSEQVIAAIERAIKDGVDVLNLSLGNTINGPDWPTSLALDKAVEKGIVAVTSSGNSGPNLWTVGSPGTSTKAISVGASTPPLHIPHIATIFSSEEVEMLPFQGAPKWNLKQAKYYEMEFVGLGEKKDIKDVEGKVVLIERGKIPFTEKVLNAKEQGAIAVIIYNNLEGTFLGGLEMEVGIPVVSISKSDGVFLKNQLKKKRKLMKTKYRWHRDEIASFSSRGPVTHTWEIKPDLVAPGVAIDSTVPNGYIALQGTSMAAPHVAGAAALLKQAHPDWEPSKIKAALMNTTKVLKKGDGEFYSVLEQGTGRIQLKDAMETKSIIQPGSLHYGIYEKMDKREKKDVILQLENVSEKEVKYRFDIPKANKGIIWSIPPSFSLKPGEKKEVTVSLDINPEKLEPGMHEGQITVKADGQEIRLPYLFMIEEPNYPRIQGFQFGYGDKEGSYQYEVFVPEGAEELGIALYEGDTLHFIDFLDWQRDVPRGLLRKEISGEKLKGKGLVKAVIFAKRKDKEDSIEVDLYFD

SEQ ID NO: 72032 - protein, 231 aa, Oryza sativa Japonica Group
MSAAPIPREWVGLQQFPAATQTKLHELLGKLKEENVSTLTILVMGKGGVGKSSTVNSIVGERVATVSAFQSEGLRPMMCSRTRAGFTLNIIDTPGLIEGGYINEQAVEIIKRFLLGKTIDVLLYVDRLDAYRMDTLDDQVIRAVTNSFGKAIWRRTLVVLTHAQLSPPDGLDYNDFFTKRSESLLRYIRAGAGVSKRELGVMYTSLVFYMGIIGISRFFFFFCNLSAASSV

SEQ ID NO: 72033 - protein, 339 aa, Escherichia coli
MSVLVTGGAGYIGSHTVLTLLQKGIDVIVIDDFSNSSLESLERVKKITNRDIKVYKGDVADLRLLNLIFSNHDIHTVIHFAGSKSVGESISKPIHYYNNNVVASLVLINEMMKRGIYNLIFSSSATVYGNSNTMPVTENAPIGMTTNPYGTSKLMIEKILDDVTRANSSFRVTVLRYFNPVGAHFSGEIGEDPNGIPNNLMPYVCQVAIGKYKQVSVYGRDYPTKDGTGVRDYIHVMDLAEGHVAALEHRNEGPNHKVYNLGTGKGYSVLDLLTTFERVTFRSVPYVLSERRPGDIAECWSDPSKAYRELGWKAKRGLEEMVRDAWNWQQKNPNGYIKA

SEQ ID NO: 72034 - protein, 774 aa, Medicago truncatula
MVSVFFVLVTILLSINHSEQLQSSHTQTLLRIQQQLNFPSALSNWNNSTDFCNTDSNSSLTVVCYEDTITQLHIIGEGKTPPLPKNFSIDSFVTTLVKLPSLKVLTLVSLGIWGPLPGKIARLSSLEIVNMSSNHLYGSIPVELSSLLNLQTLILDDNMFSGQVPTVSALTVLSLKNNLFNGSLPNSVSNLENLRIISLSHNKLYGVVPDLSHLRNLQVLELDDNAFGPQFPKLGNKLVTIVLRNNMFRSGIPADVSSYYQLERFDISSNTFVGPFQPALLSLPSIAYLNISRNKLTGMLFGNLSCNSELEVVDLSSNLLTGSLPKCLVSNSIDRTVLYARNCLETTKQNQQPPPSCHTEALAVGILPDRKKKKQVSKVVLALGIVGGTLGGVALVLLILFIVRRGNARSKMKNPPTRLISENAASGYTSKLLSDARYISQTKKFGALGLPTYRSFSLEEIEAATNNFDTASLMGEDSYGEMYRGQLKNGSIVVIRCIKMKKRYSTQNFMHHMELISKLRHRHLVSALGHCFKCSLEDSSVSKIFLVFEYVPNGTLRSWTSDGHTGRSLNWTQRIGAAIGVAKGIQFLHTGIVPGVYSNNIKIEDILLDHNLVAKISSYNLPLLSNIGKVRRGNSSDGSKHSSINKRGKHEDKCDIYDFGVILLEIILGRTIKTTNDAEAFKDLLQTSLGADEDARRSIVDPAIRKACLEQSLKTMTEICVRCMIKEPAERPSIEDVLWNLQFAAQVQDAWRGDSQSSEGSPGSPLGPQRTAFH

SEQ ID NO: 72035 - protein, 520 aa, Staphylococcus aureus subsp. aureus MW2
MAYFNQHQSMISKRYLTFFSKSKKKKPFSAGQLIGLILGPLLFLLTLLFFHPQDLPWKGVYVLAITLWIATWWITEAIPIAATSLLPIVLLPLGHILTPEQVSSEYGNDIIFLFLGGFILAIAMERWNLHTRVALTIINLIGASTSKILLGFMVATGFLSMFVSNTAAVMIMIPIGLAIIKEAHDLQEANTNQTSIQKFEKSLVLAIGYAGTIGGLGTLIGTPPLIILKGQYMQHFGHEISFAKWMIVGIPTVIVLLGITWLYLRYVAFRHDLKYLPGGQTLIKQKLDELGKMKYEEKVVQTIFVLASLLWITREFLLKKWEVTSSVADGTIAIFISILLFVIPAKNTEKHRRIIDWEVAKELPWGVLILFGGGLALAKGISESGLAKWLGEQLKSLNGVSPILIVIVITIFVLFLTEVTSNTATATMILPILATLSVAVGVHPLLLMAPAAMAANCAYMLPVGTPPNAIIFGSGKISIKQMASVGFWVNLISAIIIILVVYYVMPIVLGIDINQPLPLK

SEQ ID NO: 72036 - protein, 128 aa, Picea sitchensis
MAFRNALLNHIRVNVNQGRPTLRVVGWGSWSNVSRWMSSEGSSGSFLDKDEVTERVLSVVKSFPKIDPSKVNPNVHFQKDLGLDSLDTVEIVMALEEEFAMEIPDKEADKIDSCSLAIDYIASHPMAK

SEQ ID NO: 72037 - protein, 542 aa, Arabidopsis thaliana
MASKSDVNIIETSSKVHFSGFHQMDGLASNRPEQMAEEEEHGQPFVIGESRGVAGGAASGKTTVCDMIMQQLHDQRAVVVNQDSFYHNVNEVELVRVHDYNFDHPDAFDTEQLLSSMEKLRKGQAVDIPNYDFKSYKNNVFPPRRVNPSDVIILEGILIFHDPRVRDLMNMKIFVDAGLSHTKPVNTYVVKSVAYMRRCTCICTHEDADVRLARRIKRDTVEKGRDIATVLDQYSKFVKPAFEDFILPTKKYADIIIPRGGDNHVAIDLIVQHIHTKLGQHDLCKIYPNLYVIQSTFQIRGMHTLIRDSKTTKHDFIFYSDRLIRLVVEHGLGHLPFTEKQVVTPTGKLMKKIIPYYNLGEELSNHRSVYSGVDFCKKLCGVSVIRSGESMENALRACCKGIKIGKILIHREGDNGQQVCVLSLLITSPNYLLTTNGTHQLIYEKLPSDISERHVLLLDPILGTAGNSAVQAIRLLISKGVPESNIIFLNLISAPEGVNVVCKKFPRIKIVTSEIELGLNDEFRVVPGMGEFGDRYFGTDDE

SEQ ID NO: 72038 - protein, 636 aa, Medicago truncatula
MIVEVGNGEEGGGRFRGFGSLIRRKQVDSIHYRGHPQLARKLSVVDLVGIGVGATIGAGVYILIGTVAREQAGPALVISLFIAGIAAALSALCYAELACRCPSAGSAYHYTYICIGEGVAWLVGWSLILEYTIGASAVARGITPNLALFFGGQDNLPSFLARHTLPGLGIVVDPCAAVLIVLITLLLCLGIKESSTVQSIVTTINVSVMLFIIIVGGYLGFKAGWVGYELPSGYFPYGVNGMFAGSAIVFFSYIGFDSVTSTAEEVKNPQRDLPIGISTALAICCVLYMLVSAVIVGLVPYYELNPDTPISSAFSSYGMEWAVYIITTGAVTALFSSLLGSVLPQPRVFMAMARDGLLPTFFSDIHRRTQIPLKSTIVTGLFAAVLAFFMDVSQLAGMVSVGTLLAFTTVAVSVLIIRYVPPDEIPIPASLLTSVDPLLRHSGDDIEEDRTVSPVDLASYSDNSHLHDKSDVLLEHPLIIKEVTKEQHNEKTRRKLAAWTIALLCIGILIVSGSASAERCPRILRVTLFGAGVVIFLCSIIVLACIKQDDTRHTFGHSGGFACPFVPFLPAACILINTYLLIDLGVDTWLRVSVWLLIGVLIYLFYGRTHSSLLNAIYVPSARADEIHRSQANHLA

SEQ ID NO: 72039 - protein, 368 aa, Synechococcus sp. RS9916
MSLLQNLRRRLNTGPVMQDWPGLIEAYRSWLPVSNTTPVVTLREGATPLIPVPAVAERIGKGVKVYVKYDGLNPTGSFKDRGMTMAISKAKEEGCEAVICASTGNTSAAAAAYARRAGMRAFVLIPDGYVAQGKLAQALVYGAEVLAIRGNFDRALDIVREAAEKYPVTLVNSVNPYRLQGQKTAAFEVIDALGDAPDWLCIPMGNAGNITAYWMGFQEYHQAGRSRTLPRMMGFQASGSAPLVNNTTVDDPNTIATAIRIGNPVNREKALAAREASNGAFLDVTDAEIVAAYKLLGGEEGIFCEPASAASVAGLLKRKDEVPAGATVVCVLTGNGLKDPDCAINNNDAAFHTDLAPDLGTVAKVMGF

SEQ ID NO: 72040 - protein, 293 aa, Prochlorococcus marinus str. MIT 9515
MIDLASPLTIKNKFVIFGGGFSGDYFAKSIRKLGCTALTSSRSANNDPNSFIFNSENNLLPEDSILDGVTHILSCIPPDKNGNDPVLKSLKNKINNLSVKWVGYLSTTGVYGNTHGDWVSEKDEPNPLQQRSQRRLNCEKEWIHSNLPIQIFRLPGIYGPGRSTLEAITTKKIKVIHKDNQVFSRIHVADIANAIIYLIQNKNKLDFHQIINIADDEPCSQIEVIRYGYQLLGLRMPKKILFEEAKKDLSPIAQSFWLENRRVSNKLLCEELGYKLIYKNYQVGLDNCLINIK

SEQ ID NO: 72041 - protein, 245 aa, Brucella melitensis 16M
MKFEFENRTLVLTGANGGIGRAIAELFHASGANLVLTDLDREGLDAFAASLGSPERIATIKADASSADDAEKTVALAMERFGGIDFLVPSVGIYQAKPFAEMSDADWHRTISINLDGVFYLCKRALPALKEDSSIVTLASLAAYRGAYVNAHYGATKGAMVSMTRALSRELAPKTRVNGVAPGIIETPMTSELLKTRMDETMTQTPLKRLGKPSEIASVIAFLCSPAASFVTGETIQVNGGIYMA

SEQ ID NO: 72042 - protein, 462 aa, Streptomyces avermitilis MA-4680
MKAQDGMYIDGAWRPAAGPDMIEVVNPADEQVIGRVPAGTPEDVDAAVRAARAALTAWAATPPAERAARISALRDVLVARQDEIAETVTAELGSPLSFSQSVQVGLPILVAGSYAELAATYAFEERVGNSTVHHEPVGVVGAITPWNYPLHQIVAKVAPALAAGCTIVLKPAEDTPLTAQLFAEAVHEAGVPAGVFNLVTGLGPVAGQALAEHEDVDLVSFTGSTAVGRQIGATAGAAVKRVALELGGKSANVILPSADLAKAVNVGVANVMANSGQTCSAWTRMLVHAERYEEAVELAAAAAVKYADRIGPLVNAKQRARVRGYIDKGVAEGARLVAGGPESTEPQGYFVSPTVFADVTPEMTIAKEEIFGPVLSVIRYEDEEEALRIANGTVYGLAGAVWAGDEAEAVAFARRLDTGQVDINGGRFNPLAPFGGYKQSGVGRELGAHGLAEYLQTKSLQF

SEQ ID NO: 72043 - protein, 302 aa, Staphylococcus epidermidis ATCC 12228
MIAYDLIGQTPLVLLESFSDENVKIYAKLEQFNPGGSIKDRLGKYLIEKAIDEGRLKEGDTIVEATAGNTGIGLAIASNRHKVKCIIFAPEGFAEEKISIMKALGADVRRTPKAEGMTGAQQEALAYATRYGYLYMNQFETKDNPGAYTQTLAKQLTDELSHIDYFVAGVGSGGTFTGVAQHLKTYDVKNYIVEPEGSVLNGGVSHPHATEGIGSEKWPSFLEKELVDGIFTVADKDAFNNVKLVANKEGLLVGSSSGAALQGALELKKSIQNGVIVTIFPDGSDRYMSKQIFNYKESFNNE

SEQ ID NO: 72044 - protein, 386 aa, Guillardia theta
MAYFKAVAYLAALASAAAFNPGSSFVPRLNAPATQPKAAKMTGPTMQAVPCGINGFGRIGRLVARIMIKDPETKLLQVNAGSATPDYMAYQFKYDSIHGRYQGDVVVDGDDLVIDGQRVITTRARDPKDIGWAKTGVEYLCESTGVFLTAEKAQPHIDAGVKKVIFSAPAKDDSLTVVMGVNAEDYKGQTDFISCASCTTNGLAPLVKCINDKWGIEEGLMTTIHAMTATQAVVDSSSRKDWRGGRAASGNIIPSSTGAAKAVAKVIPAVKGKLTGMAFRVPTIDVSVVDLTCRLAKDATYEEICAEVKRRANGDMKGFLGYTDEPLVSTDFETEPISSTFDAEAGISLNPRFVKLVAWYDNEWGYSNRVKDLMVHVAKVDAKVKA

SEQ ID NO: 72045 - protein, 359 aa, Streptomyces avermitilis MA-4680
MVRAAVLPAVGAPLEITGIELPEPGPGQVRVRLAAAGVCHSDLSLSDGTMRVPVPAVLGHEGAGTVVSVGEGVTQVSPGAGVVLNWAPSCGRCHACSLGEVWLCADALTGAGTVYARRTDGSDLYPGLNVAAFAEETVVPAACVLPVPDGVPLTDAALLGCAVLTGYGAVHHSAKVQPGETVAVFGVGGVGLATLQAARIAGASKIVAVDVSPEKESLARRAGATDYLVASENTAREIRGLTDKQGVDVAVECVGRAVTIRTAWDSTRRGGRTTVVGIGGKDQQVVFNALEIFHWGRTLSGCVYGNSDPAKDLPVLAEHVRAGRLDLGALVTERIALDGIPAAFDNMLAGKGGRALVVF

SEQ ID NO: 72046 - protein, 717 aa, delta proteobacterium MLMS-1
MKKTALLLLLAVLVVLFFVFELDQLLTLEALKHGQERFAVWRAEAPWLVGGGFFLLYVVVTALSLPGAAVMTIAAGALFGLLTGTILVSFASTMGATLAFLVARFLLQDMVQQRFGDRLAAINRGVERDGAFYLFTLRLVPIFPFFLINLVLALTPIRAFTFYWVSQLGMLPGTLVYVNAGTQLAAIERAGDIMSPGLIGSFALLGIFPLLAKKVVAMVQRRRVYAGWRRPRRFDRNLVVIGAGAGGLVSSYIAAAVKAKVTLVEAHKMGGDCLNYGCVPSKSLIRSAKLAYQCRHADRYGLRPQSEVVDFAAVMRRIKTNIATIAPHDSVQRYQGLGVEVLLGHGRLVDPWTVEVSLNGGGSRRLSSRNIIIAAGAEPAVPPLPGLDEVGYLTSDTLWEEMARLHRPPRRLLVLGGGPIGCELAQAMARLGSQVTQVLRGPRLLPKEDGEVAELARQALEESGVTVLTEHKPLRCEFQGAERVLVVEQTGGEQTLPFDALLLAAGRRARLQGYGLEELGVPVDGTVTVNDYLETRYPNILAVGDVAGPYQFTHTAAHMAWFATVNALFGQLRRFRVDYSVIPWCTFVDPEVARVGLNEQEAQKQGVAYEISRYELSELDRAITDGAEQGFVKVLTVPGKDKILGVTIVGAQAGELLAEYVLAMKHGLGLNKVLGTIHSYPTMAEANKYAAGVWKKAHAPQKLLALLERYHTWRRRR

SEQ ID NO: 72047 - protein, 387 aa, Prochlorococcus marinus str. MIT 9515
MAIQQKLSLMIPGPTPVPEKVLEALGRHPIGHRSKDFQDLVEITTKNLQWLHQTKNDVLTITGSGTAAMEAGIISTLSKGDKVICGENGKFGQRWVKVAQEFGLEVIKIDAKWGSPLDPENFKKILEKDYKKEIKAVILTHSETSTGVINDLKTISSHIRNHKKALSIIDCVTSIGACDVPVDEWELDIVASGSQKGYMIPPGLSFVSMSQKAWKASEASNLPKFYLNLKSYKKSLSSNSNPYTPAVNLVFALNEALNMMKDEGLDSIFARHKKHRLAVSEAAKTLNLQLFADENHLSPSVTAIQIKDIDAEQFRKTIKTKYDILLAGGQDHLKGKIFRVGHLGYINDRDVISVIAAIGNTLVELNKISTEQVGEALKIASFHLKVT

SEQ ID NO: 72048 - protein, 1284 aa, Bacillus sp. KSM-LD1
MKKGSFKKFFSSLLIITVILSTFLSPAAAFATDSPTKKTTVDEQTLQMKKIIAQQESLLEQTPTLDQSLQNLKGDEEVSVIVQLSEPPVALVKGKSEVEGKSFSASQAKAVEKKVVSQQVAFEKSLSTKKVKYSKGFTYNKVFNGMSLTVKASELEALLSVEGVVSVELDEERYALETPSKDGKVDALMTDSTPHLGVPELWDLGYEGEGVKVAVLDTGIDYYHPDFADVYRGGYNFIPHSGNDYARDRADDDGYETSPLDRPDHRPEFNANGSSFYTSHGTHVAGTIVHLAPKIDLYSYRVLGAYGSGATAGIIAAIEKSVEEEMDIINLSLGGSSNSETAPDAIAINNATLAGVTAVIATGNSGPGRGTIGNPASSAFAISVGNSTVPEMHLSSSVTVEAGEYSKTDTLPMFGWTYQEDPRDTLTGTYDLVAIPGVGNPSDFEGIDVEGKVALISRGEIAFVDKIAAAKDAGAVATIIHNNVAGAGPANIYLSTDYGFIPTFDMATADGQALREALGSELGQVTFGDYDETMTEGDDVNSSSSRGPTNPNFDIKPDVVAPGTNIMAAIPAYEKDYPGADYEYAYGRKTGTSMATPHVAGVAALLKQVNPEWTPFDMKVAISNTAKQLNVSQYDVFAQGPGRIQPVAAAFPEALAYAYDETEFEGEVHENVKGTVTFGKVEPNAQSAQTVTKQVVVKNMGESTSDFNVTVQTTKSGTGDMSAANVEVDVTSFTLSDEQVLNVTLNVPAGAGALGNELLGYIHIQSATSKLLLPFAVEFSGEVPNGLGYYFLESDVISPNGDGVLDTTRLAFQLLNNHGTNYIELWDAQNPEGGYYGDGYVGYFHAGESLGAGSYTLTINGVYRDWADGAQKMAEDGVYTVDFTGANPVAGVTFDWAPLIIKTSNAEVEFGDLGEYQPGEEFEVSGTVVDSFVDYKSTVENVLGLDYDVNDQLTVEYVLLDADGEELDSASVELDQEGNFVLSLPSLPVGENELTLSVGDVAGNSSEHVLDLTVEAPNSPHYDEAVWYESVNNFFNAVYFAGLALLDGDSRAESLLETVSVELLNEANTQLAEGDFTTAEYSYQLLVETEGVPQAVKEEAASKIAVKSEEFAIALWYESLGNYYNAVYFAGQAIEAGDARVGALMANVAEALLAEANELLANGNFTEAEFAYQLLVETTGVPQDVKEEAASKLAVKSAYLGDALWYEEVGNLYNAVHFTGLAYSEGDARAEGVMARVAPALLAKADDDLANNKYLEAYNAYFLLLATDGVPQYIKDAAEERVSN

SEQ ID NO: 72049 - protein, 857 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCISDFPEDFIFGAATSAYQVEGAAHEDGRGPSIWDTFSEKYPEKIKDGSNGSIASDSYHLYKEDVGLLHQIGFDAYRFSISWSRILPRENLKGGINQAGIDYYNNLINELLSKGIKPFATIFHWDTPQSLEDAYGGFLGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYSESAEDRLAAARAMAFTFDYFMEPLVTGKYPIDMVNYVKGGRLPTFTAKQSKMLKGSYDFIGRNYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYAVRFGLVYVDFNGGRKRYPKKSAKWFKKLLNEKKKN

SEQ ID NO: 72050 - protein, 245 aa, Glycine max
  misc_feature (141)..(141): Xaa can be any naturally occurring amino acid
  misc_feature (180)..(180): Xaa can be any naturally occurring amino acid
  misc_feature (190)..(190): Xaa can be any naturally occurring amino acid
MPRTSTLECSGCPPLRALTFDALGLIKVVEARDKQRGAPQVVERWGDPESSKCVMAVSMIDRESHPLLAVARKNNQIEVLSPVNGDIQATITDANDLNGQSEVNNIVGLHLFAKQNSELASRDCTLLTCTTKGNASIKGHXNLVDSSKGSSCIKTWNVCSGGNILCCKVDGNEKFALFGXGKCVEMNIWXDLNNFTKIWNSKPPTKDNLGIFTPTCFTSATFLMKDDHRKFVAGTNSHQVRLYDV

SEQ ID NO: 72051 - protein, 346 aa, Zea mays
VRVSFGPLEGYSRAAAATTASPSASFPAASLRRDARRTSCVAAAAAATTAAEAGLAAVPAPPPTPMVRVVPESLQRESGCLVEGFRARGACAADGEGFGDAAGEGGGPGAMEYLTSVLSSKVYDVAIESPLQLASKLSHRLGVNIWIKREDLQPVFSFKLRGAYNMMAKLSREQLERGVICSSAGNHAQGVALSAQRLGCDAVIVMPVTTPEIKWKSVERLGATVVLEGDSYDEAQSYAKLRCQQEDRTFIPPFDHPDVITGQGTIGMEIVRQLQGPLHAIFVPVGGGGLIAGIAAYVKRVRPEVKIIGVEPSDANAMALSLCHGKRVMLEHVGGFADGVAVKAVG

SEQ ID NO: 72052 - protein, 233 aa, Rhizobium leguminosarum bv. viciae 3841
MTTPSKSWIADLPKDRLIAEFSVWSADLVRLADDLARVDRHVDVLHIDVADGHFAPAMLFFPDLVAGVRKVSARPIHVHLMVSDSILLSQIEQFADAGSDLISLHVENESVAAEALDLLDRRGVAAGMVLKVDTPVERVEKYASRLRFVTLLGTAIGVKGQGLDEKAGARLQQAKQIIAGCGAAHRIVLAADGGIREHTVPLLRQSGAETVVLGSLAFNAPSLDERMAWVRAL

SEQ ID NO: 72053 - protein, 322 aa, Candidatus Kuenenia stuttgartiensis
MKGVMMSDCKIPFTCELCDKQSSCQLDHIEHNKWAIAQRMKEITYKIVVISNKGGVGKSTVTTNLGVTLALKGYKVGVADADIHGPNIPMMLGVEGQRLKGTEEGILPLEVLPNLKIASLSFLIEDPALPIIWRDAAKWDFLCELMGSICWGKLDYLLVDLPPGTGNEAISIIELIGKVDGSVIVTTPQDVVLLDVKKSVYFSRDSNVPVIGVVENMSDLVCPHCKGHIEVFKTGGGEKICKELGLTFLGKIPLDPEVTKKCDDGEAFVTAFPDSEGAKAFSEISKKCEVFVRKQTEENTEIREYREVPFLGKVPVDPNFVE

SEQ ID NO: 72054 - protein, 459 aa, Staphylococcus aureus subsp. aureus MW2
MNIIEQKFYDSKAFFNTQQTKDISFRKEQLKKLSKAIKSYESDILEALYTDLGKNKVEAYATEIGITLKSIKIARKELKNWTKTKNVDTPLYLFPTKSYIKKEPYGTVLIIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTSDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYIFKSTRLESGVHLPPYKGKFKYIKAFFKN

SEQ ID NO: 72055 - protein, 465 aa, Escherichia coli
MLFPIIMAGGTGSRLWPLSRESFPKQYLKLYGDMTMLQSTIARLNTLDCSTPLVICNEEHRFIVAEQLKKINKLDKNILLEPQGKNTAPAITLCAFAALKYAKNDEDPLLLVLAADHVIGNISSFTKSVKSALPHAHAGKLVTFGIIPTTPETGYGYIHRGEKFNDAYKVSSFTEKPDIYRAQEFLKTGEYYWNSGMFLFSAKRLLAEMEKYRPDIFSACEQAFLSPSNDLDFIRVDRDKFSLCPSESIDYAVMENTDDAIVVPMDAEWSDVGSWSSLWDISDKDVNGNAVSGDLISFNSYNNFIKAEDKLVALVGVNDLVLVHTDDAILVSSKYEVQNVKKIVEVLNQNGRDESKKHKEVYRPWGEYHYITEAEKYNVRRVLINPGQKISTQTHNHRSEHWVIVSGIAKITINNDINIIKENESIYIPPGTMHTIENSEMFPLEIIEIQTGQLLMKMTLFVLKL

SEQ ID NO: 72056 - protein, 190 aa, Nostoc sp. PCC 7120
MAVFEGTFTQTEPLRLAVVIGRFNDLVTTKLLAGCQDCLKRHGVDPDPHGNQVDYVWVPGSFEVPLVARQLALTHRYDAIICLGAVIRGQTPHFDYVSAEVSKGIAAASFQTGVPVIFGILTVDTMQQALERAGIKANHGWDYAMNALEMASLMRQLRSNVTDSYSQTQSLPAAFPNASIGKLTAESEEV

SEQ ID NO: 72057 - protein, 202 aa, Vibrio sp. Ex25
MANIVFIDNFDSFTYNLVDQFRSLGHSVKIYRNSIPAETIEQAVNELENPVVLLSPGPGAPSEAGSMPELILRMKGKVPMIGICLGHQAIVEAYGGTVAGAGEIIHGKVSMMEHQNHAIYQNLPSPLAIARYHSLVATKVPESLTITAEVDDLVMSAVHEEDKVCGFQFHPESIMTTYGATLLANAIEWALEEQTSVNPLTA

SEQ ID NO: 72058 - protein, 560 aa, Acinetobacter sp. ADP1
MYAEQSPSKYCNTASACLDPMLTNAAVTTPNYLATQAAVETLQKGGNAVDAAISAAATLAVVYPQMNTIGGDNFWLIYNAKTKQVRALNASGRAGENVSIDFYKSRGYDKIPSRGYLAANTVPGIVSGWDQAYQYASGSMTNKGLAWKDLFNKPIMYASQGFAVTPSLARWEAINTDTKDSVARNLQRFDEFKRVYLKSDGSPYQVGDLFKQPDLAKTLDIIATKGSKEFYQGSIAKAIVQDLQANGGVLTLNDFKQHTADWVDPLSVKYRQYTAYNLPPNTQGMASLEILNILNNFNVSAIPEGSADYYHLLVEATKEAFIDRDKYLTDPKFSPIPLKFLLSEQHGKDQAQRIDMSKAAGKNPPLEPKGDTVWLGVIDKDGNAVSLIQSIYHDFGSAVVAKGTGVLLQNRGSFFSLDPNHVNHLEPQKRTFHTLNAAMMLDQNNQPVLIYGTMGGEGQPQTQAAIATRVVDYGMSVQEAVAAPRWLYGRTWGAESNTLKLEGRITSDVAKTLKDRGQPVEILDDYTDTMGHAGAIAINRKTGVISAATDPRSDGLAAGY

SEQ ID NO: 72059 - protein, 621 aa, Populus tremula x Populus alba
MEQYEVLEQIGKGSFGSALLVKHKHEKKKYVLKKIRLARQTDRSRRSAHQEKELISRIRNPFIVEYKDSWVEKGCYVCIIIGYCEGGDMAEAIKKANGVHFPEEKLCKWLVQLLMALDYLHMNHILHRDVKCSNIFLTKGQDIRLGDFGLAKILTSDDLASSVVGTPSYMCPELLADIPYGSKSDIWSLGCCIYEMTSLKPAFKAFDMQALINKINKSIVAPLPTKYSGAFRGLVKSMLRKNPELRPSAAELLRHPHLQPYVLKIHIKMNSPRQNTLPFQWPEPHYMKKTKFLVPEDNPLKAHREKRYSLSNDRALNPSISAAEQDSVCSTEGIHDTPSYLNQSLSDSSIESSHEGTVICRSIASKPSNFAKTTKPAPTKASVTTRRRTEPVKKRESLPVTRTPTKKSNPTTRRTSLPLPSRTAIQNSAHGTNNSILLQIKSPDVSVNAPRIDRIAEFPLASYDKPYLPFRRTSSTSAQGSSNSLHHGDRSITKDKCTVQISDRTSAKPNFTEAWQGIEHGMFQVDEENGSNSSNQNATAGASSRTSSDIRRRRFDTSSFQQRAEALEGLLEFSARLLQDARYDELGVLLKPFGPGKVSPRETAIWLTKSFKENTAKTEDC

SEQ ID NO: 72060 - protein, 299 aa, Zea mays
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHGRSRSRSPPPQRRGHRDRDDYRGGGGGGRGRGSRYDRYDDGAGRGGRHDRYDDGAGRGGRHDRFDDGGRRRHGSPSRRARSPVRESSEERRAKIEQWNREREGKQ

SEQ ID NO: 72061 - protein, 439 aa, Rhodopirellula baltica SH 1
MDLFADQEADHLFAAQPLAARMRPKKLSEFVGQQHILGEGKLLRRLIASGRVGSILLHGPPGTGKTTLAHLIASEQNSELITLNAISSGVKDVREVLAKARDRVSAGDPRPLLFIDEIHRFNKSQQDALLADVESGIISLIGATTSNPYFAVNAALISRSQLFGLEPVSVEDMRSLLKRAITDRECGLGNQNVTIDEDAIDYLSSASDGDARKALTALEVAVHSHENPKASITRDDVAESMTSRIAGYDATGDDHYDLASALIKSIRGSDVDASLYWLARMLEGGEDIRFLCRRLVILASEDIGNADPQALIIAVSAMQACEMIGLPEAQLTLSQTVAYLSLAPKSNATTSAISAARRDVRDRQVIPVPKMLRCGHYTGAEELGHGDGYKSAHNTEEGVAKLDYLGVDRRYYKPVERGFESELASRLQKIRDQLGRETE

SEQ ID NO: 72062 - protein, 421 aa, Glycine max
MTSHSHYPPDLDADSVTSSPRSDHFHDAPPRIRFMCSFGGKILPRPHDNQLRYVGGDTRIVAVNRSITFSALILKLSKLSGMSNITAKYQLPNEDLDALISVTTDEDVENMMDEYDRVAHNQNPRSARLRLFLFPEGEDSRASSISSLLNGSAKRENWFLDALNGGVSGLERGRSEASSMVSEVPDYLFGLDNSEEITNHQRDPRPKPGPIIQDNVSVSDPGSPAPVVSSPYCSTSSAPPVPSLPNLPYVKTKPLNLNPVPDTDSKENQTEPETEPHPNLNLNQNPNMYSNNPVVHYPPEAAYSAHSVNPVPVYYVSGPVRPGSVPVPMQTPYHYVQQSYHAVVPPQVPIGYHPLVPGSGQVYGAGVRHMTPLQPYSPSTTAVVHDGLKQHVYHAVPNSGPVPVHPVIPMTGLDEPQRGGA

SEQ ID NO: 72063 - protein, 527 aa, Vitis vinifera
  misc_feature (60)..(60): Xaa can be any naturally occurring amino acid
  misc_feature (510)..(510): Xaa can be any naturally occurring amino acid
  misc_feature (517)..(518): Xaa can be any naturally occurring amino acid
  misc_feature (520)..(520): Xaa can be any naturally occurring amino acid
  misc_feature (524)..(524): Xaa can be any naturally occurring amino acid
  misc_feature (526)..(526): Xaa can be any naturally occurring amino acid
MSVQDYLDKHMLSRKIEDAVNAAVRAKTSDPVLFIVGTSLLLISFCLVAEKIRKKARKFXIWYEAVELRDGDKGTYLGNGVTRAVRNVNEKISEALIGMDPTLQSQIDQVMIDLDKTEKKVPLYKHIADLSGQSNLFLPVPAFTVISGGKHAGNTLAAQEIMILPIGATRFEEALQMGAETYHHLKYSGFSVFPCLNATYTSRIESIREGLDLVKEAIGRTGYNEKIKIAIDVAATDFCIGAKYDLDFKSPNKSGQNFKSGEDMIEMYKELCNDYPIVSIEDPFDKEDWEHIRNFCGLGICQVVGDDLLMSNPKRIERARRESTCNALLLKVNQVGTVTEAIEVVKLAKDAHWGVVTSHRCGETEDSFLADLSVGLATGQIKAGAPCRGERLAKYNQKSLGIKRFMLAKIGDSRDHSFQGQINKWIALVRLNGIWVLIWLLFHIFKRHNQIKRPFGSSKQSLVRKYAGPYHSSTFGDYKIRLYSMGIQRPVLFFVPRTLVDARRRTRALXEELAGRXXEXPKVXSXL

SEQ ID NO: 72064 - protein, 339 aa, Escherichia coli K12
MKSILIEKPNQLAIVEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGEIFTEKGIKPTLIIDAACHPSILKEAVTLASPAARIVLMGFSSEPSEVIQQGITGKELSIFSSRLNANKFPIVIDWLSKGLIKPEKLITHTFDFQHVADAISLFEQDQKHCCKVLLTFSE

SEQ ID NO: 72065 - protein, 244 aa, Coccidioides immitis RS
MDAEPSFRRKHHPSRRLETDLKSDNILLALRNPSILDSVAQDEMNDPSPRKQLDGRDIYLSRNYWGLSPDQLGRSVITDFGLAVRGDGPPNSHPIQPEGYRAPEVCLGGEWSYSADIWNLGAMLWDLFCGRGPFDTPPNSRGSGSADEAHLGQIISLLGPPPPDLLRRGKETSRYFDAKGQFKFPELIGKKDLVSMAKEIDYDDGMPQFVDFISRMLRWRPEDRTTAEDLISHPWLPQARPANG

SEQ ID NO: 72066 - protein, 528 aa, Prochlorococcus marinus str. MIT 9515
MGKNLLKKERDPSILILDFGSQYSELIARRIREANVFSLVVSNFISTKEIQDINPQGIILSGGPNSVYEDNAPKCDQNIFNLGIPVLGICYGMQLMVKELGGTVTPANNRSEYGRAPIKIDFESDLLSSVKDKSIMWMSHGDSINHLPNGFIKIAHTENTLHAAISNKEKKLFGVQFHPEVIHSEYGMTVIKNFVYSISKCKADWNTETFLEETIPRIKEQVGDKKVLLALSGGVDSSTLAFLLNKAIGKQLTCMFIDQGFMRKGEPEFLMEFFAKKFHIKVEYINARERFLHKLNGVTDPEEKRKIIGGEFIRVFEEESHRLGPFEYLAQGTLYPDVIESAGTNLDPKTGERIAVKIKSHHNVGGLPKDLQFKLVEPLRKLFKDEVRKLGNALGLPDEIIKRHPFPGPGLAIRILGEVSIEKLNCLRDADWIVRDEIKKAGLYNDIWQAFAVLLPVKTVGVMGDKRTYAWPVVLRCVSSEDGMTADWSRIPYETLERISNRIVNEVAQVNRVVFDITSKPPGTIEWE

SEQ ID NO: 72067 - protein, 615 aa, Mycobacterium sp. MCS
MSSAHTPVVSRLETADRALEQLDELIERLEKAEDAWSDWLTAVSPEHRASATNMVHYWSLRQSDLRDLQRRLAGLGLSSLGRSEPHVEGTLRLVHAAVAAMRHGSWHPPGVTAVDANVGDELLREHAVDLFGPAPAERATRIMVTLPSSAATDPDLVRDLIARGMNVARINCAHDDAEAWTAMAGHVRRAAESTGRKCLVAMDLAGPKLRTGPIRPGPRVIKLRPTRDALGRVVTPFRLRLTASEEPTGSSESAMAVVPVDEAWLARRRDGDVVGFHDARGAKRQLVLSRPDEMAGAVIATGDKTSYLATGTVLHAGAHDPCEVGLLPEREQTLMVQRGDELTLTRDCAPVPADHGGAPRIGCTLPEVFDHARPGEKIRFDDGRIGGEIVAVERDALRVRIDRTAPGGSKLGSAKGVNVPDTHLPIAALTDKDVEDLATVVAIADIVQISFVQRPSDITQLHDELHRLGGDHLGVVLKIETRRAFEHLPQLLLTAMRWPRVGVMIARGDLAVEVGYERLAEVQEEVLWLCEAAHLPVIWATQVLESLAKSGLPSRAEISDAAMGERAECVMLNKGPHIVDAVVVLDDILRRMNEHHYKKNALLRQLRSWRPDATE

SEQ ID NO: 72068 - protein, 191 aa, Synechococcus sp. RS9916
MSIFVGNLPFRAEQEDIIELFAAHGEVTNCALPLERDTGRKRGFAFIEMADEAMETAAIDALQGVELMGRPLRINKAEPRGSAPRRGGGGYGGGGGGYRGGGGGYGGGGYRGGGSEGGGYGGGSGARGWEDRSYGGGGGGYRGGGGGYGGGGGQGTDYDDGRSRRRRGGASQGDSYGGGGDSYGGYGGAEG

SEQ ID NO: 72069 - protein, 440 aa, Photorhabdus luminescens subsp. laumondii TTO1
MKLSLDHIPGKMRHAINECRLIQIRGRVTQVTGTLLKAVIPGVRIGELCHLRNPDNTLSLLAEVIGFQQHQALLTPLGEMFGISSNTEVSPTGAMHQVGVGDYLLGQVLDGLGNPFSGGQLPEPQAWYPVYRDAPAPMSRKRIEHPLSLGVRAIDGLLTCGEGQRMGIFAAAGGGKSTLLSTLIRSAEVDVTVLALIGERGREVREFIESDLGEEGLKRSVLVVATSDRPAMERAKAGFVATSIAEYFRDQGKRVLLLMDSVTRFARAQREIGLAAGEPPTRRGYPPSVFAALPRLMERAGQSDKGSITALYTVLVEGDDMTEPVADETRSILDGHIILSRKLAAANHYPAIDVLRSASRVMNQIITPEHQAQAGLLRKWLAKYEEVELLLQIGEYQKGQDPVADNAIAHIEAIRNWLRQGTHEPSDLPQTLAQLQQITK

SEQ ID NO: 72070 - protein, 335 aa, Pichia angusta
MTANVGINGFGRIGRLVLRIALSRDDINVIAINDPFIAPDYAAYMFKYDSTHGKFKGTVTHEGKYLVINGKKIEVFQERDPANIPWGKEGVDYVLDSTGVFTTIEGAQKHIDAGAKKVIITAPSKDAPMFVVGVNHEEYTPDIKILSNASCTTNCLAPLAKVINDIFGIEEGLMTTVHSITATQKTVDGPSHKDWRGGRTASGNIIPSSTGAAKAVGKVLPALAGKLTGMSMRVPTTDVSVVDLTVNLKKPTTYEDICATMKKAAEGPLAGILGYTDEAVVSSDFLTDSRSSVFDAKAGILLTPTFVKLVSWYDNEYGYSTRVVDLLQHVAKVSA

SEQ ID NO: 72071 - protein, 635 aa, Streptococcus pyogenes M1 GAS
MIILQGNKLERSFSGDVLFQNISLQVDERDRIALVGPNGAGKSTLLKLLVGEETPTSGEVNTKKDLTLSYLAQNSRFESDQTIYEEMLKVFEALRQDEKRLRQMEMDMATVSGQVLTRLMTDYDLLTEHFRQQGGFTYESDIKAILNGFKFDESMWQMTIAELSGGQNTRLALAKMLLEKPELLVLDEPTNHLDIETIAWLENYLANYQGALIIVSHDRYFLDKVATVTLDLTPNGLDRYSGNYSRFMALKAEKLVAEEKQFDKQQKEIAKLEDFVQKNIVRASTTKRAQARRKQLEKIERLDKPTGGRKSAHMTFHAEKPSGNVVLRVEEAAIGYGDQVLSEPINVDINKLDAIAVVGPNGIGKSTLIKSIIGQLPLLKGQLKYGANVETGYYDQTQSHLTSSNTVLEELWQDFSTTPEVDIRNRLGAFLFSGDDVKKSVAMLSGGEKARLLLAKLSMENNNFLVLDEPTNHLDIDSKEVLENALIDFDGTLLFVSHDRYFINRLATKVLEITENGSTLYLGDYDYYLEKKAELEELARLAAGETVEETKEASATDYQLQKANQKERRRLTRRYEEIEARLETIEERIGAIQEDMHASNDTAQLIAWQKEWDQLDQEQEALMEEWETIAEQIES

SEQ ID NO: 72072 - protein, 548 aa, Oryza sativa Japonica Group
MKRVSSHVSIASEAEINLDLSRLLIDKPRLTLERKRSFDEQSWSELSHRQNDGFDSIMHSPAFPSGFDSPFSLGTLGDPHPLVNEAWEALRKSVVYFRGQPVGTIAAVDHASEEVLNYDQVFVRDFFPSALAFLMNNETDIVKNFLLKTLHLQSSEKMVDRFKLGAGAMPASFKVDRNRNRNTETLVADFGESAIGRVAPVDSGFWWIILLRAYTKYTADTSLAESPECQNCMRLILNLCLSEGFDTFPTLLCTDGCSMIDRRMGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFLGNVSPAMMDFRWFALGNCIAIISSLATPEQSVAIMDLIEERWEELVGEMPLKICYPAIENHEWRIITGCDPKNTRWSYHNGGSWPVLLWLLTAACIKTGRPQMAKRAIELAESRLLKDGWPEYYDGKLGRFIGKQARKFQTWSIAGYLVARMMLEDPSTLMMISMEEDRPVKPTMRRSASWNA

SEQ ID NO: 72073 - protein, 391 aa, Arabidopsis thaliana
MASASFVKPNTLSSPWIGQRSFAHTSASSSPPPRVSFAIRAGAYSDELVKTAKSIASPGRGILAIDESNATCGKRLASIGLDNTEDNRQAYRQLLLTTPGLGDYISGSILFEETLYQSTKDGKTFVDCLRDANIVPGIKVDKGLSPLAGSNEESWCQGLDGLASRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHVSFSYARALQNSVLRTWQGKPEKIEASQKALLVRAKANSLAQLGKYSAEGENEDAKKGMFVKGYTY

SEQ ID NO: 72074 - protein, 469 aa, Streptococcus pyogenes M1 GAS
MAFEIIMPKLGVDMQEGEIIEWKKQEGDTVNEGDILLEIMSDKTNMELEAEDSGVLLKITRQAGDTVPVTEVIGYIGAEGESVDTIASSEKTTEIPVPASADAGPAVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGANKMCLSDFVLASKDVIKKAQTGKLKAAEMSGSTFSITNLGMFGTKTFNPIINQPNSAILGVGATIPTPTVVDGEIVSRPIMAMCLTIDHRLVDGMNGAKFMVDLKKLMENPFELLI

SEQ ID NO: 72075 - protein, 587 aa, Streptococcus pyogenes M1 GAS
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVSQMNGLENLNLEMDRNRIKVNDYQETSIPGIYAPGDVNGTKMLAHAAYRMGEVAAENAMHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 72076 - protein, 425 aa, Pediococcus pentosaceus ATCC 25745
MQPLAFRMRPRTIEEIVGQQHLVGPGKIIDRMVKAKLLSSMILYGPPGTGKTSIASAISGSTKYAFRILNAATDSKKDLQIVAEEAKMSGTVILLLDEIHRLDKTKQDFLLPHLENGNIILIGATTENPYININPAIRSRTQIFEVKPLQPDEIKKAVLAAIKDSSRGLGELPIVIDEDALKFVSESTNGDLRSALNAVELAARSTGPDENQKIHLTLAILEECLQKRALTQDKDGDAHYDVISAFQKSIRGSDTDAALHYMARLLESGDLQSVIRRLLIIAYEDIGLANPPACQRTVSAVTAAEHVGLPEARIPLADAVIELCVSPKSNSGISAIDNALTDVRTGKIGEVPDHLRDSHYKGAAALGRGVDYKYPHNYPNDWIAQQYLPDKLVDAAYFDAKGNSTYEEKIKNRYESLKKSQRSNH

SEQ ID NO: 72077 - protein, 334 aa, Aspergillus oryzae
MSRYAEAHANPQGPGDARPTALQIVKDTEMEGKLAGKSAVITGVSSGIGLETVRAIAATGAFLYLTARDLNKAKTALDDIFKPEQMELIHMDQSSLESVRNAAKTILSKTDKVSLLINNAGIMALPELRLSMDGYELQFATNHLSHFLLFNLLKPAMLAASTPEFQSRVVNVSSDSHRHHGINASDNYNFQKGGYEPWTAYSQSKTAVIYMANELDRRYGSRGLHATSVHPGMIATNLGQYLTPEQIEQLLQNTRWNSLWKSFEQGAATTVWAAVGREWEGNGGKFLAGCAEAVRGPEGTEDYVGTFVNHTYKPEDEARLWKDSLEMVGLSDDK

SEQ ID NO: 72078 - protein, 396 aa, Glycine max
MAIQHHNEQLEHNENVSSVLDALYCDEGKWEDEEEEEEDNEESEVTTNTGTSLFPLLMLEQDLFWEDEELNSLFSKEKVQHEEAYDYNNLNSDDNSNDNSNNNNNVLLDSCLSQPRREAVEWILKVNAHYGFSALTATLAVTYLDRFLLSFHFQREKPWMIQLVAVTCISLAAKVEETQVPLLLDLQVQDTKYVFEAKTIQRMELLVLSTLKWKMHPVTPLSFLDHIIRRLGLKTHLHWEFLRRCEHLLLSVLLDSRFVGCLPSVLATATMLHVIDQIKHNGGMEYKTQLLSVLKISKEKVDECYNAILQLSKANKYGHNNINNTSKRKYEQIPSSPSGVIDAAFCSDGSNDSWAVGSSLLYSPPEPLFKKSRTQGQQMKLSPLNRVIVGIVGTSP

SEQ ID NO: 72079 - protein, 456 aa, Bacillus clausii KSM-K16
MKLCVIGTGYVGLVSGVCYSHIGHEVVCVDRDQEKIKRLSQGEVPIFEPGLEDMLASNMAAGRLSFTTRLSDGLAGADAAIIAVGTPARADGSANLDYVEAVAKEIGSCITAGLVVITKSTVPVGTNRKVKNWIAETCGHEDFEVASCPEFLREGTAIADTLEMERAVIGVESVNAERLLRDLHKPFQTTIVTCNLETAEMAKYAANAFLATKISFINEVANVCEQVGADVTSLAEAIGLDHRIGRHFLKAGIGYGGSCFPKDTQAFIRVAQQAGYDLQIVPAVERVNAAQRLTVVHKLKTALGHNLAGKQIAMLGLAFKPNTDDMRAAPALDVYPALEREQANTVAFDPIATEQAKAALPGIQLANTWQQAVKDADAVLLLTDWETFKDISLPELKKLTKQPIVIDGRNMFDPKEMEMHGFYYDSVGRPVVDGRLERIREWEDLVLGVYDRFANG

SEQ ID NO: 72080 - protein, 470 aa, Rhizobium leguminosarum bv. viciae 3841
MRPYFQERGYDMLDRSNELAAWDRDHFFHPSTHMGGHARGETPTRVVAGGEGVYITDTTGRKSLDAFAGLYCVNVGYGRQKIADAIAEQAKNLAYYHAYVGHGTEASITLSKMIIDRAPTGMSRVYFGLSGSDANETNIKLIWYYNNILGRPEKKKIISRWRGYHGSGVMTGSLTGLALFHNAFDLPRAPVLHTEAPYYFRRPDRSMSEEQFSQYCADKLEEMIIAEGPETIAAFIGEPILGTGGIVPPPKSYWQKIQTVLDKYDILLVADEVVTGFGRLGTMFGSDHYDMKPDVITIAKGLTSAYAPLSGTIVSNKIWQVLVQGSDQLGAIGHGWTYSAHPICAAAGIANLELIDELGIVENAGTTGAYFRSELEKAVSGHRNVGEVRGDGLMAAVEFVDDKDDRTFFDAGRKIGPQVASALLERGVIGRAMPQGDILGFAPPLCLTREEADIVVKAAADAIETVFKNI

SEQ ID NO: 72081 - protein, 408 aa, Aspergillus oryzae
MTPYFRYFPVFTWSGGVGGSEYNLPLHVGGLFIILSVSTLACAFPVLAIWFPRLRIPSSCLFFVSHFGTGVLIATAFVHLLPTAFQSLNDPCLSKFWTTDYPEMPGAIALAGVFLVTVIEMVFSPARHCCRGGTSLSDPPPYLSRPTEKETPIKRAHVVDSTVCNERERPAGVEPLPHLRDMGPLIGRSSSISRAINQMGEDPERICRISSAPEVPQYRQEPRIEPVQEDVERSDDGHVMTPEQKHRKEVMQVVLLEMGILFHSVFIGMSLSVSVGSEFVILLIAIVFHQTFEGLALGSRIAALDWPEKAMQPWLMSLAYGCTTPIGQAIGLATHTLYSPDSEVGLLLVGVMNAISAGLLIFASLVELMSEDFLSDESWRVLRGKKRVYACIILFMGAFCMSLVGAWA

SEQ ID NO: 72082 - protein, 133 aa, Zea mays
MGSFTASASTLSVARPALLLKPTVAVSAPVLGLPPMSKRKGGVKCSMETKQGNVSAVGAGVSAAATAALTAVMSSPAMALVDDRMSTEGTGLPFGLSNNLLGWILLGVFGLIWTFYFTYTSSLDEDEESGLSL

SEQ ID NO: 72083 - protein, 445 aa, Ustilago maydis 521
MAIQKIQARMVIDSRGNPTVEVDLTTEKGLFRAAVPSGASTGIHEAVELRDGDKSSWMGKGVSKAIDNVNNVIAPELIKSGLPVTSQKEIDDFLIKLDGTPNKGKLGANAILGVSIAVAKAGAGEKGVPLYKYLAELSGVKAPYVLPAPAMNVINGGSHAGNALAFQEFMIVPTGAKSFTESIKIGTEVYHNLKKVINTKYGIDATNVGDEGGFAPNVQSADEALEILTEAIKKAGYEGQVHISLDVASSEFYKDGKYDLDFKNPNSDSSKWLTGKELADVYLGFIKKYPITSIEDPFDQDDWEAWSHLRANAGITIIGDDLTVTNPLRIKTAIEKKACNGLLLKINQIGTISESIQAAQLSQSDNWSVMVSHRSGETEDVTIADLVVGLGVGIIKTGAPCRSERTAKYNQLLRIESLEPSAVYAGIDGFTQGETAPKLITNKSA

SEQ ID NO: 72084 - protein, 501 aa, Aeromonas hydrophila
MRCLYLHGLITCWQEVKINMAVIPVIMAGGSGSRLWPMSREHFPKQFLNLYGNNSMLQETVNRLAEIECTAPLILCNEKHRFIVAEQLRQLDILANNIILEPVGRNTAPAIALAAIQSLKDVDDTHDPILLVLAADHLIKDQQAFTNAVNSAIPFAESGKLVTFGIVPNTPETGYGYIHRGSELKSFLNEEKAYGVNQFVEKPNLAVAKGYLASGEYYWNSGMFMFSARRYLAELKLSRPDIYQACLASMNDIRSDLDFIRINNDEFKQCPSDSIDYAIMEKTSDAVVIPMDAGWNDVGSWSSLWDISDKDACGNVSRGDVILIESHNNYVSAESILVSTIGVDNLVIIQTKDAILVSNKDKVQDVKSIVEELKRCGRKEYKTHREVYRPWGQYDSIDDGNGYQVKKILIRPGERLSTQMHHHRAEHWIVVSGTAKVTNAEREFLITENESTFIPIGAIHSLENPGKVDLELIEIRSGKYLEEDDIIRFSDKYGRVDGGEK

SEQ ID NO: 72085 - protein, 334 aa, Synechococcus sp. RS9916
MDSPTSGEREPAWRFSVAPMLDCTDRHFRVLMRQISTRALLYSEMVVAQALHHTNRRERLLDFDPVEHPIALQVGGDDPVLLAEAAQMAADWGYDEINLNVGCPSPRVQAGNFGACLMAEPDRVARCVEAMGQASRLPVTVKHRVGIDHLDSDALLQAFVDRVAAAGATRFAVHARKAWLEGLDPKQNRTIPPLQYDRVIALKQRRPELTIELNGGLDTPDQCLEALESCDGAMVGRAAYAHPLRWGCIDERIYGEAARTVTASDVVLGLIPYAQAHLARGGRLWDLCRHLVQLVEGVPGARHWRRNLGLNAQRQGADIPVLEDAARQLLDAGL

SEQ ID NO: 72086 - protein, 170 aa, Ralstonia metallidurans CH34
MSDKGTDTKDKEKKAGKKKTASDRIEVRQSGVHGKGVYAIGQIAEGERVIEYKGEHISWKEALKRHPHDPNDPNHTFYFSLDDGDVIDAKFGGNRARWINHACDPNCEAREKKGRVFIHALRDIEPGEELFYDYGLVIDARYTKKLKQEYECRCGSPKCRGTMLAPKDKK

SEQ ID NO: 72087 - protein, 597 aa, Hevea brasiliensis
MEEENQSNKSSRISCSSGMSDVVLGCVMPYIHDPRDRDAVSLVCRRWYELDALTRKHITIAFCYTTSPDRLRRRFMHLESLKLKGKPRAAMFNLIPEDWGGFVTPWVNEIAESFNCLKSLHFRRMIVTDSDLEVLAKSRGRVLQVFKLDKCSGFSTDGLLHVGRLCRQLRTLFLEESSILEKDGSWLHELALNNTVLETLNLYMTDLNKVRFEDLELIAKNCRNLVSVKISDCEILDLVRFFHTAAALEEFCGGSFNDMPDKYSAVTFPQKLCRLGLTYMGKNEMRIVFPFASLLKKLDLLYALLDTEDHCLLIQKCFNLEVLETRNVIGDRGLEVLASSCRRLKRLRIELGADEQEMEDEEGVVSQRGLIALAQGCLELEYMAVYVSDITNAALEHIGTHLRKLNDFRLVLLDREERITDLPLDRGVQSLLMQRKLRRFALYLRPGGLTDEGLGYIGQHSKNVRWMLLGYVGESDEGLLAFSKGCPSLQKLEMRGCCFTEGALAKAVMQLTSLRYLWVQGYRASSTRGRDLLAMARPFWNIELIPPRKVVMVNQVGEDVVVEHPAQILAYYSLAGPRTDFPNTVVPLDSCRIESCK

SEQ ID NO: 72088 - protein, 227 aa, Brassica napus
  misc_feature (150)..(150): Xaa can be any naturally occurring amino acid
MVVSPKIAPSMLSSDFANLAAEAKRMVDLGADWLHMDIMDGHFVPNLTIGAPVIESLRKHTSAYLDCHLMVTNPMDYVEQMGKAGASGFTFHVEVAKENWQELVRKVKSAGMRPGVALKPGTPVEEVYPLVEGATPVEMVLVMTVEPGFXGGQKFMPHMMDKVRALRQKYPTLDIEVDGGLGPSTIEAAAEAGANCIVAGSSVFGAPEPGKVISLLRTSVEKAQPTA

SEQ ID NO: 72089 - protein, 500 aa, Arabidopsis thaliana
  misc_feature (119)..(119): Xaa can be any naturally occurring amino acid
  misc_feature (179)..(179): Xaa can be any naturally occurring amino acid
MGEIVVLSSDDGMETIKNRVKSSEVVQWEKYLPKTVLRVLLVESDYSTRQIITALLRKCCYKVVAVSDGLAAWEVLKEKSHNIDLILTELDLPSISGFALLALVMEHEACKNIPVISTXVMSSQDSIKMVLKCMLRGAADYLIKPMRKNELKNLWQHVWRRLTVNFLFPFLRFPCVEVXNLKDLLSFLVMDQLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 72090 - protein, 504 aa, Candida parapsilosis
MSVPKFNDLSFYSDPSAHKSRYANLVKTFKSKYPNDEIEFFARSPGRVNLIGDHIDYNYFPVLPMAIEVDVVAAVSTNNNDMIVIANTDSAKFPKETVSLAEEFTIDREHHTWANYFKCGLIVASKFLQEKAMTKLKGMNITFSGTVPTGGGLSSSAAFCVASTLAVLYANGVEDISKADLTRITVVSEHYLGLNNGGMDQCASVYGEQGKALFIQFKPQLKGTPFEFPVKNLTFVITNSLQVSNKYETAPIHYNLRVVEMAIAGDLLAKKLNVEGKEGIVKDSNVDTYSLRGVMDGYCGAWDGEDLDVGVVHLEKMIDVVGKTLTKEGGYTVEQCCEEMGLTPEEFHSRYLKKIPVKFDVLKLYERALHVYRESLRVLKTLQLLSTVVDASQFLQTFGSLMNESQHDLDILNESSNPKLNEICSIALANGAYGSRVTGAGWGGSIVHLTTTENLPKLTKSLEAYYKREFPGITDEEIREAVIDSKPATGSCLVKLDFSHALQG

SEQ ID NO: 72091 - protein, 648 aa, Musa acuminata
MSSPPPSPSATPPSTSPPPPTSLSPPPASNSPPPAPNAPPPTPPSPPPASPPPPTPPPPADVPPPPVVTSPPPPAPPPPSVSPPPPALSPPPASTPPRPPSASPPPAAAPPPPPPSATPPPTNSPPPPPSATPPPTISPPPPGSQSPPAPAPSNSTGGTPPAPPKPPSPPSPSPSASHRAPAYPISPSSNGSGIPTSDVGQKSGQSSGDGGMKAGPAVAVALVTAVVLLGLLGAITWIVRRKRRKPPANYESGFAMSSPYQSSVMSESSHQRSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDIQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDSRLEDAYDDTEMFRMIEAAAACTRHSAAMRPRMGKVVRVLDSLSDVDLHNGVKPGQSEVFNVGQTADIRLLQRLAFGSQEFSSEYSQSNWSRQSDL

SEQ ID NO: 72092 - protein, 124 aa, Zea mays
GPHRPQCPPPSSSPPPPRAADEEYVSETKEVIGKVRSTIGLDKSDPSVADAVAELRDLSNSWVAKYRREKSLLGRPSFREMYSALNAVSGHYISFGPTAPIPAKRRARILEEMDTAEKALPRGR

SEQ ID NO: 72093 - protein, 426 aa, Zea mays
MASISEWSYYNTSLFCEKKMTSPLISVSISVAASLLLPCIYVLVWHRQKLEFFLCKKTSSAIEENIEALILAHGSLAPKRYRYSEVTKITSSLNIKLGEGGYGMVFKGRLDDGRLVAVKFLHDSKGDGEEFVNEVMSIGRTSHINIVSLFGFCLEGSKRALIYEYMSNGSLDKYIYTENPKAVLGWDKLYTIAIGIARGLEYLHHSCNTRIVHFDIKPQNILLDQNFHPKIADFGLAKLCHMKESKLSMTGARGTPGFIAPEVHSRTFGVVSTKADVYSYGMMLLEMVGGRKNVNSAAQESSEKYFPHWIYDHFGQEDGLQACEVTRENEGIAKKLSVIGLSCIQILPMHRPTIGKVMEMFERGSDELDMPPRQNFSQIFQDPVHSLNAETMSMISGTKAKASSEVLKMKGISVVNSKTIQRLPTL

SEQ ID NO: 72094 - protein, 498 aa, Rhizobium leguminosarum bv. viciae 3841
MTAVFARPAYHDALSRLADRHLLRDLAYVGGRWIAGQSGKSFEVTDPASAATLAWVASLGADETAVAINAASEACAAWRAMLPQGRAAILRKWFELMLAAKEDLALIMTLEQGKPIAESRGEIDYAASFVEWYAEEGKRLNAESVTSHLPGAEMIVRREALGVVGIVTPWNFPSAMLTRKVAAALAAGCTVVAHPSSETPLSALALAELGERAGVPAGVFNVVTGHAATIVGRMCADTRVRAMSFTGSTGIGRLIAAECAPTLKRLVMELGGHAPLIIFDDADIEKAVEIAVNAKFATSGQDCLAANRIFVQRRIADAFTKAFADRIAELKVGAGLEDGAEIGPLMHERAVAKVEEQVADALGHGARLVTGGRRHKAGRLFYEPTLLSDVPADALIMREETFGPVAAIAAFDTEDEVIARANDTEYGLVAYIVTENGARQMRLGRALEYGMVAVNRVKITGAPIPFGGWKQSGLGREGSRHGLEAFTELKYLCIDTAA

SEQ ID NO: 72095 - protein, 513 aa, Staphylococcus epidermidis ATCC 12228
MEMAKEQELILVLDFGSQYNQLITRRIREMGVYSELHDHEISIEEIKRMNPKGIILSGGPNSVYEEGSFTIDPEIYNLGIPVLGICYGMQLTTKLLGGKVERANEREYGKATINAKSDELFFGLPSEQTVWMSHSDKVIEIPEGFEVIADSPSTNYAAIEDKKRRIYGVQFHPEVRHTEYGNDLLRNFVRRVCNCTGEWTMENFIEIEIEKIRQQVGNRKVLCAMSGGVDSSVVAVLLHKAIGEQLTCIFVDHGLLRKGEGDMVMEQFGEGFDMNIIRVNAQERFMSKLKGVSDPERKRKIIGNEFVYVFDDEAAKLTDVDFLAQGTLYTDVIESGTKTAQTIKSHHNVGGLPEDMEFELIEPINTLFKDEVRALGIELGIPEHLVWRQPFPGPGLGIRVLGEITEDKLEIVRESDAILREVIREEGLERDIWQYFTVLPGIQSVGVMGDYRTYDHTVGIRAVTSIDGMTSDFARIDWEVLQKISSRIVNEVDHVNRVVYDITSKPPSTIEWE

SEQ ID NO: 72096 - protein, 152 aa, Prochlorococcus marinus str. MIT 9515
MIKERTFLAIKPDGVQRGYIAEIIGRFEKKGFKLVGLKQLIPSKQLAQDHYGVHRERPFFKDLVNFISSGPVVAMIWEGEGVILSARKIIGATKPLEAEPGTIRGDLAIDIGRNIIHGSDGEETAKFEINLWFDQHEICDWETSDSEWRVES

SEQ ID NO: 72097 - protein, 347 aa, Legionella pneumophila str. Lens
MNTAPKQYGFYMPAEWYPHERCWMAWPCHHETWSKIGLDKAKMAYARVAKAIAQFEPVTLLVNPGDEDSAKNLCKGHNIEIISLPINDSWTRDTGATFLINNERQLAGVDWIHNAWGGNYADCSLDNFIASHIIKYTEAQYFHAPLVMEGGSFHVDGEGTILTSKECLLNSNRNPHLSQQEIEQYLINYLGAERIIWLNMGLIGDETDGHVDEIATFIAPGKVLCLITKDKEDPNYHRLQENFEILKSSKDARGRTFEVYTVEQPPATYLNGERLTLSYINFYMANQGIVMPAFGYESFDRLAYQLFVQIFPGYQITQIDALDVFSGGGGIHCITQQQPKSHKLVEQ

SEQ ID NO: 72098 - protein, 764 aa, Xylella fastidiosa Temecula1
MSNDTFKQAAIDYHRTQPAGKIKVVATKPMLTQRDLSLAYSPGVAFACQAIVENPQQASELTARGNLVAVISNGTAVLGLGNIGPLAGKPVMEGKGVLFQKFAGIDVFDIEIDESDPDKLVDIIASLEPTFGGVNLEDIKAPECFIVERKLRERMSIPVFHDDQHGTAIIVGAAVLNAMVITGKKIGEVKLATTGMGAAGVSCVNMLVSLGLNPDNILAYDREGVIHTGRTDLDPEKQRYARDTDKRTLAEIVEGADIFLGLSAAGILTPEMVATMAPDPVIFALANPIPEIMPEVVCAVRTDAIIGTGRSDYPNQINNVLCFPYLFRGALDVGATTINEEMKIACVKAIAALARCEASDLGAAYGGETPSFGREYLIPRPLDPRLLVELSSAVAQAAMDSGVATRPITDMSAYHDKLSQFVYRTSLMMKPVYDRARADKQRVVYAEGEEEVILRAVQNVIDEGLAFPILIGRPDVIESRIQRMGLRMKVGVDFEVTNIHDDPRFNDYWQYYHGVTERRGVTVSAAKELMRSRPTLIASVMVARGEADALLTGAVGRFHKRLGYARSVIPLEPRVSSTAAMTGVINQHGAFFFVDTHVQEDPSAEQITEATLQACYRLRLFGIEPSVALLSHSNFGSHDSRDALKMRQVRELLLKRSPRLNIDGEMQADTAWDEVLRERIMPNTTLKGRANLFVFPNLEAANIAYNLVRVFTDGVAIGPILMGISKAVHILTSSTTSRRVMNMTAIAAVDAQIRKQFEGGKRGG

SEQ ID NO: 72099 - protein, 473 aa, Pediococcus pentosaceus ATCC 25745
MHNFIKNFIKKENPAIYEDKDSHLTRTLVVKDFLALGVGTIVSTSIFTLPGVVAAQHAGPAVVLSFLAAAVVAGLVAFAYAEMASAMPFAGSAYSWINVILGKGFGWVAGWALLAEYFIAVAFVASGLSANFRGLLSSIGIQIPKQLANPLGTNGGIIDITALIVVIAVALLLAHGTTGAARIENALVVLKVVAILVFIIVGLSAIHIQNYLPFIPKYHTNPDGTSFGGWKGIYSGISMIFLSYIGFDSIAANAGEAKNPEKTMPRGILGSLIIAVILFIAVSLVLVGMFHYTNYANNAEPVGWALRHAGHGVIAGVIQAIAVIGMFTALIGMMMAGSRLLYSFGRDGMLPKWLGQVNPKGLPNHALSLLTIIGIIIGSMFPFAFLAQLISAGTLIAFMFVSLGIYVLRPREGKDIAIPSFKMPLYPVLPALAFLGSLAVFWGLDAQAKLYSLVWFIIGIIVYTFYGARHTTD

SEQ ID NO: 72100 - protein, 239 aa, Glycine max
MAARARIRESGAGAVPYADFLRLCCDAAGPDAGPSVARALDESGSVIVLGKTVFLRPDMEKIQRKGAVVKAIENAIPVRHAAAAAAAEIDPAREEELRAMEAEKAEIDRAAAARVRRELWCGLTYLVIQTAGFMRLTFWELSWDVMEPICFYVTSMYFMAGYAFFLRTKKEPSFEGFFESRFAAKQKRVMRARGFDLRRYEELRRACGVAAPPLQARTPCASAGAARESGHCHSYCHCH

SEQ ID NO: 72101 - protein, 354 aa, Triticum aestivum
  misc_feature (85)..(85): Xaa can be any naturally occurring amino acid
  misc_feature (176)..(176): Xaa can be any naturally occurring amino acid
  misc_feature (192)..(192): Xaa can be any naturally occurring amino acid
  misc_feature (204)..(204): Xaa can be any naturally occurring amino acid
  misc_feature (220)..(220): Xaa can be any naturally occurring amino acid
  misc_feature (238)..(238): Xaa can be any naturally occurring amino acid
  misc_feature (262)..(262): Xaa can be any naturally occurring amino acid
  misc_feature (313)..(313): Xaa can be any naturally occurring amino acid
AYLGDSLEQVCTKKQAGTGPEFPGYRRPAPPVPHLLRSPRTAMDADADTVVFEAPAHFRFYKSGRIERLHRPPILPAGDDEATGXVTSKDVVLDADTGLSVRLYLPKLQEPSTKLLVLVYFHGGSFLIESADSSTYHNYVNALAAAAGVLAVSVDYRLAPEHPLPAAYDDSWGGAXWAALAQDEWIREHGDXARLFLAGDSAGXNIVHDMLMRVASNDGXPRVEGAILLHPWFGGSQXVEGEHPAAPMVTGMLWSYACPGAXGGADDPRMNPLAPGAPALERLGCVRMLVTAGLADGLAARDRAYHDAVAGSXWGGTAAWHGSDGEGHVFFLEKPGCDNAKQLMDRVVAFIAGA

SEQ ID NO: 72102 - protein, 333 aa, Rhizobium leguminosarum bv. viciae 3841
MVSTLPVSLEDIRAAARRIAGRVIGTPMVQSFSLGELAGVPVHLKLEHHQTTGSFKLRGATNAVLSLSPAERSRGVVAASTGNHGRALAYAAKAEGAVATICMSRLVPDNKVSESRRLGADVRIVGGSQDEAQQEVERLVREEGLVMVPPFDHPDVVAGQGTLGLEIIDILPEAAIVLVPLSGGGLAAGVAAAVKGISPTTKVIGLTMEKGAAMKASLDAGRPVQVEEVSSLADSLGGGIGLDNRVTFAMCRELLDDVILLTEVEIAVGMRHAYACERQIVEGAGAVGIAALLAGKIVGNGPIVAILSGANVDMEQHRRVINGKAALCGEERP

SEQ ID NO: 72103 - protein, 377 aa, Vibrio sp. Ex25
MEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGKPVHYLCDEGADWYPDLEDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAYELINQIPGVSCVKPKGAMYLFPKIDTKMYNIKNDQQMVLDFLKQEKVLLVQGSGFNWPKPDHFRIVTLPHVEDLEIAIGRFERFLSTYSQ

SEQ ID NO: 72104 - protein, 639 aa, Agrobacterium tumefaciens str. C58
MTGMPQTPLLDRVNFPSDLKEIDDRDLPELARELRDEMIDAVSKTGGHLGAGLGVVELTIAIHKVFNTPEDRLIFDVGHQCYPHKILTGRRDRIRTLRQEDGLSGFTRRAESEYDDFGAGHSSTSISAGLGMAVAAGLDGSDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDEKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILQIGKGRIIKEGTKVALLSFGTRLAECLAAAEDLDAAGLSTTVADARFAKPLDLDLIRQLAAHHEVLVTIEEGSVGGFGAHVLHFMASAGLLDHGPKVRTLTLPDQWVEQAKPETMYANAGLDRAGIVSTVFNALGQRQAGVGFAG

SEQ ID NO: 72105 - protein, 482 aa, Acinetobacter sp. ADP1
MNSQTKTTSMTPHSFDIHHLQDVLDQQKRAYQRYPVPSAKDRIDRLARLKRILIKYQDQFAEAINRDYGNRSVGETKIGELLTCLEHVGYYSKHLTQWMKPSKRHISILHQPAKGWVEYQPLGVIGIITPWNYPLLLSVGPLICALAAGNHAMIKISSASAHFGQVLENALSEAFPQELVTVINGGGAISDAFSHLPFDKMIFTGSTSVGKTVMAAASENLVPVILELGGKSPAIVHPSMDMKEAAQRLAVGKLWNAGQTCVAPDYVFLPKGRSAEFIENFKLIALNMYPHFRDNQDYTSIINDKQYRRLQGYLDDAREHGARVIEVNPHNESLDDVRKIAPTLLTGVTTEMDIMKNEIFGPIFPIFEYDQMEDVIEFINRRPRPLALYYFDFDQARADYIAQRTHSGHFGLNTVLTHVAQDDLPFGGVGASGMGKYHGPEGFFNLSHERSMMSNPKLYSLKYILPPFNKPIHRLISKTLLR

SEQ ID NO: 72106 - protein, 472 aa, Anaplasma phagocytophilum HZ
MFLFTKDLLDYVEKHGIKFIDWRFTDLLGRWYHITHSTNFLDPGVFTAGVAFDSSSVPGWQPIEASDMLLVPDISTAFVDPFSAQATLSVICNVVCPGDRTDYSRDPRYTARKAHHYLVSKSIADKCFFGPEVEFFVFDRVRFAAESHNSFFKLTSVESSSGASKRFDSSHGYGLKERGGYLCSSPMDSSHDMRSEVLSMLDEVGVKPLLHHHEVASSQCEVGFHHNELVAAADSVQKCKYVLRNVVGSYGKSVTFMPKPVVGDNGSGMHCHQSLWKDGNNIFAGDNGTAGLSDTCLYYIGGILAHGKALNAFANPSTNSYKRLVPNFEAPTWLAYSHGNRSAAVRVPFVPSNSVAARRIEVRFPDPLANPYLCFASQLMAGLDGIKNKIMPPEVQGRSLYDMSEDEVRGLSSVCFSLEEALEALDKDRGFLVEGGVFTNDQIDAYIKLKRQEAHELRIHPHPVEFSNYYAL

SEQ ID NO: 72107 - protein, 148 aa, Glycine max
MASTALSSAIVNTSFLRRQQTPISLRSLPLANTQSLFGLKSSTARGGRVTCMATYKVKFITPEGEQEVECEDDVYVLDAADEAGIDLPYSCRAGSCSSCAGKVVSGSVDQTDQSFLDDDQMNEGYVLTCVAYPTSDVVIETHKEEAIV

SEQ ID NO: 72108 - protein, 487 aa, Physcomitrella patens subsp. patens
MYKSLRSSHKLPPGPRPLPVVGNLTHITPVRFKCFMEWAQTYGSVLSVWMGPTLNVVVSSADAAKEMLKERDHALSSRPLTRAAARFSRNGQDLIWADYGPHYVKVRKVCTLELFTFKRLESLKPVREDEVGAMVAALFKDCADSRPLNLKKYVSAMAFNNITRIVFGKRFVDDKGNIDNQGVEFKEIVSQGMKLGASLKMSEHIPYLRWMFPLQEEEFAKHGARRDNLTKAIMQEHRLQSQKNGPGHHFVDALLSMQKQYDLSETTIIGLLWDMITAGMDTTAISVEWAIAELVRNPDVQVKAQQELDQVVGQDRVVTEADFSQLPYLQAVAKEALRLHPPTPLMLPHKATETVKIGGYDVPKGTVVHCNVYAISRDPTVWEEPLRFRPERFLEEDIDIKGHDYRLLPFGAGRRVCPGAQLGLNMVQLMLARLLHHFSWAPPPGVTPAAIDMTERPGVVTFMAAPLQVLATPRLRAALYKNGSSPS

SEQ ID NO: 72109 - protein, 324 aa, Magnaporthe grisea 70-15
MSSGRKIKLNSGHEIPVIGLGTWQSNPNEVAKAVEHALRNGYRHIDGALVYGNEHEVGEGIRASGVPRSDIFLTSKLWNTFHHPDDVEAGIDLTLRDLGTHYVDLYLIHWPVSFAPRENPRELFPIDPATGATHVVDIPDADTWRAMERLVESGKARSIGVSNFTRGRLEKLLQTARIRPAVNQIEAHPYLQQRELLEWHRQQGIVVQAYSPTGNNIYGRPKPLDDPVVLEVAARVGRTPAQVLVQWAAQRGTVVLPKSVTPSRIDENFVDFELPADEVEKLNALERHARYNFPARLGVDIFGEATEEELKAAVQAFIEQRRQA

SEQ ID NO: 72110 - protein, 263 aa, Bacillus clausii KSM-K16
MKRSHLFTSITLASVVTLATAPAASAASFLSPLQALKASWSYEGETGPEFWGDLDEAFAACSNGKEQSPINLFYDREQTSKWNWAFSYSEAAFSVENNGHTIQANVENEDAGGLEINGEAYQLIQFHFHTPSEHTIEETSFPMELHLVHANHAGDLAVLGVLMEMGNDHEGIEAVWEVMPEEEGTAAYSISLDPNLFLPESVTAYQYDGSLTTPPCSEGVKWTVLNDTISISETQLDAFRDIYPQNYRPVQELGDREIGFHYH

SEQ ID NO: 72111 - protein, 766 aa, Zea mays
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 72112 - protein, 376 aa, Bacillus clausii KSM-K16
MMKQSYVCRSCHTTYPVSRDLWKCLCGGLLDLDKQMPLLEPTAWESGPPTLWRFLDALPFEKDAKSWQNVTLGEGNTPLLPVSADKPNVYVKVDYLMPTLSFKDRGAAVLIAKALELGATSVIADSSGNAGTAVSAYAARAGIACEVFCSNTVSPKKQAQMAAYNAKVHTIAGTREDVARAAQQKAANLEEGGFYASHVYNPYFYEGTKTYAYEIYEQLGDAPDTVIIPVGNGTLLLGAYYGFSELLANRLIGKCPKIVAVQAQQCAPLAHAFATGEPSITPIVGQTTIAEGIAIAAPPRATQILEAVRNTGGTFITVSEAQIAKARSALAKQGFDVEPTSAATYAALHVYRHCETETIVIPLCGSGTKASDHIAK

SEQ ID NO: 72113 - protein, 175 aa, Frankia sp. CcI3
MAEELYATLRTTQGDIEIRLFPDHAPKTVRNFVGLATGTQEWTDPETGAKKTGTPLYSGTIFHRVIPNFMIQGGDPLGSGRGGPGYRFADEFHPDLTFNRPYLLAMANAGPGTNGSQFFVTVAPTDWLNRKHTIFGEVTRGTDVVDAIAKAPTGAQDRPKSDIVIQEIVIDRRSA

SEQ ID NO: 72114 - protein, 285 aa, Zea mays
MTTLSRMLPRLRSSATRALRKVFGLEPAAPPRRLPAPEAFVASERSLLRPLPGLDLPPCLPDNLSRSPTRVTTLPNGLRVATEDIPGPSACIGFFVNSGSVYESGETTGVSYLLERMGFKDTKHRSHLSIVSELELAGASVSVSASREQMVYSYDTLKGYMPEALEILIDCMRNPLFLQEEVQRQLVLAREGFQELQRSPERFLHEQLNIVGFSGALANPLIAPEHVLARINDRIIPKFYHENFTADRVVLAAAGVDHEHMLGYADFLLKDWHRGAPMEKAKSTY

SEQ ID NO: 72115 - protein, 79 aa, Oryza sativa
IGTGKVATSEQAQEVHAAIRKWAADKLGKDTAEKLRIIYGGSVAAKNCKELAQQPDIDGFLVGGASLKPEFVDIVNANN

SEQ ID NO: 72116 - protein, 223 aa, Zea mays
  misc_feature (211)..(211): Xaa can be any naturally occurring amino acid
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCXKWESVQAPWLIE

SEQ ID NO: 72117 - protein, 331 aa, Brucella melitensis 16M
MSKHAVSCAIPSQRTHQETTMARKIIIDTDPGQDDAVAILLALASPELDILGITAVAGNGPLARTEVNARTVCEVAKKPDTKVFAGSIRPLVRPLVTAENVHGKTGLDGYDLPAPTMPLQAQHGVDFIIETLMKEEPGTVTLCPIGPLTNIASALIRESKIAGRVKEIVLMGGGYFEGGNITPSAEFNIYVDPHAASVVFSSGIKITMLPLDVTHKVLTTEKRIAAIRNIGSHVGEVVAAWLEFFERYDEAKYGTDGAPLHDPNVIAYLIKPELYSGRACNVEIEINSELTIGETVVDWWEVTDRPKNAFFIKDVDADGFFSLLTERLATL

SEQ ID NO: 72118 - protein, 313 aa, Brucella melitensis 16M
MSHGEAPLKIFVFGSVNVDVSARMAALPRPEQTVNASGYGIGLGGKGANQAVAVAKLGGAIRFVGAVGHDAFGELALKQMREFGLDTGSVRVIDDVDTGMAIIQVEETGQNTIAVCAGANARWSSADIDAYGADIAKARITLLQREVPHEANLAVAKAVRAAGGTVLLDPAPVGDASQMADLIALSDIISPNETEAAEITGIEPTDLASAEAAGRKLLERGPKIVILKLGSRGALLVTADEVKHFTPFKVKVVDTVAAGDSFNGGFAVAFSQARPLHDCVRYGSAAGAIAVTRVGAGAAAPTAREVEELIGRA

SEQ ID NO: 72119 - protein, 495 aa, Mesorhizobium loti MAFF303099
MAVRNDVSTRSYQQFIGGRFVDGSGSGSIERRSPATGDLVARYADGTPEDVDLAVEAARIAFEDGPWPRMSGMERAEVLNRLADLIRTNRDRLVRIEVEEVGKPVRFARGDIDGAAGLTRYAASLAMQMAGLTYTNIGDGKTALISREAVGVVALVTPWNFPALILSQKVPFALAAGCTVVLKPSEFTPGSAFEIAALAAEAGVPAGAFNVVSGYGATAGDHLTGHMGIDFVSFTGSTRTGSRVVGNTSRHLVKSSVELGGKSANIVFADADLEAAADGALMGVFFNNGECCVSGSRLFVQSSIADDFIAKVIARSRKMKVGDPFDDDTDVGALIDRNHLAKVTGFVKSGIEEGAQLVLGGNVAAGAVGHFHEATIFDRVEPHMTIFREEIFGPVLSITRFDTVDDAVRLANDTAYGLSNYIWSKNIDTVLTVAKRLKSGWVQANTIIDGAPQLPLTGVKGSGFGYEMGQAGFEEFTQLKTLLIQTGPRAPVFPV

SEQ ID NO: 72120 - protein, 599 aa, Lactobacillus casei
MDQSKTNQNNQHSVAESAQLKSDETANQPKVEEESSVKQDVQPSKNVNQQDVATQSNERENNDIKGESQTLKASNQHTQSSNSHNQSIGTKDSDSEELDQPLVKLQKPSNDSTYQTQSKAKQDSSKQLPQEKTTKHQIQTTENEQTTNVDSKKANDTQDARQHTQEPKNDTSTSQKNHHQVATKEQSNRSTTRETQKQSANSNQNHQSTHQAQFKNQYPVVFVHGFLGFTGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSCIIGKDANKEIRPNDGVVPVISSQHPSNQTFKKVDDHTPATDKGVWQVRPVQHDWDHLDLVGMDAFDLTHTGRELGQFYLGIMDNIMRIEEADGITNK

SEQ ID NO: 72121 - protein, 286 aa, Vitis vinifera
MEGKEEDVRLGANKFAERQPIGTSAQTDKDYREPPPAPLFDPGELHSWSFWRAGIAEFMATFIFLYIIISTIIGVVKSPNKCATVGFQGIAWACGGMIFVLVYCTAGISGGHINPAVTFGLLLARKLSLTRAVFYMIMQCLGAICGAGMVKWFQRHDFETLGGGINAVASGYSKLAGLGAEIVGTFVLVYTVLSATDAKRNARDSHVPILAPLPIGFAVFLVHLATIPITGTGINPARSLGAAIIYNRGNAWDDMWIFWVGPFIGATLATLYHQIVIRAIPFKTRA

SEQ ID NO: 72122 - protein, 506 aa, Musa acuminata
MDVTGTTFLFASFLVLLLLLLRKHSYSRRGNARLPPGPFKLPLIGSLHHVLGPLPYRSLAALSEKFGAVMLLKLGEVPTLVVSSPEAAAEIMKTQDVSFASRPMISSVRIIAYGDKSPVFAPYGSYWREVRKMSILELLSVKRVLSFRSIREEEVLNFVRSMDLSSNSGSTVNLSSKFALMTNDIAARAIIGRKCKYQKQFLQVINRALEASGGFSLADLFPSSSLVSLLSGIPLKLPRLHREMDAILSSIIQEHRERNSTEQVEEDLVDVLLKVQREGSVPFAFTDVAVKAIILDLFGAGGETTATTLEWIMSELMRNPGAMKRVQQEVRETVGGKGRVREEDINEMKYLRMIIKETLRLHPPLPLLLPRECQEPREILGYQIPEKTRVLVNVWALGRDPRHWDDAAMFKPERFDRGSSTVDFKGNNFEFIPFGAGRRMCPGIAFGMASVELPLASLLYHFDWELPARDGVKPNELDMTENFSLTCRRRSELCLRAIHRNPCPMY

SEQ ID NO: 72123 - protein, 252 aa, Streptomyces avermitilis MA-4680
MSHPLFDIAGRTALVTGSSRGIGRALARGLLEAGCTVVLNGRDGDRLTAAAAELPGDVRTAAFDVTDGPSVAAGIAEVEERVGPLDILVNNAGIQLRAPLLEFTDSDWHRILNTNLTSAFLVGREAARRMTERGHGKIVNICSLQSEVVRPGIAPYAATKGALKMLTKGMCADWGPYGVQVNGLGPGYIETELTRPLVEDEEFSAWVRHRTPAGRWGRTEDLVGGVLFLASPAADFVSGQVLYVDGGMTSVL

SEQ ID NO: 72124 - protein, 506 aa, Musa acuminata
MDVTGTTFLFASFLVLLLLLLRKHSYSRRGNARLPPGPFKLPLIGSLHHVLGPLPYRSLAALSEKFGAVMLLKLGEVPTLVVSSPEAAAEIMKTQDVSFASRPMISSVRIIAYGDKSPAFAPYGSYWREIRKMSILELLSVKRVLSFRSIREEEVLNFVRSTDLSSNSGSTVNLSSKFALMTNDIAARAIIGRKCKYQKQFLQVLNRGLEASGGFSLVDLFPSSSLVSLLSGMSLKLPRLHREMDAILSSIIQEHRERNSTEQVEEDLVDVLLKVQREGSLPFAFTDVAVKAIILDLFGAGGETTSTTLEWIMSELMRNPGAMKRVQQEVRETVGGKGRVREEDINEMNYLRMIIKETLRLHPPLPLLLPRECQEPREILGYQIPEKTRVLVNVWALGRDPRHWDDAAMFKPERFDRGSSTVDFKGNNFEFIPFGAGRRMCPGIAFGMASVELPLASLLYHFDWELPERDGVKPNELDMTENFSLTCHRRSELCLRAVLRNPCPMH

SEQ ID NO: 72125 - protein, 189 aa, Staphylococcus epidermidis ATCC 12228
MSLINKEILPFTAQAYDPKKDEFKEVTQEDFKGSWNVVCFYPADFSFVCPTELEDLQNQYAKLQELGVNVYSVSTDTHFVHKAWHDHSDAISKLEYSMIGDPSQTITRNFDVLDEESGLAQRGTFIIDPDGVVQAAEINADGIGRDASTLVNKIKAAQYVRQHPGEVCPAKWEEGSESLQPGLDLVGKI

SEQ ID NO: 72126 - protein, 371 aa, Vitis vinifera
MAALSSFFKRKSSIPFTSLAIRRWFSTQPILDSPSFSQRIRDLPKDLPGTNIKKEVSQLIGKTPLVFLNKVTEGCGAYVAVKQEMMQPTASIKDRPALAMITDAEDKQLITPGKTVLIEPTSGNMGISMAFMAAMKGYKMVLTMPSYTSLERRVTMRAFGADLILTDPTKGMGGTVKKAYELLESTPDAFMLQQFSNPANTQVHFETTGPEIWEDTRGQVDIFIMGIGSGGTVSGVGRYLKSQNPNVKIYGLEPTESNVLNGGKPGPHHITGNGVGFKPDILDMDVMEEVLMVSSEDAVNMARQLALKEGLMVGISSGANTVAALRLARRPENKGKLIVTIHPSFGERYLSSVLFQELRKEAENMQPVSVD

SEQ ID NO: 72127 - protein, 132 aa, Physcomitrella patens subsp. patens
SMSNPEYHVLAVDDSIIDRKVIERLLKTSSYKVTTVNSALRALEYLGLSESCSTSVKANKVTVNLIMTDYCMPEMTGYDLLKIVKAETSAFKELPVIVMSSENDSNRIKRCLEEGAKEFLIKPVQIEDVQRL

SEQ ID NO: 72128 - protein, 145 aa, Streptococcus pyogenes M1 GAS
METSDELKQRIGDLSYEVTQHAATESPFTGEYDNFFEKGIYVDIVSGEVLFSSLDKFNSGCGWPAFSKPIENRMVTNHDDSSYGMRRVEVKSREAGSHLGHVFSDGPKEAGGLRYCINSAALKFIPYDQMEKEGYAQWLTLFDET

SEQ ID NO: 72129 - protein, 207 aa, Brassica rapa subsp. pekinensis
WFQGTADAVRQYLWLFEEHNVLEFLVLAGDHLYRMDYEKFIQAHRETDADITVAALPMDEKRSTAFGLMKIDDEGRIIEFAEKPKGEQLKAMKVDTTILGLDDERAKEIPFIASMGIYVVSKNVMLDLLRDQFPGANDFGSEVIPGATDLGLRVQAYLYDGYWEDIGTIEAFYNANLGITKKPVPDFSFYGRSAPIYTQPRYLPPSK

SEQ ID NO: 72130 - protein, 469 aa, Pediococcus pentosaceus ATCC 25745
MSTGKVVQVIGPVIDVEFPLDEELPTINNALKIKKADGTVLVSEVTLELGDGVVRTIAMDGTDGLQRGLDVEDTGDSIKVPVGKETLGRVFNVLGDTIDGGKELGPDIKRDPIHRDPPDYDELNPSTEVLETGIKVIDLLAPYIRGGKIGLFGGAGVGKTVLIQELIHNIAQEHNGISVFTGVGERTREGNDLYFEMKGSGVLERTAMVYGQMNEPPGARMRVALTGLTIAEHFRDVEGQDVLLFIDNIFRFTQAGSEVSALLGRIPSAVGYQPTLATEMGQLQERITSTKKGSVTSIQAVYVPADDYTDPAPATTFAHLDATTNLERALTQQGIYPAVDPLASTSTALDPQIVGEEHYEVATEVQHVLQRYKELQDIISILGMDELSDEEKTVVARARRIQLFLSQDFSVAAQFTGLPGHYVKIEDTISGFKGILDGKYDDLPEEAFRLVGSIDDVVEKAKKISATED

SEQ ID NO: 72131 - protein, 316 aa, Sorghum bicolor
MVVPVIDFSKLELDGAERAETLAQIANGCEEWGFFQLVNHGIPLELLERVKKVCSDCYRLREAGFKASEPVRTLEALLDAERRGEEVAPVDDLDWEDIFYIHDGSQWPSDPPAFKETMREYRAELRKLAERVMEAMDENLGLDRGTIKAAFSGDGRHEPFFGTKVSHYPPCPRPDLITGLRAHTDAGGVILLFQDDKVGGLEVLKDGQWTDVQPLAGAIVVNTGDQIEVLSNGRYRSAWHRVLPMRDGNRRSIASFYNPASEATISPAAVATSGGEAYPKYMFGDYMDVYVKQKFQAKEPRFEAVKAAAPKSSPAA

SEQ ID NO: 72132 - protein, 366 aa, Agrobacterium tumefaciens str. C58
MAYDQKRVVDAIRAFEAGEIVVVTDDDDRENEGDLIISAVHCTPEKMALIVRHTSGIVCAPMPREEAKRLNLNAMVAENDSAHTTAFTVSVDFKHGTTTGISADDRTLTVRNLANPNVGASDFTRPGHIFPLISREGGVLMRSGHTEAAVDLCRLAGLPPIGVISELVNDDGSVMRGPQVLDFADKHGMKHVSVADLIAYRQRKETLVEMESSFTIETPFGPAMAQTYSLPWDPMQHMAVIFGDIRDGVDIPVRLHTENVADDVFGDRQPVRHYMQKIAEEGRGVIVYLREGSVGVGQVAGRRKARDPDEAHAQARSRENEWLEIGLGAQILKDLGISSIKLLTTRERHYVGLEGFGIQISATDIC

SEQ ID NO: 72133 - protein, 168 aa, Anabaena variabilis ATCC 29413
MNKIFIKLFGLIVIVMLAWFWVIIDTHPAFAQINTINYNNANLENRDFANADLVGVNFVAAEMRGTNFQGANLTNAILTKGVLLKANLSEANLTGALVDRVTLDNANLKNAIFTEATLTRSRFYDADITGADFTDAIIDRYQVSLLCERADGVNPVTGVATRDSLGCK

SEQ ID NO: 72134 - protein, 354 aa, Anabaena variabilis ATCC 29413
MSSPLFPVILAGGKGERFWPLSRQDRPKQFLSLDGSSRSLLQSTAERLVKFAGEWNDLWVITSSQLGQGVQQQLPELPSQNLLTEPQGRDTAAAVAWASLEIQKRYGDDAIIGFFPSDHWIADPEAFKRTLDAASQLATSTEAIVTLGIKPTFPSTGYGYIEQGEKIGTFNELPAYHVNRFTEKPIREKAETFLSTGRYSWNSGMFVFRAGVVLKELYTYAPEIIEPLVEHGVDVYPQLPKKSIDYALMEKTNLVYVLPAEFGWDDLGDWNAIERLLKKPDDPNVELATHVGLDTQGAIVYATNPEDVIVTIGLEDVVIVRDRNVTLIVNKERTQEIKQIIKTLQGDPRFTDLL

SEQ ID NO: 72135 - protein, 1170 aa, Arabidopsis thaliana
MTMSQTDGVEFASRNTNENGHDDDDQLRSQWVAIERSPTFERITTALFCKRDEKGKKSQRRVMDVSKLDDLDRRLFIDDLIRHVENDNHVLLQKIRKRIDEVGIDLPKIEARFSDLFVEAECEVVYGKPIPTLWNAISSKLSRFMCSNQAKKISILKGVSGIIRPKRMTLLLGPPSCGKTTLLLALSGRLDPSLKTRGDISYNGHLFSEFVPEKTSSYVSQNDLHIPELSVRETLDFSGCFQGTGSRLEMTKEISRREKLKGIVPDPDIDAYMKILGLTICADTRVGDASRPGISGGQKRRLTTGEMIVGPIKTLFMDEISNGLDSSTTFQILSCLQQFARLSEGTILVSLLQPAPETFELFDDLILMGEGKIIYHGPRDFVCSFFEDCGFKCPNRKSVAEFLQEVISRKDQEQYWCHIEKTYCYVSIESFIEKFKKSDLGLELQDRLSKTYDKSQTQKDGLCFRKYSLSNWDMLKACSRREFLLMKRNSFVYVFKSGLLIFIGFIAMTVYLRTGSTRDSLHANYLMGSLFFSLFKLLADGLPELTLTISRIAVFCKQKELYFYPAWAYAIPSAILKIPISFLESFLWTMLTYYVIGYSPEMGRFIRQFLILFALHLSCISMFRAIAAVFRDFVVATTVGSISIVLLSVFGGFIVRKPSMPSWLEWGFWLSPLSYAEIGLTANEFFAPRWGKITSENRTLGEQVLDARGLNFGNQSYWNAFGALIGFTLFFNTVFALALTFLKSAFKPGVLTALMGVSGAGKTTLLDVLSGRKTFGDIKGQIEVGGYVKVQDTFSRVSGYCEQFDIHSPNLTVQESLKYSAWLRLTSNISSETKCAIVNEVLETIELEEIKDSIVGIPGISGLTTEQRKRLTIAVELVSNPSIIFMDEPTTGLDARAAAIVMRAVKNIAETGRTVVCTIHQPSIDIFEAFDELILMKNGGKIIYYGPLGQHSSKVIEYFMRIHGVPKLKENSNPATWILDITSKSSEDKLGVDLAQMYEESTLFKNNQQDLFNVFGSMFTVVLFSGINNCSTVLFSVATERNVFYRERFSLVVTPNVHIAFTLRSSFYAIVNLFAGYVMPKPNIPRWWIWMYYLSPTSWVLNGLLTSQYGDMEKEILAFGEKKKVSDFLEDYFGYRYDSLALVAVVLIAFPILLASLFAFFIGKLNFQKK

SEQ ID NO: 72136 - protein, 493 aa, Ralstonia metallidurans CH34
MTKRQASTATTTKTTAKARRRASEVSAEPVVERVPRRKRSVRPTTREADFVVIGAGSGGVAAARRAASHGARVILVERDAIGGTCVNRGCVPKKMLSYGANWASILSTCLSHTGGKEDWRDASVRVNAEVARLNASYAQRLNEAGVEILHGDARLSGADEVVVGNEIIRTRKTLIATGAHPLALPVPGGELASSSDDVFTWQTVPASIAVIGGGYIAVEMASILSRYGVKVDLLVRGDRLLPKFDHDIAAALAEALAAKGVRLHFRADVTMLSQANGATEVCYTQQNNPGRTQTVRAQAVLAAIGRRPSIAELGLDALGVQLGERGGICVDRQFRTTVRSIHAIGDCMDRNLHLTPVAIAQGRWLADRLFGKRGDIADFDFVPTAVFSEPAIGAVGLTEAQAIEAAGGRADRVRTEIKRFVSLENRFGGVAQPSVFKLVFNARSGRVLGAHLMDNAAPEIIQTFAVALRLGVKDAHLKTTMPLHPTVAEELFG

SEQ ID NO: 72137 - protein, 427 aa, Photobacterium sp. SKA34
MSFQSLNLHPNLLKALTDLGYSTPTDVQQQAIPLALKGDDVMAGAQTGTGKTAAFTLPLLQRLMTLPSQAEQVSTAVENNQKSRNKIRALILTPTRELAQQVFDSITTYAKYTEIKVAVAYGGTSMNVQVKALNAGAEILVATPGRLLDHVFNGSVSLSEVETFVLDEADRMLDMGFIVDIQRIMKRMPAERQTLFFSATFSKQVKKLAFDILTNPKMVEVTPANTAAETVEQIVYPVDKHRKAELLAYLIGSRNWRQVLVFTKTKQGSDQLAKDLGLDGIKASSINGDKSQGARQRALDDFKSGKTRVLVATDVAARGLDIEQLEYVVNFDMPFKAEDYVHRIGRTGRAGMTGHAITLMSLDEEWALKAIEELLDSRLPQQWLEGYEPNPALIETQSVHRGAAAEKRRAKSKSKIHQNRGKHRNRR

SEQ ID NO: 72138 - protein, 132 aa, Helicobacter pylori
SNIKYELDKKSGALMVDRVLYGAQNYPANYGFVPNTLGSDGDPVDALVLSDVAFQAGSVVKARLVGVLNMEDESGMDEKLLALPIDKIDPTHSYIKDINDLSKHTLDKIKHFFETYKDLEPNKWVKVKGFEN

SEQ ID NO: 72139 - protein, 506 aa, Oryza sativa
MEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRPSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDDYISEEMEGSVDGLSEQVSRMHS

SEQ ID NO: 72140 - protein, 110 aa, Triticum aestivum
  misc_feature (59)..(59): Xaa can be any naturally occurring amino acid
  misc_feature (78)..(78): Xaa can be any naturally occurring amino acid
  misc_feature (98)..(98): Xaa can be any naturally occurring amino acid
MDANRRQSGIQQLLAAEQEAQQIVNAARAAKSARLRQAKEEAEREIAEYRAQMEAEFQXRKVAESSGDSGANVKRLEXETAAKIEQLTQASHNISPDXIQMLLRIHNVKN

SEQ ID NO: 72141 - protein, 188 aa, Brassica rapa subsp. pekinensis
AGGVQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTGKVPDFSVDWVKGSKFGILVIIHSHAKHGNAQICDFGYNLGYWSIAIKRSLLCFWSVA

SEQ ID NO: 72142 - protein, 418 aa, Euphorbia esula
MFGRAPKKSDNSKYYEILGVSKSASQDDLKKAYRKAAIKNHPDKGGDPEKFKELAQAYEVLSDPEKRDIYDQYGEDALKEGMGGGGGGHDPFDIFQSFFGGSPFGGGGSSRGRRQRRGEDVTHPLKVSLEDLYNGTSKKLSLSRNVICSKCKGKGSKSGASMKCSGCQGSGMKVSIRHLGPSMIQQMQHPCNECKGTGETINDKDRVPPVQGRKGLFKRRKVLEVHVEKGMQNGQKITFPGEADEAPDTVTGDIVFILQQREHPKFKRRGDDLVVEHTLSLTEALCGFQFILTHLDGRQLLIKSQPGEVVKPDQFKAINDEGMPMYQRPFMRGKLYIHFNVEFPDSLPPDQSKALEAVLPSRTSVQLSDMEVDECEETTLHDVNFEEEMRRKQQQSAEAYDEDEDMPGGAQRVQCAQQ

SEQ ID NO: 72143 - protein, 174 aa, Zea mays
  misc_feature (61)..(61): Xaa can be any naturally occurring amino acid
  misc_feature (120)..(120): Xaa can be any naturally occurring amino acid
  misc_feature (131)..(131): Xaa can be any naturally occurring amino acid
MSARPSMSAVGHAAHTDSHMRPHTIHLDMVMYCNDCSGPFIINNPSGYQIILIGDFIRSLXKKKGFYLRAMKMMNVYRPFHQQHYAYLTDTPFLPSVGEYIISGLVKPMVYQAKDVWMTXGRYIIVANKPXEAHPSTIRTDYHAECGMKLIHGSDFKQNGKKEIALWLPVRLAQ

SEQ ID NO: 72144 - protein, 536 aa, Xanthomonas oryzae pv. oryzae KACC10331
MSVIDSQLQVSSESFQHNAAAMRAVIDDLRHTLAQTARGGSEAARAKHTARGKLLVRERIDALLDRGSALLEIAPLAAHGMYDDQVPCAGVVAGIGRVSGVECVIVANDATVKGGTYYPMTVKKHLRAQEIAQQNRLPCIYLVDSGGAFLPLQDDVFPDRDHFGRIFYNQANLSANGIPQIACVMGSCTAGGAYVPAMSDETVIVREQGTIFLGGPPLVKAATGEEVSAEELGGAEVHTRISGVADHFADNDLQALTRVRAIIAQLNWRKPAASLALQAPRPPRYAADELYGVIPADTRKPFDVREVIARIVDDSRLDEFKPRYGSTLVTGFAHLHGYPVGIIANNGILFSESALKGAHFIELCTQRGIALVFLQNITGFMVGRKYEHGGIAKDGAKLVMAVACAKVPKFTVVIGGSFGAGNYGMCGRAYSPNFLWMWPNARIGVMGGEQAASVLATVRRDGIEANGGAWSGEEEDAFKAPIRAQFEQQGHPYYASARLWDDGIIDPADTRRVLGLGLSAALNAPIEPTRFGVFRM

SEQ ID NO: 72145 - protein, 260 aa, Bacillus licheniformis ATCC 14580
MSKVSGKIAFVTGGGQGIGEAICKRLAEDGFAVAVADYNVETATQVAEDINKLNGKAIAVKVDVADRDDVFKAVDETVKRLGGLDVVINNAGLGPTTPIESITYEDYRKVYDVNVGGTYWGIQAAVKAFKELGHGGKIINASSQAGQVGNPGLAVYGGTKFAVRGITQTAAKDLAELGITVNAFCPGIVKTPMMMGIAQQTADEAGKPFEWGMEQFAKNIALKRLSEPEDVAACVSYLAGPDSDYMTGQALIIDGGMVFN

SEQ ID NO: 72146 - protein, 545 aa, Synechococcus elongatus PCC 6301
MLANWIGILLGGFLAGQIARRLGAPALIGMILWGIVLGPQVSQWLSPAVLDQAGIWRTLAVMVILVKAGLGLERDKLVQQGSVALRLGILPAACEAVVIAIAAHYLLNFDWLTGLLLGCVIGAESPAVIVPGMLRLKQLGLGVRKGIPDAILTGSALSDVLLLLVFSLLLALLTQGNAHIWTLPGLGPVNPWLLLPLQVLLQVSLGAVLGFVVARLLVRMLGPQNWTQTLTQDTLVTAAIALGLVLAAEQLPIFSGYLAVMVLGYFVVELYAPLARRLRQGFDSLWAIAQIALFVLLGAGLPLTALASLWLPGLLILVLGTLLGRSIGWALSTWGSNWNWQERSFLLAGNSAKATVQAAIGGVPLAAGLPEGQSILAIAVLSIVITAPLGAWAIPTFAPRLLSRDPVDPSQVSRDRPVRLLAAVDSSPVAIAVLLKTAELARRSDAEVAVLHVAQVSDTQSLQTLQRQIEQSLADIRYQFWLREGAIPETINRCAQEWQADEIILGKHEQSHRPEMRLGSVSQALLDVSTVPMILVETVAELQTS

SEQ ID NO: 72147 - protein, 302 aa, Vitis vinifera
  misc_feature (51)..(51): Xaa can be any naturally occurring amino acid
  misc_feature (267)..(267): Xaa can be any naturally occurring amino acid
MAWELGFRRLEWAMTKFQKRKTNSPEESDAAGVEGIGKTRWVCPMEMEMEXEVELQCRPTNMVPCRVSPHEVAASRLVELLLTQWSVRSHTNQWLLRMPRIIVLLEFLLRFGSSPTFPNQDITTLLLDPQAFKDTIDLFVERYKGKNISVVAGIEARGFIFGPPIALAIGAKFVPMRKPNKLPVGLSDKAIKELHLLVIAVIFECRISASLNLAIGAVISQEYALEYGTDKIEMHVGAVQAGERALVIDDLIATGGTLCAAINLLEXVEVDVVECACVIELPELKGRDRLGDKPLFVLVSAA

SEQ ID NO: 72148 - protein, 455 aa, Yarrowia lipolytica CLIB122
MRLVSFLPLLLIHTTAATSADTTAVDLSDFYAGTNPSALDSAISVPEGNYKPKHVVHISRRRLICRTNEDTGEEICKVDNSDPQESIIEEVDCSKKERNTNVGLRVGALFAVLGTSALGVFPPVLAESIWRINLETLPMTFIKQFGTGVVLSTAFVHLGAEATEEFNNPCIGEVEYKPTPLAFVLAGLFISFLIEYLGARLLRWRANTLEARRNENQDCEETKCGHDHDHGHIIDNTGGDTEDSDNGGEPVQEIVEDVIEKAPSRLSSSSVRRSTTQTTAPPPPIAGGCHSHGLIDPTDKFSVWIMEAGIIFHSVLVGVTVSLAEEDTFITLFIAILFHQMFEGVGLGSRIAGLKESRLISKCLMCLWFSIITPIGMAIGLGVLDHFEENPTTLWALGSIDGLCCGVLVYAGVVEMLGFDWLFGDLQDAPPLRVCVGLVGLTLGMLLMSLVGHWA

SEQ ID NO: 72149 - protein, 891 aa, Cardamine flexuosa
MKIITEGRFHVSLLSLLLLLSASHLISAADYSPTDKILLNCGGASDLVDTDNRTWISDVKSKFLSSSGDSKTSPAATQDPSVSQVPYMTARVFRSPFTYPFPVAAGRKFVRLYFYPNTYDGLNATNALFSVSFGPYTLLKNFSAAQTAEALTYAVIVKEFIVNVEGGSLNMTFTPESNAYAFMNGIEVTSMPDIYSSTDGSLIMVGASSDFTIDNSTALENVFRLNVGGNDISPSADTGLYRSWYDDQPYIFAAGLGIPETADPNMTIQYPTGTPTYVAPVDVYSTARSMGPTASININYNLTWVFSIDSGFSYLVRLHFCEVSPRITKINQRVFTIYLNNQTAEEEADVIAWAQGNGIPFHKDYVVNPPEGKGQQDLWLALHPNTRNKPEYYDSILSGVEIFKVNTSDGNLAGSNPIPGPKVTADPFKVLRPRTSQSRNHTTIIVGAAIGAVVLALIIGLCVMVAYCRRNRGDYQPASDATSGWLPLSLYGNSHSAGSTKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAHGTMREHLYKTQNSPLPWKQRLEICIGAARGLHYLHTGAKHTIIHRDVKTTNILLDEKWVAKVSDFGLSKTGPTLDHTHVSTVVKGSFGYLDPEYFRRQQLTDKSDVYSFGVVLFEALCARPALNPTLAKEQVSLAEWAPYCYKKGMLDQIVDPYLKGKITPECFKKFAETAMKCVLDQGIERPSMGDVLWNLEFALQLQESAEENGKGMSGDMDMDEIKYNDGNGKGKNEMSSDVYEGNVTDSRSSGIDMSIGGRSLASEDSEGLTPSAVFSQIMNPKGR

SEQ ID NO: 72150 - protein, 448 aa, Clostridium perfringens str. 13
MEVKKYVDNLMEDLKKNNPGESEFLAAAEEVLYSLVPVLEKNPKYMEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSSGYVYDENGIDLEVVKEIKEVKRGRISEYVNYVKTAKFTEGFRGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSRNAASEYGHDGNLIVGANIAGFKKVADAMLDHGII

SEQ ID NO: 72151 - protein, 328 aa, Prochlorococcus marinus str. MIT 9303
MSRIYEDNSQAIGNTPLVKLHAVSKNAKATVLAKIEGRNPAYSVKCRIGANMIWDAEKRGLLSKERTIIEPTSGNTGIALAFTAAARGYKLILTMPESMSLERRRVMAVLGAELILTEAAKGMPGAIAKAKEIAESDPQKYFMPGQFENPANPDIHSKTTGPEIWNDCDGAIDVLVAGVGTGGTITGVSRYIKQEKGKSIVSVAVEPTHSPVISQTLNGEDVKPGPHKIQGIGAGFIPKNLDLALVDRVEQVSNDESIAMALRLANEEGLLVGISSGAAVAAAIRLAEQPEFAGKTIVVVLPDMAERYLSSVMFESVPTGIIQDPVAA

SEQ ID NO: 72152 - protein, 260 aa, Zea mays
MRSSEASSRLVQELVLYAASAALSPCLVLFAGLRHLDPNRAASQKAQQQKKEIAKRLGRPLVSTTPYEDVIACDVINPDSIDVEFDSIGGLDQIKQALYELVILPLRRPELFTFGKLLSPQKGVLLYGPPGTGKTMLAKAIARESGAVFINVRISNLMSKWFGDAQKLVAAVFSLAHKLQPAIIFIDEVDSFLGQRRTTDHEAMTNMKTEFMSLWDGFTTDQNARVMVLAATNRPSELDEAILRRLTQIFEIGFPVESER

SEQ ID NO: 72153 - protein, 489 aa, Frankia sp. CcI3
MSRAPHVRSVAAPPSTAKTSDIKTSDRVPGSGEGPVEAIRRLRADPLTRLNELARAHGPVVRLASWPVSAFLVTDPDAIADALVSGHRAYAKGAVRRGAGSRRTVVQPLALLLGQGLLTSAGDTHRQQRRLLQPLFHKQRIAGYADAFAAIADKTADGWRDGQRLDVHTEMTEMTLAIVARTLFDVDLDSHVVDVIRAALDQNMPAARRAQLPGFTTLERLPLPAPRRRRDARNALDRVVHDLIADRRATGATGNDLLSLLLTARDADTGASMDDSQVRDEALTLLLAGHETTANALTWTFHLLGRDPEVLATLQAELDRVLGERRPTIDDLPQLPYTNAVISEAMRLYPPVWAMGRHLVEDRDVAGYRLPAGSTLVFSQWVVHRDERWWPRPELFDPIRWTGPDTADEPADAGPKMRPRFAYFPFGAGPRQCIGNTFAITEGVLALAAIARRWSFTPVPGLPVTPQPLVTLRPKDGLPMIAHGRYPNR

SEQ ID NO: 72154 - protein, 393 aa, Rhodopirellula baltica SH 1
MPEVSSASNHRFQPSSNRQRVNMHPWIADRTASFDSSGIRKVFDLAAKLKDPINLSIGQPDFDVPEEIQDATVDAIRSGKNAYSPTQGIAPLREKLLAEINAKYPGQNRDVFVSSGTSGGLVLSLLSMINPGDEVIFLDPYFVMYPALVSLCGGIPVTVDSYPDFRLDPAKIEAAITPKTKMILVNSPANPTGVTASEQDLRDVGDLAAKHNIALLSDEIYSRFFYDGDFASPAATNPDTIVIDGFSKSHAMTGWRVGYVHGPPEIIATMLKIQQYSFVCSPQPAQWGALRAMEISLDGHIDDYRRKRDFMVEQLSPHFELTSPGGAFYLFPKAPGTEGGTAFVERAIADGLLIIPGKIFSSRDSHFRVSFAASDDTLRRGAERLIKLAGDNR

SEQ ID NO: 72155 - protein, 310 aa, Bacillus clausii KSM-K16
MARKILLDVDTGVDDALAIILASKSTDAQLLAITTVNGNVSLEKATVNTLKVLTLLHKEGDIPVIQGAHAPLRRPCFFEHSVHGNDGLGGALPHFEPTAQPADGYAPDYIIEQANRYPGELTLVMTGPLTNLALALEKCPDLPKLVAGVVYMGGAAFTHGNVTPVAEYNMYVDPEAARKVIHAGFAPLVQVGLDVTRKALLTRENIGSLVDSPIKQFIKTCTADYIKRYEARNTVAACALHDPLAVAYALKPELLHLEEMFVEVETNSQFCDGQTVCDRQQRLGKPANVNVATEIDSDAFLSYFLHSIQN

SEQ ID NO: 72156 - protein, 153 aa, Saccharomyces cerevisiae YJM789
MSSQTERTFIAVKPDGVQRGLVSQILSRFEKRGYKLVAIKLVKADDKLLEQHYAEHVGKPFFPKMVSFMKSGPILATVWEGKDVVKQGRTILGATNPLASAPGTIRGDFGIDLGRNVCHGSDSVDSAEREINLWFKKEELVDWESNQAKWIYE

SEQ ID NO: 72157 - protein, 283 aa, Triticum aestivum
  misc_feature (78)..(78): Xaa can be any naturally occurring amino acid
RCGGPKASPMEYLKDEHVCGRALGIRFDKRTGDLYIADAYFGLSKVGPDGGLATPLATEAEGVRFNFTNDLDLDADGXVYFTDSSVLYQRRHFMQLVFSGDASGRLLKYNPETKETTVLHRNLQFPNGVSLSKDGSFFVFCEGSRGRLSRYWLKGEKAGTVDLFAILPGFPDNVRTNDKGEFWVAIHCRRSAYARLLSRRVQLRKFLLSLPIPAKYHYLMQIGGNLHALIIKYSPEGEVLDILEDTKGQVVRAVSEVEEKDGKLWIGSVLMPFIAVFDYAKES

SEQ ID NO: 72158 - protein, 472 aa, Escherichia coli O157:H7 EDL933
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVQAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETREEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHSMEWLAKHSVELDSQGRIIAPEGSDNAFQTSNPKIFAGGDIVRGSDLVVTAIAEGRKAADGIMNWLEV

SEQ ID NO: 72159 - protein, 190 aa, Moritella sp. PE36
TNINDYKGAIMSTSLRKYQGILPQLANSAYVDKSAVLIGDITIDEDASIWPLVAARGDVNKIVIGARTNVQDGCVLHVTRKSPANPNGIPLIIGDDVTVGHKALLHACTIGDRVLIGMGAIVLDGAIIEDDVMIGAGTLVPPRKKLASGYLYIGSPAKQARKLTDDEIAFLKLSADNYVLLKNEYIADSQ

SEQ ID NO: 72160 - protein, 445 aa, Citrobacter amalonaticus
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSEEGFNFIGTGVSGGEEGALKGPSIMPGGQKEAYELVAPILKQIAAVAEDGEPCVTYIGADGAGHYVKMVHNGIEYGDMQLIAEAYSLLKGGLNLSNEELATTFSEWNKGELSSYLIDITKDIFTKKDEEGKYLVDVILDEAANKGTGKWTSQSSLDLGEPLSLITESVFARYISSLKTQRVAASKVLTGPQAQPAGDKAEFIEKVRRALYLGKIVSYAQGFSQLRAASDEYNWDLNYGEIAKIFRAGCIIRAQFLQKITDAYAENPAIANLLLAPYFKQIADDYQQALRDVVSYAVQNGIPVPTFSAAVAYYDSYRAAVLPANLIQAQRDYFGAHTYKRT

SEQ ID NO: 72161 - protein, 463 aa, Legionella pneumophila str. Lens
MDLFRKKDIKGSPDSESHLAKCLSVFDLTFLGVGAIIGAGIFVLTGIVAATISGPAVIFSYVVAGFACAFAALSYAELAASIGGCGSAYGYAYAGFGELIAWIVGWDLLLEYSIAVSAVSIGWSGYANDFLMALKIFIPTHLLHGPADGGDLNILAILIIAVLTTLLIVGVKSSSRFNNIMVLVKLLVIFIFIAIAFGEVKVENWSSFMPYGWAGVMKGASIIFFAYVGFDAVSTAAEEAINPQRDLPIGIIASLAICTVIYILVSGLLTGIAHYTTLNVSSPISHVLLVLGYKTAAGLVGVGAIAGLTTVMLVLFYGLTRVFLAMSRDGLLPRFLSKTNEHTKTPIRIILLCGILMASLASVTPIGTLAELVNIGTLFAFIVVCGGVLYLRRTHPDMERPFKTPFMPYVPILGIISCFYLILNLPWVTILRFIIWMLVGIAVYFAFSRTNSALSVEGDCAAE

SEQ ID NO: 72162 - protein, 468 aa, Cryptococcus neoformans var. grubii
MAPITVKKICCIGAGYVGGPTCAVIALKCPQIQVTIVDLNQQRIDAWNSDNLPIYEPGLDEVVKATRGKNLFFSTDVDKGIEEADLIFVSVNTPTKKSGVGAGYAADLKFLQLATRRIAEVATSSKIVVEKSTVPCRTAESMRTILEANCRPGCHFDILSNPEFLAEGTAISDLFNPDRVLIGSLQTQQGINACQALSDVYANWVPRERILTVGLWSSELSKLAANAMLAQRISSVNALSAICEATGANIDEVSYAVGKDTRMGSKFLKASVGFGGSCFQKDILNLVYLSESLHLPEVAKYWRAVVEMNEYQKGRFARKVVDTLFNTITGKKIAILGWAFKKDTGDTRESPSISIANHFLSEKARIAVYDPQVTESQIWLDMTDYGEIPAEPIQPHLTICKSVEEACANAEAIVICTEWDEFKTLDWKKIYDNCPRPAFVFDGRLILNRQELTNIGFKVVTIGTGDRV

SEQ ID NO: 72163 - protein, 278 aa, Physcomitrella patens subsp. patens
TVVLLGWLGAQQKHLKKYAEWYNARGIHAVTFLIPMTDILSFKVEKNAEEHVNSLARHLSQWLSDQGEHADIEGDKQLMFHTFSNTGWLTYGIILEKMQEQGHFLEKIAGCVVDSAPVADPDPQVWASGFSAALLKKRSSATQPGFSNREVEEGITVEASSQGTIVNSEAKRANGLEIAVLPLLEAFFSLFLKLPAIDQRLSQVVNVLQKKQPACPQLYIYSTADKVIPVKAVEAFIEEQRKSGRVVRACNLQSSPHVDHFRSHPQVYSEQLSNFLKE

SEQ ID NO: 72164 - protein, 306 aa, Cryptococcus neoformans var. neoformans B-3501A
MLGRVGGAKEDETWTKTVSMRMFLLLLLEDGGGRRPPRRSGARKVNDVAFANGVPIYTSRRTRSKKYLMVIPSSHCATATQPLSHTTMSLIHALIARGTTVLAEHATGTAELKPAAQITILSKIPPNNSKLTYVWQDRLIHYVSSNGVIYLVMADDSVGRRMPFAFLADLERRFTAQYESDDIVSAGAHSLEEFEPELAKLMHQYTSSPPADPLRQAQSDLNNVKDIMVQNIDSILQRGERLDLLVDKTDTLAGQAYAFRRGARSVRRQQWWKNMRIMALSGVVGLLLLYLFIAQFCGASLGHCRS

SEQ ID NO: 72165 - protein, 365 aa, Staphylococcus epidermidis ATCC 12228
MALTAGIVGLPNVGKSTLFNAITKAGALAANYPFATIDPNVGIVEVPDSRLIKLEEMVQPKKTIPTTFEFTDIAGIVKGASKGEGLGNKFLSHIREVDAICQVVRAFDDENVTHVSGRVNPLDDIEVINMELVLADLESVEKRLPKIEKMARQKDKTAEMELRILTQIKEALEDGKPVRSIDFNEDDQKWVNQAQLLTSKKMLYIANVGEDEIGDKDNDKVKAIREYAANEDSEVIVISAKIEEEIATLDDEDKEMFLEDLGIEEPGLDRLIRTTYDLLGLSTYFTAGVQEVRAWTFKQGMTAPQCAGIIHTDFERGFIRAEVTSYEDYVQHGGENGAKEAGRQRLEGKDYIMQDGDIVHFRFNV

SEQ ID NO: 72166 - protein, 121 aa, Streptococcus pyogenes M1 GAS
MALNIENIIAEIKEASILELNDLVKAIEEEFGVTAAAPVAAAAAGGAEEAAKDSFDVELTSAGDKKVGVIKAVREITGLGLKEAKGLVDGAPANVKEGVAAAEAEEIKAKLEEAGATITLK

SEQ ID NO: 72167 - protein, 143 aa, Clostridium tetani E88
MKINNIMTKDIVSLQAEDTVEHAAQLMKEHGVGSLPICNEGKIVGIITDRDIALRSVAMGESIQNQTVRNIMTSNPITVSPNISATEAAEIMSKKQIRRLPVVENKNLVGMVSLGDISTEPNLENSAGKALTGISETNFSEFD

SEQ ID NO: 72168 - protein, 201 aa, Acinetobacter sp. ADP1
MYVPTIENALVPVVVEQSSRGERSFDIFSRLLRERVIFLTGEVEDNMANLIVAQMLFLEAENPDKDIHLYINSPGGSVTAGMAIYDTMQFIKPDVVTYCMGQAASMGAFLLNAGAKGKRYCLENARVMIHQPLGGFRGQASDIEIHAREILFIKERLNRLMAEHSGQDYERVARDTDRDNFMTAQAAKEYGLVDEVLSKRP

SEQ ID NO: 72169 - protein, 312 aa, Zea mays
EHHSRFIGTYRCAVSTPFCAEIVESADAYLFAGPVFNDYSSVGYSLLLKKEKAIIVQPERVVVGHGPAFGCVLMKDFLHALATRLKKNTAAYENYRRIYVPLGEPLPSEPGEPLRVNVLFKHIQAMLSGDTAVIAETGDSWFNCQKLKLPEGCGYEFQMQYGSIGWSVGATLGYAQAAKDKRVIACIGDGSFQVTAQEVSTMLRWGHNSIIFLINNGGYTIEVEIHDGPYNVIKNWNYTGLVEAFHNGEGACYTAKVRTEEELTEALEAALGPKKDCLCFIEVIVHKDDTSKALLEWGSRVSAANSRPPNPQ

SEQ ID NO: 72170 - protein, 360 aa, Glycine max
IRLEYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKELPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETEADKRFLAAKGSVPIGIGRNSHIKRAIIDKNARIGENVKIINSDNVQEAARETDGYFIKSGIVTVIKDALIPSGTVI

SEQ ID NO: 72171 - protein, 186 aa, Clostridium tetani E88
MFKNLKYDIDNIIKNDPAARNSLEVLLLYPSIHAIINHRIAHFFYKKRMFFIARLISQISRFFTGIEIHPGAQIGNGLFIDHGMGVVIGETAEVGNDVTIYHGVTLGGTGKDKGKRHPTVGNNVIIGSGAKVLGPIVIGNNAKVGANSVVLKDVPENKTAVGAPAKIVGEKKSEVVDMNLYRTIVR

SEQ ID NO: 72172 - protein, 498 aa, Quercus nigra
MRINPTTSDPGVSALEKKNLGRIAQIIGPVLDVTFPPRKMPNIYNALVVKGRDTAGQQINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLSETIRGFKLILSGELDGLPEQAFYLVGNIDEATAKATNLEMESKLKQ

SEQ ID NO: 72173 - protein, 328 aa, Medicago truncatula
MGIVSQDALNQLQALIDQVEEPLQKTFQNVHQGHVTETLIRFLKAREWNASKAHKMLIDSLNWRVQNEIDKILSKPIIPQDLYRGLRDSQLIGLSGYSREGLPVFAIGVGLSTFDKASVHYYVQSHIQINEYRDRVILPSASKKHGRPITTCVKVLDMTGLKLSALNQIKLLTIISSIDDLNYPEKTNTYYIVNAPYIFSGCWKVVKPLLQERTRKKVQVLQGCGRDELLKIMDYACLPHFCKKEGSGSSKHSGSGSENCYSLDHPFHQELYNYIKEQSRMNEDRKPIKHGSFHVEFPEPSADDGEIAKTIESEIHKFENSHGNVIDG

SEQ ID NO: 72174 - protein, 439 aa, Prochlorococcus marinus str. MIT 9303
MPALSSTMTEGKIVEWLKQPGDKVGRGESVLVVESDKADMDVESFQDGYLAAVLMPAGRSAPVGETIGLIVESEAEIAAVQANAPAAPASDPAPLKAAAKVVDDHAPASTPAPVVESPPVAAPPPVTSQAVESDKRIVASPRAKKLAAQMGVDLAKLRGSGPHGRIQAEDVQLAAGQPISVPQVAEGNASFATTHATSAGVAHAVSSPVGQSFGAPGETAAFNNLQQAVNRNMEASLAFPCFRVGYTITTDQLDAFYKQVKPKGVTMTALLAKAVALTLVRHPQVNAAYSTAGMVYPEQVNVAIAVAMDDGGLITPVLQNADRTDLYEMSRQWADLVKRSRSKQLQPEEYSTGTFTLSNLGMFGVDRFDAILPPGTGAILAVAASRPAVVAGKDGSIGVKRQMQVNLTADHRVIYGADGAAFLKDLAELIETRVESLAL

SEQ ID NO: 72175 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVEVKGFEN

SEQ ID NO: 72176 - protein, 319 aa, Photobacterium sp. SKA34
MFNSAETKIAFFGECMIELSGDPIRKSFGGDTLNTALYLSRLTRQHAVHVSYATGLGVDTLSQELLESWHQEGIHTNLVETFAKQLPGLYMVQTDKVGERSFLYWRDNSPAKNYFSTSSLNKLEIALRDKQYDYFYLSGISLAILDQASRLRLKHLLEAFSLAGGKIIFDNNYRPKLWSNQEAKYWYSQILPLVDIALITQDDDVLVWGDDESVAARCLRMGCNEIVIKRGCEPCQLIWRQDQYVYHTYVAAEQVSNVIDTCAAGDSFAAGYLAGRVTGQSYQDSATLGHTLAAIVIQHSGAIIPENAMKNLTLPSKSE

SEQ ID NO: 72177 - protein, 720 aa, Acinetobacter sp. ADP1
MNTILMIPTGEGVGLTSACLGLIYALDCNGIKAGFLKPFSQELPNQVDRTTSLFSHLFQGKTVTSISHEKVLQRLALGERDELLEEAVSIHRNVAANYDVIIVEGLLPNAQDHFATELNAALAQALDAKVVLVSTADVQNPRRTAEKIEAHLHHFGGVSSNRTAGVLFMRTRGLPEETAQIPLTIDPSLRLNTEIAAFSQELQRYNRNLGTTTLPIIGLVPFSNTLSVPRTLDIASIIEGDWIHQGEARHRRILHSSLIASSIEYELNKFVAGELIISASERTDVLLASSLATSNGIPLAGLVLTERKAPNPQILDFCQHAIKQGLPILHTQLNTLETAQRLADFGNEIPVDDTERAEQVTRFVSSHIDTAWLNSQINTGVQPRLSPSAFRHELVQKSIAAKKRIVLPEGDEPRTVQAAAICQSRGIAHCILLAKPEAVVEVAKARGIELPDDLEIIDPDLIRNQYITPMVELRNGKLNELQAKEQLQDTVVLGTMMLALDQVDGLVSGAIHTTANTVRPAFQLIKTAPDYSLVSSVFFMLLPDEVYVYGDCAINPDPDADQLAEIAIQSADSAKAFGINPRIAMISYSTGTSGAGADVEKVAKATEIAKQRRPDLLIDGPLQYDAASVESVGRQKAPDSQVAGRANVFIFPDLNTGNTTYKAVQRSANVVSVGPMLQGLNKPVNDLSRGALVDDIVFTIALTAIQAEQQLEAKAAALAS

SEQ ID NO: 72178 - protein, 132 aa, Helicobacter pylori
SNIKYELDKESGALMVDRVLYGAQNYPANYGFVPNTLGSDGDPVDALVLSDVAFQAGSVVKARLVGVLNMEDESGIDEKLIALPIDKIDPTHSYVKDIDDLSKHTLDKIKHFFETYKDLEPNKWVKVKGFEN

SEQ ID NO: 72179 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 72180 - protein, 198 aa, Rhodopirellula baltica SH 1
MSVLVTQKAPDFTATAVMPDGTFKDDFKLSDYKGKYVLLFFWPLDFTFVCPTEIIAFSDRAKDFEDLGVNIVGVSIDSHFTHLAWTNTPRNEGGIGKTAYPLVADLNKQISRDYDVLLDGGVALRGLFLIDQEGVVRHQVVNDLPLGRSVDEALRMVKALQYFETNGEVCPANWQEGSRTIKADVEGSKEFFGAEYKS

SEQ ID NO: 72181 - protein, 882 aa, Francisella tularensis subsp. tularensis SCHU S4
MRGVFMSKFVYAFSEGNKSMRDLLGGKGANLSEMLNSGLPVPDGFTVTTEACLKYYDDRQKLSNEVKEQIFAHIKDLEKRTGKTFGGGNNPLLVSVRSGARVSMPGMMDTVLNLGLNDTVAQAMVAKTNNEQFVYDSYRRFIMMFADVVMDCEKKPFDKVLEDKKAKRKVKNDCDLPAQDYKDIVTEYKKIYKDLVGKDFPTDPIEQLLAAVEAVFKSWNAERAIIYREINNISNNWGTAVNVQEMVYGNSGNNSGTGVAFTRNPSTGENELFGEYLINAQGEDVVAGIRTPAHISTLKDKMPEVFNDFVKIAKNLEKVYKDMQDMEFTIEDGKLFMLQTRNGKRTAKAALKIAVDMAKEGLITNEETVMMVEPHLLEQLLHPKFDEKALASKRPLGSALGASPGAASGRIYFDVESLLAAKARGEEKTILVRIETSPEDIAGMNACNGILTLRGGMTSHAAVVARGMGKCCVSGLESARIDEEKKTITFERGQVFTEGDYLSLDGTKGTVYRGIIKTVDPEVTKDFEDFMKFVDSVRKLRVRCNADTYKDASIARAFGAEGIGLCRTEHMFFEEDRISYVRQMILAKDKKERQRALDKLLPVQQQDFEELFEAMDNLAVTIRFIDPPLHEFLPHEVDEIDDLAREFNISYSELEARIEALSEVNPMMGHRGCRLAVTYPEIIEMQTKAIIYAAISSKRMGIEVKLELMIPLVSTLGEFKLLSGIVREVADTILKREKIDIDYKVGVMLETPRGAIGAGMLAAAGSEFFSFGTNDLTQMTFGFSRDDANKFIKDYLEKGILSFDPFARLDIKGVGKLMQIAKEGVKAVNPNAKMGICGEHGGEPYSVGFCHDLDLDYVSCSPFRVPIARLAAAQAKIYADRR

SEQ ID NO: 72182 - protein, 445 aa, Citrobacter freundii
AVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVIYIGADGAGHYVKMVHNGIEYGDMQLIAEAYSLLKGGLNLSNEELATTFTEWNEGELSSYLIDITKDIFTKKDEEGKYLVDVILDEAANKGTGKWTSQSSLDLGEPLSLITESVFARYISSLKDQRVAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADEYQQALRDVVAYAVQNGIPVPTFSAAVAYYDSYRSAVLPANLIQAQRDYFGAHTYKRT

SEQ ID NO: 72183 - protein, 315 aa, Clostridium perfringens str. 13
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDEKGERDFEFHRGSDGEYSFNNIDLSKIEKDDIIHFGSATGFLKGELKNTYFKLLEIGRKNGNFISFDPNYRDMLIKEEGIEEFKEDCKKFISSCDFLKLSDEEIKLLTEEEDLERGVEKLHSLGAKIIAVTLGGKGTLLSNGIHSEIVPSIKINQVDSTGAGDAFVGAVLKKVSELKDKKNLDLNSWREIISYGNKVGALTCTNYGAIDAIPNEEDLMKYI

SEQ ID NO: 72184 - protein, 132 aa, Helicobacter pylori
SNIKYELDKESGALMVDRVLYGAQNYPTNYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 72185 - protein, 198 aa, Oryza sativa
  misc_feature (123)..(123): Xaa can be any naturally occurring amino acid
  misc_feature (189)..(189): Xaa can be any naturally occurring amino acid
KLSSSSHGGDDRVRQGAPDLRQQGQPHRRGRCVLLRWNLCKQKLGANAILAVSLAICKAGAIIKKIPLYQHIANLAGNKQLVLPVPAFNVINGGSHAGNKLAMQEFMILPTGAASFKEAMKMXVEVYHNLKSVIKKKYGQDATNVGDEGGFAPNIQENKEGLELLKTAIEKAGYTGKVVIWMDVAVFEXYNDKDKTYD

SEQ ID NO: 72186 - protein, 445 aa, Escherichia vulneris
AVMGRNLALNIESRGYTVSVFNRSREKTEEVVAENPGKKLVPYYTVQEFVESLETPRRILLMVQAGAGTDAAINSLKPYLDKGDIIIDGGNTFFHDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNKGELSSYLIDITKDIFTKKDEEGKYLVDVILDEAANKGTGKWTSQSSLDLGEPLSLITESVFARYISSLKEQRVAASKVLSGPQSQPAGDKAEFIEKVRRALYLGKIVSYAQGFSQLRAASEEYNWDLNYGEIAKIFRAGCIIRAQFLQKITDAYAETPAIANLLLAPYFKQIADDYQQALRDVVAYAVQNGIPVPTFGAAVAYYDSYRAAVLPANLIQAQRDYFGAHTYKRT

SEQ ID NO: 72187 - protein, 445 aa, Raoultella planticola
AVMGRNLALNIESRGYTVSVFNRSREKTEEVIAENPGKKLVPHYTVKEFVESLETPRRILLMVKAGAGTDSAIDSLKPYLNKGDIIIDGGNTFFQDTIRRNRELSAEGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTKWNEGELSSYLIDITKDIFTKKDEEGKYLVDVILDEAANKGTGKWTSQSSLDLGEPLSLITESVFARYISSLKDQRVAASKVLTGPKAQPAGDKAEFVEKVRRALYLGKIVSYAQGFSQLRAASNEYNWDLNYGEIAKIFRAGCIIRAQFLQKITDAYEQNAGIANLLLAPYFKQIADEYQQALRDVVAYAVQNGIPVPTFSAAIAYYDSYRSAVLPANLIQAQRDYFGAHTYKRT

SEQ ID NO: 72188 - protein, 445 aa, Raoultella terrigena
AVMGRNLALNIESRGYTVSVFNRSREKTEEVIAENPGKKLVPHYTVKEFVESLETPRRILLMVKAGAGTDSAIDSLKPYLDKGDIIIDGGNTFFQDTIRRNRELSADGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTEWNQGELSSYLIDITKDIFTKKDEEGKYLVDVILDEAANKGTGKWTSQSSLDLGEPLSLITESVFARYISSLKDQRVAASKVLTGPQAQPASDKAEFIEKVRRALYLGKIVSYAQGFSQLRAASNEYSWDLNYGEIAKIFRAGCIIRAQFLQKITDAYEENAGIANLLLAPYFKQIADEYQQALRDVVAYAVQNGIPVPTFSAAIAYYDSYRSAVLPANLIQAQRDYFGAHTYKRT

SEQ ID NO: 72189 - protein, 445 aa, Shigella boydii
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGNKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 72190 - protein, 319 aa, Glycine max
MVSSNGLATTQPLFSFGLISDVQYADIPDGRSFLGVPRYYKHSILVLRRAVKEWNTHQKHKFAINFGDIVDGFCPKDQSLGTIKKLVDEFEMFRGGPVHHIIGNHCLYNLPRSELLPLLKIKTLDGRAYYDFSPVPEYRFVVLDGYDISAIGWPKDHPKTLEALKILREKNPNENKNSPINMEGLERRFLMFNGAIGKEQMKWLDDVLLEATKLKQKVVCCHLPLDPGAASEKGLLWNYDEVMNLIHKYNCVKVCLAGHYHRGGYSIDSHGIHHRVLEAALECPPGTDAFGYIDVYDDRISLVGTDRMKSTEMHFTPPS

SEQ ID NO: 72191 - protein, 465 aa, Zea mays
  misc_feature (330)..(330): Xaa can be any naturally occurring amino acid
TDRVSDADLGLVGAIRFQASGHGEAAAGAEAQTADAAGAGPAAPRPRRAGPPPSPLSPRPPPPLPFSCRTSYVKKAGWYRSGVPAPAARAPFYRHWSAELRAALPFLGSIAFMLAAFLCEAISVRFVSAVMGLHWHRTAAPLPDTGQWLLLSLNEKLPQSVVDLLRAHVITLHHYLMLFIMLGFSVLFDCIKAPGLGIATRYMFTMAIGRVLRTITFIATILPSARPWCAVARYQIPQHPHPWAQKYYVPYASDSNAIRRVITQDMAYAAVQAYPDEYKPDWGRMSFLVDILRPTPGEGPSWYHLLKKASGGCNDLMYSGHMLVAVLTAXMAWTEAYGGWISVAIWLLVLHSAQREVRERHHYSVDCVAAIYVGVLLWRMTGFIWSARDLARARRLAKLEEVQSRLVHAAKDSDIDEIRGLLKEVELAGQERQGFSQRAILAFAAGTIIFTLSCVLIAFTATSDG

SEQ ID NO: 72192 - protein, 213 aa, Triticum aestivum
  misc_feature (87)..(87): Xaa can be any naturally occurring amino acid
  misc_feature (106)..(106): Xaa can be any naturally occurring amino acid
  misc_feature (194)..(194): Xaa can be any naturally occurring amino acid
  misc_feature (199)..(200): Xaa can be any naturally occurring amino acid
TKHKYAFSSRLRIAVSALLLLLLLSAGVLAARAQHEIDDESEFSYIRGSENGPENWGKIKEEWVTCGTGRMQSPIDLSDRHAAQAPXLGYLNHSYLPVDASIVNRXHDIMVKFNGDAGSLWINGTAYHLKQVHWHSPSEHRVNGRRYSLELHMVHLSAENKTAVIGILYKIGRRDHFLHELEPYLKRIADTKEXEEMVXXVDPWDGEGRWPKA

SEQ ID NO: 72193 - protein, 362 aa, Lactobacillus johnsonii NCC 533
MKRYLILEDGSIYEGEGFGADCESSGEVVFTTGMTGYQEAITDQSYADQILVFTNPLIGNYGITLADYESLEPQIKGVICHQVARHPYNWRMQTTLPEFLKQLNIPGLQGVDTRELVKKLRIHGTLKGRITDSKENAVSIAQELKQKNITHGVISRVSTKNSYPVPGSKRNIVVIDFGIKHSILRELAERDCNCIVLPYTATAEEILNLNPDGVLLSNGPGNPEEMLMAAKMVQEVEKHVPLFGICMGHQVFALANGASTYKMKFGHRGFNHPVREIATGNIGFTSQNHGYAVDPKSIDKENLMITHVEVNDGTVEGLRHKKYPAFSVQFHPDATPGPHDEDSLFDDFMSMIDQRKEEERHA

SEQ ID NO: 72194 - protein, 389 aa, Clostridium tetani E88
MDVKEMALKLHSEKKGKLEVVGKISVKNREDLALAYTPGVAEPCVHISKDKNKVYEYTTKGNMVAVVTNGTAVLGLGNIGPEAALPVMEGKALLFKEFANVDAFPICLDTEDPEEIIRTVKLMAPGFGGINLEDIKAPECFYIEERLKKELDIPVFHDDQHGTAIVVLAGIYNALKIVDKKLEEAKILINGAGSAGIAICKLLLNAGACNIVMCDINGSLVEGDENLNPAQKEIAKVTNKEKEKGKLVDVIKDKDIFIGVSGPKILTKEMVSTMAKDSIVFAMANPEPEILPDEAKAGGARVVATGRSDFPNQINNVLVFPGIFRGALDVKAREINEEMKIAAARGVANLIKEEDLNEEYIIPDPFNKEVAESVSKEVRRIAKEMNICK

SEQ ID NO: 72195 - protein, 294 aa, Picea abies
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVPGLEPAGIDLLSKMLCLEPSKRITARSALEHEYFKDLGFVP

SEQ ID NO: 72196 - protein, 685 aa, Yarrowia lipolytica CLIB122
MHELVILSTRSEDDSRPTESSNMQYSLLQNDTIVHLRRQVTLRATIAGLAIGSMILFSNFQFGLQTGWVSMMSLPSALISYAVFRAFPGLTKEFPFTREENVYAQSVAVAVGTGPLAFGLVGIVPAIEKLLTPEENSGEPIFMHIGQLILWSLSLSLFGVFFAVLLRRQVIVREQLKFPSGSATATMISVLHEREKVKAIVEADIEEEEEEENQDNRENDNQDQEQEQEQEQEQEQSQDPDQNRHVDQEEDAVSPSSYPSYARQVKILKISFAISATCTLIQHFLPILRNLPVFGNWLAKNYLWTFNPSPGYIGQGFIMGLHTTSSMLLGCILGWGILAPYSQYKGWAPGPIDDWKTGGQGWILWISLALMVGDSVVSLLVLTYKQVWHYFHAFQDTESAYTSTEADDVEHEHPEYDLSSRFAGIGILLSSVLCLVGIKIVFPQIHLIQIIVSVFIALLLSVLGVRALGETDLNPVSGIGKISQIFLSLIPNSTILSNLVAGAIAEAGAQQAGDLMQDLKTGHLIGAYPKSQFIAQITGSLFSVFLSGLVYRLYMSVYEIPGSLFRIPTAIIWVDCARLVMGGGLPEKVGTFTAVFGVIGSALAILRDHVSLLPSGVAIGVGLYNVPSFTLARFLGGVIAYFYQRRHPEAHIDIIVCSSGLILGEGIMSIVTMLLTALTEEHNHG

SEQ ID NO: 72197 - protein, 481 aa, Physcomitrella patens subsp. patens
MVKICCIGAGYVGGPTMAMIALKCPDIEVVVVDISKPRIAAWNSDDLPIYEPGLDEVVKECKDRNLYFSTEVEKHVAEADIVFVSVNTPTKTRGLGAGKAADLTYWESAARMIADVSKSDKIVVEKSTVPVKTAEAIEKILTHNNNKGISFQILSNPEFLAEGTAMADLDKPDRVLIGGRETPAGQKAVAALKAVYAHWVPEDRIITTNLWSAELSKLAANAFLAQRISSINAMSALCESTGAEVNEVAYAVGKDSRIGPKFLNASVGFGGSCFQKDILNLVYICECNGLLEVAHYWKQVISINDYQKSRFIKRVVSSMFNTVSGKKIAVLGFAFKKDTGDTRETPAIDVCHGLLGDKALLSIYDPQVTEEQIKRDLAMNKFDWDHPQHLQPQSPTAFKQVSVVWDAYEACKDAHGICVITEWDEFKKLDYQKIYDNMQKPAFLFDGRNVLNVEEMRKIGFVVYSIGTPLDSWVKDLQVSI

SEQ ID NO: 72198 - protein, 891 aa, Arabidopsis lyrata
MKITEGQFRLSLLLLLSAATLISAADYSPTEKILLNCGGASDLVDTDNRTWISDVKSKFLSSSSSDSKTSPALTQDPSVPEVPYMTARVFRSPFTYTFPVASGRKFVRLYFYPNSYDGLNATNSLFSVSFGPYTLLKNFSAAQTAEALTYAFIIKEFVVNVEGGTLNMTFTPESTPSNAYAFVNGIEVTSMPDIYSSTDGTLTMVGSSTSITIDNSTALENVYRLNVGGNDISPSADTGLYRSWYDDQPYIFGAGLGIPETADPNMTIKYPTGTPTYVAPVDVYSTARSMGPTAQINLNYNLTWIFSIDSGFTYLVRLHFCEVSSNITKINQRVFTIYLNNQTAEPEADIIAWTSSNGVPFHKDYVVNPPEGNGQQDMWLALHPNPINKPEYYDSILNGVEIFKMNTSDGNLAGPNPIPGPQVTADPSKVLSPTSGKSKSNTAIVAGAASGAVVLALIIGFCVFGAYRRRKRGDYQPASDATSGWLPLSLYGNSHSAGSAKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAHGTMREHLYKTQNPSLPWKQRLEICIGAARGLHYLHTGAKHTIIHRDVKTTNILLDEKWVAKVSDFGLSKTGPTLDHTHVSTVVKGSFGYLDPEYFRRQQLTEKSDVYSFGVVLFEALCARPALNPTLAKEQVSLAEWAPYCYKKGMLDQIVDPYLKGKITPECFKKFAETAMKCVLDQGIERPSMGDVLWNLEFALQLQESAEESGKGVCGDMDMDEIKYDDGNCKGKNDKSSDVYEGNVTDSRSSGIDMSIGGRSLASEDSDGLTPSAVFSQIMNPKGR

SEQ ID NO: 72199 - protein, 364 aa, Aspergillus oryzae
MKALILVGGFGTRLRPLTLTLPKPLVEFGNRPMILHQVESLAAAGVTDIVLAVNYRPDVMVSALKKYEEQYNVKIEFSVESEPLGTAGPLKLAEKILGKDDSPFFVLNSDVICDYPFKELAEFHKKHGDEGTIVVTKVDEPSKYGVVVHKPNHPSRIDRFVEKPVEFVGNRINAGIYIMNPSVLNRIELRPTSIEQETFPAICKDGQLHSFDLEGFWMDVGQPKDFLSGTCLYLTSLAKRNSKLLAPNSEPYVYGGNVMVDPSAKIGKNCRIGPNVVIGPNVVVGDGVRLQRCVLLENSKVKDHAWVKSTIVGWNSSVGRWARLENVTVLGDDVTIADEVYVNGGSILPHKSIKQNVDVPAIIM

SEQ ID NO: 72200 - protein, 196 aa, Triticum aestivum
  misc_feature (170)..(170): Xaa can be any naturally occurring amino acid
  misc_feature (178)..(178): Xaa can be any naturally occurring amino acid
  misc_feature (191)..(191): Xaa can be any naturally occurring amino acid
TSISRFSIHLRPHRSWEERGRRRRRVGDGDRVAVPGGRAEGQGREVLDKAVAALRSEGLRAVGFQGDVRNQEDAARVLASTVEHFGKLDILVNGAAGNFLASPEDLTPKGFRTVLEIDTVGTYTMCYEALKYLKKGGPGRGPSTGGLIINISATLHYTASWYQIHVSAAXAGVDSITXTLALEWGTDYEIXVNGIA

SEQ ID NO: 72201 - protein, 729 aa, Rhodopirellula baltica SH 1
MFGATSVGVGAIVGGGILALAGVAFATTGPSAILAFGLNGVIAILTALSFAEMASKFPESGGTYTFSRKVLSVESAFTVGWVVWFASIVASVLYAIGFGSFATLLLSELYSTQGSVPHWLGEPWSVPVVSLATTVGIGGLMTFRTSGGGAWINVAKVAVFSVLIIGGFWMLTGQPVSKTTAELRPFLASGWGGLVQAMGYSFIALQGFDLIAAVGGEVREPTKNIPRAMLLSLVIALLIYLPLLFVLTTVGTDGSQSIRELAASDPEAVVALAARHYLGTSGYWLVLIAAVLSMFSALQANLFAASRIALAMSRDNTLPNALSRLAAGSGSPWISVLVTTGLVCLLIQLLPDIAAAGAASSLIFLVTFAIAHWLAILVRQRSVLTPPPFRVPGYPAVPVVGGLACLALAIFQGIAVPEAGIIAVMWIAIGGVLFLSLFARRARLTDVSNIASNPELSRLRGNSPLVLVPIANPNNARAMIALADTLVPAALGRVLVQTVVVAPHDWDPLVNHRPSAQLHSVMNEILHASASLGVRCETLTTVSAEPMMEIARVAKLHQCQSVLLGLSEITPEARDTPLEGLLGQLSSDVVVLRAPKDWQLDQSQQILVPVGGRGGHDYLLTRLLSSLSREQQRQVKFLRVIPTDTLRADQKRIRKELDRTTRVNAGRVCEREVVRSNDPVKTIADRAGTAGLIILGAQRLGPRQKLFGDFTRKVALESDCPVIIISRRG

SEQ ID NO: 72202 - protein, 445 aa, Shigella dysenteriae
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAFLPANLIQAQRDYFGAHTYKRI

SEQ ID NO: 72203 - protein, 445 aa, Shigella sonnei
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 72204 - protein, 280 aa, Prochlorococcus marinus str. MIT 9303
MASNHSMPCSLGVIGLGRMAQALVLPLLKQGELAPQQVVALVGRGASVERLADQLPIGLRLKAADDPTAAEAWMAPIQLLAVKPQQLDQIAASAARLKQTAAGPQLLISVLAGVSLARLQQAFPAHACVRAVPNTPALVGAGLTGLSWGEGVTAEQRLAVERLFLPVSEVLELPESQLDAFLALTSSGPAYVALVAEAMADGAVAAGLPRSLAHHLAHRTLAGTAALLKEQKLHPAELKDMVTSPGGTTIAALRKLEQAGVRSALIEAVVAAAQRSRELA

SEQ ID NO: 72205 - protein, 467 aa, Musa balbisiana
MEAKSTGRFTLGKQSSLAPDRDDGELQALRSGDLDGLQVPEEVDANIRLMYLANEGDLAGIEETLASGVDVNFRDIDDRTALHVAACQGFADVVQLLLDRGAQVDPEDRWGSTSNFITIAPAKQPLADAVHYKNHEVIKLFEKHGAKLRVTPMRVENAREVPEYEIDPSELDFTNSVNITKGTFIIAKWRGIQVAVKKFNDDVMADEDKLWDFFIFCRRAFRDELALLQQIRHPNVVQFLGAVTQSSPMMIVTEYLRKGDLRAYLNRKRTLRPSSAVLFALDIARGMNYLHEHKPEAIIHRDLEPSNILRDDSGHLKVADFGVSKLLKVAKTVKEERPLTCLDTACRYVAPEVFLNEEYDTKVDVFSFALILQEMIEGCPPFSYKQDNEVPKAYVSKQRPPFRAPPKQYAHGLKELIEHCWSENPADRPTFREIIDRLSKIQNHIAQKRRWKVSLFNFYLGLQLFSL

SEQ ID NO: 72206 - protein, 1018 aa, Neurospora crassa
MAWDKLSITRPHLVYIILGGFTSLFMLCSSIIKERMYIGEATVATLCGLIFGPHAAGLIDPIEWGNIDIVTIEFSRLVLVVQCFAVGVELPKFYMEKHWRSVTFLLIPVMLWGWLITSLFVWWLIPPLSWLDSLVVAACVTATDPVLASSVVGKGKFAKRVPKHLRDLLSAESGCNDGMAFPFVYLSLYLILDHREARDVSFHWIVFTILYECVFGAIFGFMVGYIARHGIKYAERHELIDRESFLVFYFVLALFCAGSGSILGVDDLLVGFAAGVGFSNDGWFTNKTEESHVSNVIDLLINLAYFVYLGTIIPWEQFNNFDIGLGAWRLVVLAIMVILFRRIPIMMALKPLIPDIKTWREALFAGHFGPIGVGAIFVAILARAELEHEDPVPLADISNINPNNPHFHLIRLVWPIVTFLVVSSIIVHGSSVAVFTLGKHINTLTITMSYTQANEDGPSWMNRLPRITSVSRSQARNMSDTEDDMKMPEFPPGTLPPTGLPGTFLRRQKEEDKGTGRHAGSRSSSANGRRRRKRWDDGIGPGGPISQSAIFPQRRSQSEQAIASPHDEMSLEPSDTARLSPSDALTTRRRSVRKSEKERSSDETASPYEPSPTSEQRDQELEYYDEGDHVIVEDREGNVLAVESPATGEGQNPVEALKEKLEAEAGPSGWSYDALKKKIQNWRDEEAAKRKEKEKSTRRSEPARAYQFGTTIIVENEDGEVLKKYELPSEKPENDFVSQSLKYMGIKAGDKAQVAGGTAGGEGSATRPSKPTKRPTWASAVVGGGDASKKKNAVEEQEEDDRHIRFTIGGVGQRMNKEDFIREMQKLDKSTRKEIVDQSNASSAVKSLAKADLTPKQLQQPQQQQPQPVQRRGSPAGSVKSSHSKDSLTRQGRPEKSEMMSGGSNAERSESPSISRSRSRSRSRSPSPLTAEGGSAAPSRDVPETAAERRRRLAVLQSVGDDGEGEQGETPAERRRREAALGMFPGAAEDEDSEDDDTPRIPPPRRGIRFAEPTRRVT

SEQ ID NO: 72207 - protein, 447 aa, Musa balbisiana
MAEHFNKKSGLSGTVPLGSFNSMFSFTGSWKVDAAATKALAMDGFYFPLYKAKLISDDLLLRDDVKRAVPHSWDPPLLASFIENFGTHIITSVTIGGKDELYIKQHHSSQLSESEIEKYVKDIGDQRFLNMEHQTLNAPLNYKEKDVTVIFRRRGGDDLVQNHAEWVHTISSAPDVINMTFLPIVSLLNGLPGIQNLSRAVDLYLELHRVWAPAPVNIPGHQRKEPVCPSLQFSLMGPKLYISAEQVSVGRKPVTGLRLSLEGSKQNRLAIHLQHLAILPKIFLPHWDSHVAIGPPKWHGPEEQDCRWFEPIKWKNFAHVSTAPIESTETNIGDLSGVYIVTGAQLGVWDFGAKSVLHLKLLFSKVPGCTIRRSVWDHNPCPTFAQKLDDTSSSTSGDNSKLAKIVDMTEMLKGPQDVPGHWLVTGAKLGVEKGKIVVRVKYSLLNY

SEQ ID NO: 72208 - protein, 452 aa, Brucella melitensis 16M
MRDSNFLIENNARHLWHPMAHPAEMQANPPRIVNGGEGVEVIDIHGKKVLDAVGGLWNVNLGYSCEPVKKAIRDQLDSLPYYSTFRGTTNSPLIELSYELAEFFKEDGLTRAFFTSGGSDSVETALRLARQFHKINGQPERTKFVSLKKGYHGTHFGGASVNGNANFRRNYEPLLPGVFHLAAPYPYRNPFNMDDPAAIAAAIARQFEDEIAFQGADTIAAFIMEPVLGAGGVIVPHESFMPLMREICDRHGILLIADEVITAFGRTGAWTGSRGWGVKPDMMTTAKAITNGYFPFGAVMISDKVASVFEANKNSLGAIGHGYTYSGHPVGAAAALATLKETARANTAANAGARGVELMAGLNQLKEKHELVGDVRGKGLMAALELVSDREKKSAAAKTVVQKVYDVAYEEGVMVRTSGANVIISPPLVITPADVNRIVSALDAGLSAAKGQ

SEQ ID NO: 72209 - protein, 443 aa, Brucella melitensis 16M
MFLRSMLAFPPRRDNDMSGNQELIARRERLLGRNMSLFYQDPVHLVKGEGVWLWDADGRKYLDCYNNVPHVGHCHPRVVEAICRQASTLNTHTRYLHEGILDYVERLTATFDKSLDAAILTCTGSEANDVALRMAQAVTGKTGIIATDFTYHGNTTAVSQLSTRMPPVGGYGGHVRHVPAPDSYRPLGGKGGEAFAQAWAAEVEKAIASLQESPFGFSGLIIDPFFANEGFPDLPENFLAPAVAAVRKAGGVVIADEVQPGFGRTGGHMWGHQKAGIVPDIVTLGKPMGNGHPVGAVVAGADTLNAFRKAFRYFNTFGGNPVSCAAAMAVLDVLEEEKLQANALEVGAYARQGLEKLAQKHGMIGNVRGSGLFFGAELVLDRAEKTPAAEMATRVVNEMRERGVLMNKLGIHQNATKIRPPMPFSRENADLMLSTLDDVLGGL

SEQ ID NO: 72210 - protein, 406 aa, Moritella sp. PE36
MLNDIELTDLRQQFPVLSQQVNDHPLIYLDNAATSQKPLCVLEAINTYYRDINANVHRASHALSAQATSAYENARDTCAQFINANSSKEIIWTRGTTEAINLVANCLTTSIQAGDEIIISTLEHHANIVPWQMLAQRTGAILKIIPLLPSTDIDIQAYKQLLSDRTKLVAVSHVSNAIGTVNPIEDIIALAKQTGAKVLIDGAQAISHWEVDVQALGCDFYVFSGHKMYGPTGIGVLWGKEEALNQLPPWQGGGEMIKTVSFAQTTYNELPFKFEAGTPNIAGAISLARAMTFLTSYDRQVLAAHEAELLAYTTAQLENMPRIKIIGSPQHRAGGVSFIMGDAHNSDVGMLLDLQGIAVRTGHHCAQPLMQSLNLSGTIRVSLAIYNTKAEIDFFIKALNELQDLL

SEQ ID NO: 72211 - protein, 119 aa, Streptococcus pyogenes M1 GAS
MDKIVLEGCRFYGYHGAFKEEQTLGQIFLVDLELSVDLQAASLSDQLTDTVHYGMVFDSVRQLVEGEKFILIERLAGAICEQLFNEFPPIEAIKVAIKKENPPIAGHYKAVGIELERQR

SEQ ID NO: 72212 - protein, 296 aa, Haemophilus somnus 2336
MYQFAQDLQESKQRINFFLEKQFECIDSSPSPLAEAMKYGLLLGGKRIRPFLVYATGKMLGANLIQLDYAAAAIEAIHAYSLIHDDLPAMDNDSLRRGHPTCHIAFDHATAILAGDALQPFAFELLTQTPDLSAEQKLALVQTLANASGVKGMCLGQSLDLISENQQINLSALEKIHRNKTGALLSAAVKMGFICSPHFANIKLEEQLMHYSSAVGLAFQVQDDILDIEGESIVIGKTAGSDLLADKSTYPKLIGLDGAKQKAQELYHQALQELDALPFDTSALHALAEFVVNRQS

SEQ ID NO: 72213 - protein, 266 aa, Moritella sp. PE36
MSAEYDNRFGGIARLYGVKALQFFSQAHVCVIGIGGVGSWAAETLARSGIGKITLIDMDDICVTNTNRQIHALKDTIGKQKIDVMAARIRAINPECVVTAIDDFITVDDVGMHISKDFDYVIDAIDSVRSKTALLAHCNRQKIKCITIGAAGGQIDPTQIQVLDLSRTHQDPLAAKVRSDLRRLHNFSKNPTSRFGIECVFSTEQLIYPGTDGEVCSTKNFLDGATGMDCSSGFGSSTAVTASFGLIAASRVLKKLAEREARYRPE

SEQ ID NO: 72214 - protein, 246 aa, Aspergillus nidulans FGSC A4
MGESRQELLAWLNNLLQLNMTKIEQCGTGAALCQIFDSIFMDVPMSRVKFNVNTEYAYLQNFKILQNVFARHQIDKPIPVESLSKCRMQDNLEFLQWTKKYWDQHYPGGDYDALARRKASGAPPGSAGTSRAGATSASSARRGTTPTVGRARPAAGGASSATVAALQAELNSTKEAISGLEKERDFYFAKLRDIELLLQNAIEADPELEKDDDSLVKHIQGILYSTEEGFEIPAEGEVAGDELETF

SEQ ID NO: 72215 - protein, 137 aa, Triticum aestivum
FGTRRERYRERERERERERERERERERERLIVWMRTAALPTFRKLYGRIYVDLKANDTIIVRLSNNYNTYSFGGKKKLVLSTATWLGGKNDFLGFAYLIVGGLCIFLAFAFTLLYLIKPRKLGDHNYLSWNRHPAGR

SEQ ID NO: 72216 - protein, 453 aa, Myxococcus xanthus DK 1622
MALRVAIIGAGPSGLAQLRAFESAARKGAEIPEIVCFEKQEDWGGLWNYTWRTGLGRYGEPVHGSMYRHLWSNGPKEALEFADYSFDEHFGRPIPSYPPREVLYDYIRGRVEKCDVRKYIQFNTIVRWLSWSEETRKFTVVVDDLAKREVREESFDRVVNATGHFSTPNVPFFEGIDSFPGRVLHAHDFRGAEEFAGKNLLLIGSSYSAEDIGVQCHKLGAKSVTISYRSAPMGFRWPMGMKEVPLVKRFEGNRAHFADGTSATLDAVILCTGYQHKYRFLPNALRLESHNRLYPPGLYKGVFWQGQPELAYLGMQDQYYTFNMFDAQAWLVRDVIMGRTALPSAEEREADIAAWVEREEGIQDSFGAVDFQTAYIRDLLDRTDYPGFSVEKVAELLKQWLRDKQEDILGYRDRTFTSIVTGTRATPHRRKWMDELDDSAESFLAEAPERRTG

SEQ ID NO: 72217 - protein, 504 aa, Brucella melitensis 16M
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVEFMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 72218 - protein, 305 aa, Arabidopsis thaliana
MIVKTLWTGETPKAESVKETMESYFKALLGFLLCCHGSTLGAGPTLSSIVHGSVKQIVDSSFRLFQGSVSLYDGSYEKGEKPSISQLSGAVLEACSSFKKVPTTNLIAIGSAISQVSVIMKDVLNEMKKVKPACPSSEGEASGDDFSPEQIEVAKMVADIVYEAMTVIIVIRVITRMMEKENSNENSVFVESLEKLLKLCQRSGVVIEELGTCVYHPPLKIDKITQTVKILEGNLDEVEAQVEYMKRSSNAFPGVCRKLRDAIKLMEVGLEKRKDLNQILISRQNTLYNALQLLDPTASPMNRCS

SEQ ID NO: 72219 - protein, 409 aa, Synechococcus elongatus PCC 6301
MQCSSRPVTSFNGSKHFSHLPQGCPMTVTLPSVSEKHRVRLQPLELPERLLLGPGPSNAHPAVLEAISRPPIGHLDPKFLELMTEVQGLLRYIWQTDNRLTIPVSGTGSAAMEATIANSVEPGDVVLVGVMGYFGNRLVDMAGRYGADVRTIHKPWGDVFSLAELRQALEEHRPQILALVHAETSTGAEQPLAGVGDLCREFDCLLLIDTVTSLGAVPTLLDEWGVDLAYSCSQKGLSCPPGVSPFTMGPRAEEKLARRKGKVANWYLDMSLLNQYWGSDRVYHHTAPVNMNFGIREALRLIADEGIETVWKRHRDNAEYLWAGLEDLGLTCHVPVENRLPTLTTVRIPEGVDGKAVSRQLLDEHGIEMGGGLGELAGKVWRIGLMGYNSRRENVDRLLSILADVLPRS

SEQ ID NO: 72220 - protein, 395 aa, Neurospora crassa
MSTDTKRKATEEPTSPSSAKRIKHSDSNEENEDTKKPKIPAIPFPEKAAVIEERDGEIEFRVVNNDGERESLIILTGLKCIFQKQLPKMPKDYIARLVYDRTHLSIAIVKKPLEVVGGITYRPFKGRQFAEIVFCAISSDQQVKGYGAHLMSHLKDYVKATSDVMHFLTYADNYAIGYFKKQGFTKEITLDKSVWMGYIKDYEGGTIMQCSMLPRVRYLEMGRMLLKQKECVQAKIRAYSKSHIVHQPPKQWKNGVTPIDPLSVEAIRASGWSPDMDELARQPRHGPNYNQLLHLLNDLQNHASSWPFLVPVNKDEVHDYYDVIKEPMDLSTMEDKLEKDQYNTPEDFIKDAKLIFDNCRKYNNENTPYAKCANKLEKYMWQQIKAIPEWSHLEP

SEQ ID NO: 72221 - protein, 476 aa, Oryza sativa Japonica Group
MATATAASRLAVAGAEPARARRHRPTTVAVCGGARPRSRPAAVVAAAGAAAPSPATGGVAPVPPSPRGSIIKRHTLSVFVGDESGMINRIAGVFARRGYNIESLAVGLNKDKALFTIVVSGTEKILKQVVEQLNKLVNVIQVDDLSKEPQVERELMLIKLNVEPDKRPEVMGLVDIFRAKVVDLSDHTLTIEVTGDPGKIVAVQRNLSKFGIKEIARTGKIALRREKMGESAPFWRFSAASYPDLEVAMPSKSHVNTAMKTANQNSEESSQGDVYPVESYENFTTNQILDAHWGVMADGDPTGLCSHSLSILVNDFPGVLNVVTGVFSRRGYNIQSLAVGPAEKEGTSRITTVVPGTDESIAKLVHQLYKLIDVYEVQDLTHLPFAARELMIIKIAVNTTARRAILDIADIFRAKTVDVSDHTVTLQLTGDLDKMVALQRMLEPYGICEVARTGRVALRRESGVDSKYLRGFSLPL

SEQ ID NO: 72222 - protein, 301 aa, Oryza sativa Japonica Group
MLGFRSQTPWSGAGAEPICGDAAAAVVAARKGMETPLTAVAEAFEELARRMEADGGELRLGPFGDTCALVSVLFSCLGMAFRFAEIEYVAKVNDLIGAAKSYGTLNDILDKDVENDCVKKQGSHSRNLRRVRLGLGLIKVLFEQFLSTQECSLYDAATTAYGQVCAPFHSWAVRKAVGAGMYTLPSREQLIVRLNETDCSVQKEMRRYIDASSPIIDYIDNLFLSRSISLDWGEEDEGRLRVRNDVNWFSGDRTWDRYGLEESGKGGRWRMAISSGKDGEENGSEKWIWKTVVLYYIESFR

SEQ ID NO: 72223 - protein, 143 aa, Acinetobacter sp. ADP1
MAVERTLSIIKPDAVGKNHIGEIIARFEKAGLKPVAMKYKHLSQAEAEGFYAEHKERGFFADLVAFMTSGPVVVSALEGENAVLAHREILGATNPKEAAPGTIRADFATSIDENAAHGSDSVASAEREIAYFFAADEIFPRTR

SEQ ID NO: 72224 - protein, 429 aa, Nostoc punctiforme PCC 73102
MKKVLSIILGGGAGTRLYPLTKLRAKPAVPVAGKYRLIDIPVSNCINSEIFKIYVLTQFNSASLNRHIARTYNFTGFNEGFVEVLAAQQTPENPNWFQGTADAVRQYLWLMEEWDVEEYLILSGDHLYRMDYRQFIQRHRDTGADITLSVIPIDERRASDFGLMKIDDSGRIIDFSEKPKGEALTQMQVDTSVLGLTKEQAQKQPYIASMGIYVFKKEVLFKLLRESVERTDFGKEIIPDASKDYNVQAYLFDDYWEDIGTIEAFYHANLALTQQPQPPFSFYDEHAPIYTRARYLPPTKLLDCQITESIIGEGCILKNCRIQHSVLGVRSRIESGCVIEESLLMGADFYQASVERQCSLIENDIPVGIGTDTIIRGAIIDKNARIGHDVKIVNKDNVQEAERENQGFYIRSGIVVVLKNAVIPDGTII

SEQ ID NO: 72225 - protein, 225 aa, Prochlorococcus marinus str. MIT 9303
MTLSARWHDLVDRLADGVHLLAVSKGHPATLIRQLAELGQQDFGESRLQEALPKLEDLADLKGLRWHFIGRLQANKVRGVVRSFAVIHSVDSLALAERIARIAAEEQCCPQVMLQVKFRDDPSKGGFSQEQLKQAWPDLIQLSHLQLIGLMTMAPIGLSLEQRQELFRQCRELADQLGLPDCSMGMSGDWLEAMHAGATWLRLGSILFGARSMAKSSSVDDINAV

SEQ ID NO: 72226 - protein, 307 aa, Mycobacterium bovis
MIRHFLRDDDLSPAEQAEVLELAAELKKDPVSRRPLQGPRGVAVIFDKNSTRTRFSFELGIAQLGGHAVVVDSGSTQLGRDETLQDTAKVLSRYVDAIVWRTFGQERLDAMASVATVPVINALSDEFHPCQVLADLQTIAERKGALRGLRLSYFGDGANNMAHSLLLGGVTAGIHVTVAAPEGFLPDPSVRAAAERRAQDTGASVTVTADAHAAAAAADVLVTDTWTSMGQENDGLDRVKPFRPFQLNSRLLALADSDAIVLHCLPAHRGDEITDAVMDGPASAVWDEAENRLHAQKAVLVWLLERS

SEQ ID NO: 72227 - protein, 258 aa, Yarrowia lipolytica CLIB122
MGAPTAKRQTQATEPTTDAPVAIPQTEGAEEDEVMISMDGPREDIAVLQEKDDDAEMTLDQDGKPRFASAVNAGEGVKPGRMKVPIPPHRMAPLKNEWMKIYPPLVEQLKLQVRMNPRKKQLELRTCSNTVDNSALQKGTDFVRAFTLGFDVDDAMAIIRLDELYVETFEIKDVKTLQGDHLGRAIGRIAGKDGKTKFAIENASRTRVVLADSKIHILGGFTNIKIAREAIVSLILGSPPGKVYGNLRIVASRMKERF

SEQ ID NO: 72228 - protein, 628 aa, Francisella tularensis subsp. tularensis SCHU S4
MSNNMELFVHSSNYILLASGLILFFAIVSQFLSWRLKLPSILFLILSGIILGPLSEAIFQTGFKLVDGNVIFGEALSPFVSICVAIILFEGSLSLNFSKIKSVSSVVILLITVGLAITVVLTALFCYYVVGLNLELSMLIGGITCVSGPTVVPPFMRTVRPKKHIANILKWESILVDPIGALVVVFMLAWFVIGGNFANQPNAVSTFIAYMVFVCILGITSGFILGYLIGLSFRKHYIPEYLKSFFVLAVIVLGFIISDAIMHGAGLLMVTVAGLVMANMKDIKMSDIVSFKENLSIVIISVLFIVLGAEIDFSLFKDYWLDLIEVFLFLQFILRPIVVFLCCLGSKTTFAERVVLGIIYPRGIVAASVAALVAVKIIKSHPELYSEANTLVFFVFMIIVFTVVFQSIVTPYISKALGVTEPEGKGFLIIGGNRFARELAEIFVKNDIEVVITDSSWGNVQKCRQLGLNTYYGSPVSIHADWSINLVGIGAMLGLSTSEYVNAVSAMKYKYEFGSNNVYVLRTAQKESYKGIGAIETNLANLLFDEGVDFNILIEMLNQGATIRSTNITPNYTLEKFFSDNPNAIGLFIIDDNGYAQPFSKNKKIKFESYNLISLRDDKSKDQLCLDV

SEQ ID NO: 72229 - protein, 179 aa, Francisella tularensis subsp. tularensis SCHU S4
MSRCIRSFNGKYPKVADSAYVDESAAVIGDVILKEDSSIWSQVSVRGDLLTITIGKGTNIQDCSTLHTTEYPKDSGQGFALTIGDYVTVGHGVVLHGCEIKNNCLIGMGSIVLDGAVVEPWVFLGAGSLVPPGKTLESGYMYLGSPAKKVRPISEHERQIIKENAEHYVKVKNRYKAQI

SEQ ID NO: 72230 - protein, 364 aa, Clostridium perfringens str. 13
MNEQNHGLGIIALESCTELGNAIDKLIQEKRNCEESFLIKTDEIRFSNGEGKVKIPQSVRGRDIYILCDIGNYSCTYKMFGFENHKGPDEHFQDIKRTVSAIRGKARRITVIMPLLYESRQHRRKGRESLDCALALQELERLGVDEVLTFDVHDPNVQNAIPLMSFENFYPTYDIVKSLIHNEKDLELDKEKLLVISPDTGAMDRAIYYSSVLGVDVGLFYKRRDHSRIVNGKNPIVKHEYMGRDVDGKDVLIVDDMIASGESVLDIAKELKGRNARNVYVATTFSFFTEGLEKFNKFFNDGIIKSVYSTNLTYIPEELNAAPWFKAVDLSDFIARIINRLNYDKSVASYMDATNIIQRLLDEK

SEQ ID NO: 72231 - protein, 92 aa, Glycine max
MGYLQEARENHVKKKVEEALRSKMKQKALKECDVLCSKYAECARGRTFSVVWTCRKQAKELNNCLHQFTNDAILEDMKKAYMDEQESKEKNK

SEQ ID NO: 72232 - protein, 568 aa, Photorhabdus luminescens subsp. laumondii TTO1
MEHSTPLITTLVGGFFIAYLLGMLAQRLKISPLVGYLTAGVLAGPFTPGFVADASLAPELAEIGVILLMFGVGLHFSLKDLLAVKSIAIPGAIAQILVATLLGVGLSAILGWELFSGIVFGLCLSTASTVVLLRALEERQLIDSQRGQIAIGWLIVEDLAMVLTLVLLPAAAGILGNKEANIGQLIMELAMTVGKVIAFILLMIVVGRRLIPWVLAKTASTGSRELFTLAVLVIALGIAYGAVALFDASFALGAFFAGMVLNESELSHRAAQDTLPLRDAFAVLFFVSVGMLFDPMVLIQQPLSILATLAIIIIGKSAAAMLLVKMFGHSRRTALTISVSLAQIGEFAFILAGLGVALGLLDGNARNLVLAGAIVSIMLNPVLFSLLDRYLEKTETIEEQLLEETLEEETQIPVDICGHTIVVGYGRVGSLLCQRLQEKEIPLVVIENTRAKFEELGEQGISAVMGNAASKDIMSLARLDCACSLLLTIPNGYEAGEIVACAREARPDINIIVRADYDDEVTYITERGASHVIIGEHEIAKTMATVFANSEQSYSIEPPPASPFSPSL

SEQ ID NO: 72233 - protein, 704 aa, Ralstonia eutropha JMP134
MTNEASVVRTARHGDVQVITICNPPVNALGVAVRQGLKQAIEQAEADAGVRAVLVVGEGTAFIAGADIREFGKPPMPPSLPEVCNQIEASNKLVVAAIHGPALGGGLEVAMSAHYRLALPAAKLGLPEVNLGLLPGAGGTQRAPRLMGVKAAADLMLSGKHLSAKAAQAAGLVDRLAEGDDPVAAGLAYVNELLEQGAPLRRTRDLAIADKAAALAELDTLQAETAKKTRGLFSPQKIVECVRAAVELPFDEGLAKERALFVECLNSPQRAGLVHAFFAERETAKVPEAQGAAPRALNRIAVIGGGTMGAGITVAALDTGLPVVMIERDAESIARGQANVEKVYDGLIAKGRMTPEGKAAIMARYTPSTSYESIADVDLVIEAVFEDIEVKKAVFQQLDRVCKPGAVLATNTSYLDIDAIAGSISRPQDVIGLHFFSPANIMKLLEIVVPAKVSPDVVVTAFELAKRMKKIPVRAGVCDGFIGNRILAVYKQAADYIMEDGASPYEIDEAVRGFGYPMGPFQVTDLAGGDIGWATRKRRAATRDPKARYVEVADRICERGWFGQKTGRGFYLYPQGARIGQPDREVLAIVEAERQKKGIAPRKFTAEEIMRRYMAAMVNEGAKVVEEGIALRPLDVDVTFLSGYGFPRFRGGPMKYADMVGLPKILEDIRTFAKEDPLFWKPAPLLEKLVAEGKDFASLNQAGR

SEQ ID NO: 72234 - protein, 285 aa, Zea mays
  misc_feature (165)..(165): Xaa can be any naturally occurring amino acid
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRXGGYCNFMHVKQVGRDLRRKLFGHLHRSLRSHSRGSRSPSPYRRRGSSSRSRDRDDYYYYNYRSGSGSRRSSERHRSHDSDGSRRRRGRSRSRSRSPVREGSEERRAKIEQWNREREAAQV

SEQ ID NO: 72235 - protein, 247 aa, Oryza sativa Japonica Group
MSSRSPPPKDRRIRTERTSYRDAPYRRDSRRGPSRFPNDLCNNCKRPGHFARDCPNVALCHACGLPGHIAAECSSKDLCWNCKEPGHMANSCPNEGICRNCGKSGHIARECSAPPMLPGEMRLCSNCYKPGHLAAECTNEKACNNCRKSGHLARNCPNEPVCNLCNVSGHLARECPKSDAINERGGPPPFRGGYSDVVCRACNQVGHMSRDCMAGAFMICHNCGGRGHMAYECPSGRLMDRFPPRRF

SEQ ID NO: 72236 - protein, 334 aa, Moritella sp. PE36
MSFNLRNRNFLKLLDFTPREIQHMLELSAELKKAKYNGYEQPRLTGKNIALIFEKSSTRTRCAFEVAAHDQGAQVTYLGPSGSQIGHKESMKDTARVLGRMYDGIEYRGFGQEIVEELGAHAGVPVWNGLTTEFHPTQILADFLTMQEHAQGKQLHEVAFAYLGDAQNNMGNSLLVGAAKMGMDIRLVAPEAFWPNAELVAQCREIAAETGAKITLTEDVQEGVQGCDFLYTDVWVSMGESKDAWDERVKIMTPYQINMDMIKQTGNPDVKFMHCLPAFHNDETTVGAEVAEKYNMKGLEVTEEVFESKHSIVFDEAENRMHTIKAIMVATLGQ

SEQ ID NO: 72237 - protein, 142 aa, Bacillus simplex
PAVAGLLMEKELSVLGKALSNPERPFTAIIGGAKVKDKIGVIENLLEKVDHLIIGGGLGYTFIKAQGHEIGNSLLEEDKIELAKSFIESAKEKGVKLHLPIDAVVTAEFSPDAETANVDIDAIPNDKMALDIGPKTSELFAD

SEQ ID NO: 72238 - protein, 403 aa, Triticum aestivum
IGRGWRDLFDSRVGRTVWPYGSGVWSKKEFVLPGIDPDHIVSLFEGNSNLFWAERLGRDHLAGMKDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRLPRLVCAQAANANPLYRYYKSGWTQFQPQVAEPTFASAIQIGDPVSVDRAVVALKATNGIVAEATEEELMNAMSLADRTGMFACPHTGVALAALFKLREEGTIGANDRTVVVSTAHGLKFSQSKIDYHDQKIEDMACKYANPPVSVKADFGAVMDVLKKRLKGKL

SEQ ID NO: 72239 - protein, 473 aa, Aspergillus nidulans FGSC A4
MVMANASKDSRTEAQETVVDQEIEQQKPYRPARWQSNLTILSCYIANFSDGFQNGLANPTNVIFKHLLGSSRYPSEMQTRISNSLIIGAILGVVVLGYVSDMVSRRAGLVFTSGLVTVSTLMAALALQVHPSYNMLWFFVIVRGISGFGVGGEYPPSAAAGLEESDDFRRRYRGPVFVSFTTLMATLASPILQIIYLISLKASSNNLHITFHAMYSIAAILPFTVMLLRFFMADSTLYHNSNFKQSPQNRSLRFYVLLVRRYWARLLTTSTAFFLYDFINFPNSIMSSTIISSLVTDNNIQTTAIWQVILSALPVPGVVLGAYLTNAIGRRNTGLLGFAGYTVTGFLIGGLFHKISKHMAAFVVLYGLLNAFGHMGPGATIGLISSESFPTAMRGMGYSVALALGRTGAAVGTQCFMPLRERGGDSATFYLAGGVAVLGMFVYWFLPESGELDLENEDRKLEGYLRENEIAMG

SEQ ID NO: 72240 - protein, 70 aa, Musa balbisiana
MIIPVRCFTCGKVIGNKWDTYLDLLQADYTEGDALDALGLVRYCCRRMLMTHVDLIEKLLNYNTLEKTES

SEQ ID NO: 72241 - protein, 492 aa, Zea mays
MMDLADPQQQQRLIAGAALLLATAAFLRLLLGSRSRGGKRLPPTIPGAPVIGGLVKFMRGPIPMIREQYARLGSVFTVPIITRRITFLVGPEVSAHFFKGNEAEMSQQEVYRFNVPTFGPGVVFDVDYSVRQEQFRFFTEALRANKLRSYVDQMVAEAEEYFSKWGESGTVDLKYELEHLIILTASRCLLGREVREKLFDDVSALFHDLDNGMQPISVLFPYLPIPAHKRRDRARARLAEIFATIIKSRKASGQSEEDMLQCFIDSKYKNGRSTSEGEVTGLLIAALFAGQHTSSITSTWTGAYMLRFKQYFAEAVEEQKDVMKRHGDKIDHDILAEMDVLYRCIKEALRLHPPLIMLLRQSHSDFTVTTKEGKVYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLVVDN

SEQ ID NO: 72242 - protein, 315 aa, Physcomitrella patens subsp. patens
MGETEAGFAKLQGEDFEYYMQTYSIVLGRNSKKSAVDVDLAGLGGGMNISRQHARILYDFERQRFVLEVLGKNGCYVEGVLHYPGNTPVKLDSQDLLQIGEKRFYFLLPAKKIARSVAAVSSPPNPRKRAAGAGRAAPAALVLGPSPPAKKGRGQGRNGPAGRGTRERKQAPVSPWIGQQKVEPFPPAGSTTRVRESYRYDDDEPDVGHEQSEETEVVRIILEKLQSQYHLGEWMAVSKLHADILDHFQSRQRSSQFMHIMGLDEDGIEKDGKGNSKAWSGLVNLLKRYPRYFVINTKLKGGIRVEYVSLYTEEQ

SEQ ID NO: 72243 - protein, 388 aa, Streptococcus pyogenes M1 GAS
MKNQLGQLALEQAKTFGGKLEVQPKVDIKTKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLKKSLDEVSIVVNGGGSAGLSITRKLLAAGATKVTVVDKFGIINEQEAAQLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARAKTITVEMQIAAAKGIASLVPDDALSTTNIIPDAFKEGVAEIVAKSVRSVVLKS

SEQ ID NO: 72244 - protein, 349 aa, Streptococcus pyogenes M1 GAS
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 72245 - protein, 327 aa, Physcomitrella patens subsp. patens
MKKEQSPQEKPLFSFGVITDIQYADIDDGKSFQGVPRYYRHASEVLERAVDAWNKHGNLAFAVHFGDIVDGFCPKEQSKQAFERILSELANFERGPVYHMLGNHCLYNLPRQELNQFLNIPTSGLHSYYSFSPNNEFLFVVLDGYDVSALGWPADHPHTAAAMELLNTRNPNKEKNSPEGLVGVERRFVKFNGGVGDEQLAWLENTLREAQEAQQKVIICCHLPMDPGASFPSALLWNYDAVLAVVHKFNCVVACFAGHAHEGGHSVDSHGVHHHVLEAVLECPPGSDAYGYVNVFSDHLSLCGTDRMRSYDMNFQSSGMHPSHSLN

SEQ ID NO: 72246 - protein, 430 aa, Zea mays
  misc_feature (60)..(60): Xaa can be any naturally occurring amino acid
MASATVLKSSFLPKKSEWGATRQAAAPRPPTVSMVVRASAYADELVKTAVRTIRSIDRTXVNLFIFLLRLSNSSVRVCMLCIRTYVRMCGQKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 72247 - protein, 741 aa, Physcomitrella patens subsp. patens
MTVEGGITIQGGQLLVYGQPLLRNVPSNVTFTSESNLHGGFLGASFSESNSHHVVPLGVLEEVRFLCCFRFKLWWMTQRMGSCGQEVPYETQFMLLEGPSNKYSVLLPILDGAFRACLQGNAENELQLCVESGDPAVVTNRLDYSIYMHVGSDPFEVIEDAVRAVEAHLQTFVHREKKKIPGILDYFGWCTWDAFYTDVSAKGVMQGLSSLAEGGTPARFLIIDDGWQSVAAGDESAGQSTAVTQGTQYASRLTHIKENHKFQKDGVAGSWPEDQSLGLRHTVLDAKANFNLKYVYVWHALAGYWGGVQPGGSNTKIYDSSLVYPVHSPSVLENQPDMSVDSLTVNGLGLVNPTEFFSFYDELHRYLADAAVDGVKVDAQNIFETLGAGLGGRVKLAQQVHQALEASIARNFPENGCISCMSHSTDNLYHSKQTAVVRASDDFWPRDPASHTIHIASVAYNSLFLAEFMQPDWDMFHSLHPAAEYHAAARAVGGCAIYVSDKPGNHDFNLLKKLVLPDGSVLRALLPGRPTRDCLFSDPARDGKSLLKIWNMNKYGGVIGIFNCQGAGWCKLDKKYTIHEIRPDAISSSVRAADIDRLADAAPEGWDGACVVFSHQSCELVRITLHAALPITLRKLEYELFTVAPVKKLDTDLSFAPLGLIEMFNSGGALKGLDFDTQGKSVTMQVFGWGTFGVYASQRPRACALNCSTDIPLSYDQTSGLASVSLPRGEEGCLWTVTITF

SEQ ID NO: 72248 - protein, 361 aa, Oryza sativa Indica Group
MAAAADEEACMYALQLASSSILPMTLKNAIELGLLETLQSAAVAGGGGKAALLTPAEVAEKLPSKANPAAADMVDRMLRLLASYNVVRCEMEEGADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRSGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 72249 - protein, 274 aa, Rhizobium leguminosarum bv. viciae 3841
MTKEAMVAGIPQMGYGTWNRSADEAHQGVIWALEAGCRHIDTAQGYGNEQDVARGIKDAGVARNEIFITTKVKPDNYGPGAVMPSVRESLEKLRVDQVDLLLLHWPSPHNKYPLADYLGQFAEVFDSGLARQIGVSNFTKAMIDESIRLLDSRTITTNQVECHVYMQNRPIIDYCQNLGIAVTAYSPLARGAVVGDPVLEEIGKARGATSDQIALAFLIAKGHVVIPSSSKRGRIMQNFEARKITLTPAEIKRIEGLEKGMRLVNGDWCPVWDV

SEQ ID NO: 72250 - protein, 232 aa, Oryza sativa Indica Group
MLVVSEWTLKCGGGGGPALISLPAASFFAGNLAGSFLLTTLADTHLGRRKMLVLSLANMSVAVVITAFSPNVWVNAALRFVCRFGRSMAGTSAMVLSTELVGKWWRNTESQRWLLVHGRKQEAIEALRQIASLNDGEGITMSSFTMLDMCAVEVGDGVAGGEGMLAMLRLICEWWWALQRLATITTASFSIGVVYYRMPLSVGSLSFDLYSVAYNAAAELPSSFLSWLLMGR

SEQ ID NO: 72251 - protein, 335 aa, Clostridium tetani E88
MVKVAINGFGRIGRNVFKVLIEKYSSELEIVGINDLTDAKTLAHLLKYDSLYGKFNGTVEAKENAIAINGKEIKIFAERDPKNLPWKEEGVDIVLECTGLFTDATKAKAHIEAGAKKVIISAPAKNEDVTIVLGVNEEKYNSEEHNIISNASCTTNCLAPFAKVLDQEFGIVEGLMTTIHSYTNDQKILDAPHKDLRRARAAAESMIPTTTGAAKAVALVLPQLKGKLNGMAVRVPTPTVSMTDLVCTISKEATAEEINAAFKKASETDMKGILGYSEEPLVSVDYRGDARSSIVDGLSTMVMGNRLVKVVSWYDNEWGYSTRLADLAKYVADRL

SEQ ID NO: 72252 - protein, 401 aa, Clostridium tetani E88
MVYVAFNKKTIEDIDVKGRKVLVRCDFNVPLKDGKITDENRLMGALPTIKYIMEKGGKVILCSHLGKPKGEPKQELSLAPVAKRLSELLNKEVLFPADNEVVGENAKKAVENMKDGDVILLQNTRYRKEETKNEETFSKELASLADIFVNDAFGTAHRAHCSTVGVTEFVATSVCGYLIQKELKFLGNAVENPQRPFISILGGAKVSDKINVINNLLEKVDTLIIGGGMSYTFQKAQGYTIGSSLLEEDKIDYAKEMIEKAKEKGVKLLLPVDNVAAEKFAEDAEAIITEDQNIKEGYMGLDIGPKTSKLYSQEVQSAKTVVWNGPMGVFEFEKFAKGTIEVAKAMAESQATTIIGGGDSAAAVNQLGFGDKMTHISTGGGASLEFLEGKELPGIAALNDK

SEQ ID NO: 72253 - protein, 255 aa, Clostridium tetani E88
MKGVYGLRKAIIAGNWKMHNTIDESVKLVEELIPKVKEAECEVVVCPPFICLPKIREITEGTNIKVGAQNMYFEEKGAFTGEVSPLMLEKLNIDYVIIGHSERRQYFKETDQTVNKKLKAAFEHNLIPILCVGETLDEKENGVTEEVVSKQVKLGLFELKEEQVEKLVIAYEPIWAIGTGKTATSEEANEVIALIRSTVKSLYGDKVAESLRIQYGGSVKPSTIKEQMSMSDIDGALVGGASLKANDFSAIVNYK

SEQ ID NO: 72254 - protein, 176 aa, Oryza sativa Indica Group
MAAAVAAARSSTKGVRRTKSLISRTLERCKSGLSSGGGGRSAAAPVAGCFSVYVGPERERFLVRTEYANHPLFRRLLDDAEREYGYAAQGPLALPCAVDAFLDVLWQMERDGCGGGGDDEDDLSIGGGGAASPICGLPSCGSKGRAAAAGYRMLSPARMTSILSRSSPMATPSRKR

SEQ ID NO: 72255 - protein, 513 aa, Clostridium tetani E88
MNKKPVMLMILDGFGITNHEDGNAVKMANKPNFDKLLREYPHTQLKASGLNVGLPEGQMGNSEVGHLNIGSGRVIYQELTRITKDINDGVFFENTEINYAIDEAIKNNSSLHLLGLLSDGGVHSHIDHLKAILKLAKDKGLNRVYVHAFLDGRDVPPSSAKEYIINIENYMKELSVGQIATLAGRYYAMDRDKRWERVELAYNALVYGTGELSNSAVEAIEKSYKDNTTDEFVLPTVILKDGKPTGTIKDEDSIIFFNFRPDRARQITRALNDKDFDGFERKRLKLNFITMTQYDKTIENVRIAYKPQSYKNTLGEYVSSLGLNQLRIAETEKYAHVTFFFNGGVETPNKGEDRALIPSPKVATYDLKPEMSAFEVKDEVINRIESNKYDMIILNFANPDMVGHTGVFDAAKTAIEVVDKCVGEISDKILEKEGTVFITADHGNSEQMIDYSTGKPMTAHTTNEVPFVYVSKDAKDKRLKSEGILADIAPTMLTEMGVKIPEEMTGRNLIEGK

SEQ ID NO: 72256 - protein, 431 aa, Clostridium tetani E88
MKNYIEIIDVSARQVLDSRSNPTVEVDVILEDGTTGRAAVPSGASTGIFEAVELRDGDKSVYNGKGVLKAIENVNTIIAEELVGMNVLDQIAIDKTMIELDGTDNKGKLGANAMLGVSLACAKAAAEYLGLSLYQYIGGVNAKVLPVPMMNIINGGEHADNNVDLQEFMIMPAGASSFSEALRMCSEVYHSLKSLLKAKGYDTGVGDEGGFAPNLNSNEEAIQVIVEAIEKAGYKPGVEIFIALDPASSEIFEDGKYNLKGEGKVLTPQEMVDYYANLVAKYPIISIEDGMAEEDWEGWRLITERLGTKIQLVGDDLFVTNTDRLTMGIERGVANSILIKLNQIGTLTETLNAIEMAERAGYTAVVSHRSGETEDTTIADLVVAVNAGQIKTGAPARSERVAKYNQLLRIEDELGEMGEYRGLKAFYNIKK

SEQ ID NO: 72257 - protein, 673 aa, Clostridium tetani E88
MESFIVYSVLAGVIALIFAFMLSSFISKESAGNERMQEIAGHIHDGAMAFLKTEYKYLTGFIVIVTVILAIFVGWQTAACFILGAIFSIFAGYFGMNVATKANVRTAEAARHSQGKALNIAFSGGAVMGMSVVGLGVVGIGIMYYIFGGNMEFVTGFGLGASSIALFARVGGGIYTKAADVGADLVGKVEAGIPEDDPRNPAVIADNVGDNVGDVAGMGADLFESYVGSIISALTLGTVVYANKEGVMFPLILSSIGIVASIIGILFSRKSKAKDPQKALNTGTYIGGIIVIVSAAILSNTIFGNLKAFFAVASGLVVGMIIGKITEMYTSDAYSSVQKIANQSETGPATTIISGLAVGMYSTLWPIVLISIGVLVSFFVMGGGSNAMVGLYGISLAAVGMLSTTGLTVAVDAYGPIADNAGGIAEMSELPHEVREITDKLDSVGNTTAAIGKGFAIGSAALTALSLFASYAQATELESIDILNTVTLVGLFIGAMLPFLFGALTMESVGKAANEMIEEVRRQFKTIPGIMEGKATPDYKKCVDISTAAAIREMILPGVLAIVVPVAMGLLLGKEALGGLLAGALVSGVLVGILMSNAGGAWDNAKKYIEGGAHGGKGSEAHKAAVVGDTVGDPFKDTSGPSMNILIKLMTIVSLVFAPVVLQYGGILLNLIK

SEQ ID NO: 72258 - protein, 167 aa, Glycine max
ARAQQADLCIVHIVLSLGFFEPAFLVTLLFLLNASIKTKTPKNNDKWAITFVLLTCLPFATLQALLIFFAPFENRVPAETSVVLNDGYGFETVLCAYPFLSSALFAVFGVTYSTWFLFSCWRVLSLVINKGLRMKIYVLAWIVLVAIPLQIVTLGFIVRWSPHQEVH

SEQ ID NO: 72259 - protein, 111 aa, Arabidopsis thaliana
  misc_feature (34)..(34): Xaa can be any naturally occurring amino acid
  misc_feature (94)..(94): Xaa can be any naturally occurring amino acid
  misc_feature (102)..(102): Xaa can be any naturally occurring amino acid
MAYSMFSSTAVVTSPAQATMVAPFTGLKSSASFXGNRKANKDIISITSNGGRVSCMKVWQPIGKKKFETLSYLPDLSDVELAKEVDYLLRKKWXPCVELELXRDLCTVSTE

SEQ ID NO: 72260 - protein, 236 aa, Frankia sp. CcI3
MADIRSTIVRLPVTVERSTTVRDAAAQMERQGVGALLVMENDRLVGIVTDRDIVLRGVARGIPTDSRIDALMTTEVITVPSGVDLERAYEIFRDHAIRRLPVVDGRRLVGLLSVDDLLIRTEHEMAELVHPLADEVFAPHREAPPLATTGEEPVELALELPPRRRAMRAHPGDTLVVHRPTVTQPDRLGEILEVRSPAGDPPFTVRWSDTGHVSFVYPGPDAEVRHPPEEARSGTG

SEQ ID NO: 72261 - protein, 161 aa, Rhodopseudomonas palustris CGA009
MTIKVGDRLPDAQFRVMTEDGVQVKTTDDIFKGKKVALFAVPGAYTGTCHKMHLPSIFLNAYAMKDKGVDTIAIVSVNDAFVMSAWKRDTDQRNEAIFLGDGNADFTKAIGMEMDGSGFGLGTRSLRYSMVVEDGVVKTLNLEPNPGKVEVSGGDTLLGQL

SEQ ID NO: 72262 - protein, 198 aa, Sulfolobus acidocaldarius
YIIPDEIPYKAVVNIENIVATVTLDQTLDLYAMERSVPNVEYDPDQFPGLIFRLESPKITSLIFKSGKMVVTGAKSTDELIKAVKRIIKTLKKYGMQLTGKPKIQIQNIVASANLHVIVNLDKAAFLLENNMYEPEQFPGLIYRMDEPRVVLLIFSSGKMVITGAKREDEVHKAVKKIFDKLVELDCVKPVEEEELEF

SEQ ID NO: 72263 - protein, 443 aa, Desulfitobacterium hafniense Y51
MFPITIGLNHKTAPVEIREKVSFHPSEINKALMELNELSALNGIVLLSTCNRLEIYAATPEVELGVSVIKKFLARHGKLREEDINQYLYVHTLYDSVRHLFRVVAGLDSMVMGETQILGQVAEAYEKSSQLNLSNKIIHAIFQNALAVGKRVRSETQIDQHPTSVSYTAVELAKQTFGDVQGKSILILGAGEMSALTAKHLVASGADTVLVSNRSMQRAQALAEEFSGRAIPYEELDTALAEADIVISATAAAHFVIKPERMRRVMEQRRQRALLLIDIAVPRDIHPNVGELEGVTLFDIDDLRGVVDSHQKAREEAALQAGRILEEEMGRFVKWHNSLYVVPTIVALQRRGEEVREIMLKSALNKLGPIDEKQEKIIRSMANSIVTHLLHAPIANLKEAANTSQGHLYTEILQNLFDLDGNELSPHAGWSVHHAASHHSNQG

SEQ ID NO: 72264 - protein, 285 aa, Magnaporthe grisea 70-15
MSEPLSAADEERYTNIIDGILQTADLQTVTMKKIRNGLETALDCKDLSEHKQAIKALIGARFDAATANLMENPNEPTPAASETPKRDYDDMVNGNGTIKSEEDEDEEADDDEDQNGDQINVSVPPPKKKQKRESSTESADEKFARQLQAEEEQMARVRTTRGGRDKKAAPKKKVTKKKSKAKVAADDDEDLSGDGTQKRKAGGGFQKPFHLSASLAEVCGEPTLSRPQVVKKLWEHIKGNNLQDPNDKRQILCDEKMQAVFKQSSLNMFAMNKLIGSHLYPVDEE

SEQ ID NO: 72265 - protein, 122 aa, Musa balbisiana
MASKLHQLRSKAVQASEFVVKHGCAYYKELLEKNKQHIVQPPTVEKCQELSKQLFYTRLASIPGRYESFWKELDGVKRKWRNREDLKIEDAGIAALFGLELYAWFCVGEIVGRGFTFTGYYV

SEQ ID NO: 72266 - protein, 455 aa, Physcomitrella patens subsp. patens
MVLTQSRSMKDSNTHTIDSMFATRYVQAPLPRWRLPDNETPKDAASQVINDELMLDGNPRLNLASFVTTWMEPECDKLIQKSLNKNYIDMDEYPITTEIQDRCVNMIAHLFKAPLDDGQPAVGAGTVGSSEAIMLAGLAFKRKWQLQRRAAGLPCDKPNMVTGANVQVCWEKFANYFEVEIRAVKLREDYYVMDPAKAVEMCDENTICVCAILGSTYNGEFEDVATLNNLLEKKNKENGWNIPIHVDAASGGFVAPFMYPDLVWDFRLPLVKSINVSGHKYGLVYAGIGWVVWRSKEDLPEELVFHVNYLGADQPTFTLNFSKGASHVIAQYYQFIRLGFEGYKKINMNCAENAKFLADGIVATGRFKLLSKPVGVPLIAFSLTDRSRFDEYDIADGLRRYGWTVPAYTMAPDAQQITLLRVVVREDFSRSLADRLMTDLKRTLETLDSQPPKLV

SEQ ID NO: 72267 - protein, 150 aa, Glycine max
MAEQTFIMIKPDGVQRGLIGEVISRFEKKGFYLKGLKLQNVEKSFAEQHYADLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 72268 - protein, 521 aa, Moritella sp. PE36
MDDRVTDNEPQQPQSLLTANDYLCKILLSPVYEAAVVTPLQPLTKLSERLGNSILLKREDRQPVHSFKLRGAFNKLVQLSEEQKLRGVIAASAGNHAQGVAMSAKKLGIKAIIVMPVITPEIKVSAVRGFGAEVCLHGDSFDEASHHAKKLAIEDGLTLIPPFDDPDVIAGQGTIARELLEQNAHLDYIFVPVGGGGLAAGISVYIKQLKPSIKVIGVEPRDSACLRAALDAGEPVTLDRVGIFADGVAVKRIGVETFRLCNEFLDDVITVSSDEICAALKDIFEDTRAIAEPSGALALAGLKKYTELNSLRDQNMTAILSGANVNFHSLRYVSERSEYGEKKEAVLAVTIPERPGAFLKFCELIGNRAVTEFNYRYSNRAAANIFVGLRTPQGTTELATVIKLLQDAEYPVVDLSEDEMAKQHVRYMVGGRPAEALQERLFSFEFPEHPGALQKFLLTLGMNWNITLFHYRNHGAAYGRVLTGFELPDGEMKAFSAYLVKLGYQYKEETDNPAYKFFLAH

SEQ ID NO: 72269 - protein, 305 aa, Musa balbisiana
MPTEKTNQNGLAASAPAAAARHAIPTYPPPESESEESWVWAQIKAEAHRDAESEPALASFLYATVLSHNSLAFSLAFHLANKLCSSTLLSTLLYDLFLQSFSSKPSLISAVVADLLAVRHRDPACVSFSHCLLNYKGFLAVQAHRVSHLLWGQHRRPLALALQSRIADVFAVDIHPAARIGKGILLDHATGVVVGETAVIGNNVSILHHVTLGGTGKAVGDRHPKIGDGVLIGAGATILGNIRIGEGAKIGAGSVVLIDVPPRTTVVGNPARLVGGKDKPARHDDVPSESMDHTSFIQEWSDYII

SEQ ID NO: 72270 - protein, 949 aa, Musa balbisiana
MAMACLFSSAKMAAVWCMVILGFAMAAVRVHCQSTDTLGFISIDCGIAAGSTYVDPTTNIPYVSDTQYIDAGVNQNISAAYVTNFMGRRYLNVRSFPNGTRNCYTINSITPDSKYLIRASFFYGNYDGLGSQSRLFDLYVGVNLWKTINITDPGSGYRTDVITVAASDSFSVCLVNTGHGTPFISGLDVRPLKEILYPAVNASRSLVLTRRLNMGPTDTFIRYPDDSHDRIWDPFNNIPFWAEISTNSTVENFVDDKFEAPSAVMQTAVIPVNSTKLMMSWEPEPGDVNEYYVVMYFSEFLTLTGNMSRQFYVYLNGHLWYAKPFTPDYLFSDAIFGTNPTEGYHQYNVTIQALDNSTLPPILNAMEVYSRMSDVNVPSDAGDVDAMMAVKAWYKIKRNWMGDPCSPKALAWDGLNCSSSLSNPPRITALNLSSSGLTGEIATSFASLTAIQILDLSHNNLTGTIPAILAQLPSLKILDLTNNNLAGSVPSPLLTKAQNGELVLRLALCLKDQVACRFSQQSVDLYNDRIESNPSLCGNGTSCEITPTTKKKKLSTPIIVIICLAPLLLLLVVVSIIWRLRKPPSKGNSVEPQNEETLKRVKEHQDGLLQLENRQFTYMELKSITNNFERVIGKGGFGTVYHGCLEDGTQVAVKMRSQSSSQGTKEFLAEAQHLTRVHHRNLVSMVGYCKDEPCLALVYEFMAQGTLQDHLRGSQPPLLRGGRALSWRQRLQIAVQAAQGLEYLHKGCKPPLVHRDVKTGNILLSESLEAKIADFGLSKAFQSEINNTHVSTAVMGTPGYLDPEYYATNQISEKSDVYSFGVVLLELLTGQPPVITAAGNAHIAHWVRQRLARGNIEDVVDGRLQGESDVNSMWKCADVALRCASPVAHQRPDMAEVVTQLKESLQLENPYDSRTESLYAEAASDVSQNSALEIERVAAMSMADRPSAR

SEQ ID NO: 72271 - protein, 412 aa, Oryza sativa Indica Group
MNGASSGGGGGGAGGDGPLVYQRWKGNNVFVLQGRFIFGPDARSLYVTMFLIIAPAAIFCVFVAKELMDNFSYGLGLPVMIAAVVFTAYDLSLLLLTSGRDPGIIPRNAHPPEPEGLDGNAEVGSNQTPPMRLPRVKDVVVNGITVKTKYCDTCMLYRPPRCSHCSICNNCVERFDHHCPWVGQCIGLRNYRFFYMFVFSTTLLCLYVFGFCWVYIVKIRNSEQVTIWKAMAKTPASIALLVYTFIAVWFVGGLSVFHLYLMSTNQTTYENFRYRYDQRANPYNRGVVENIKEIFFSAIPASKNNFRARVPVPQEQGLRPRPTNGFMSPNMGRAVGDIEMGRKPVAWDEPRMAAEIGDLGAGLGNLLEDKDSRFRNASPDLSRDALAIGGLDDQGSSVMNPGRTSWGVEAGR

SEQ ID NO: 72272 - protein, 694 aa, Acidovorax sp. JS42
MAGSTSALTAPLILALVCGLIAVAYGLWARSWILSKDAGNARMQEIAGAIQMGAAAYLARQYKTIAFVGIVLAILIAAFLDGTTAVGFVIGAVLSGACGFIGMNVSVRANVRTAQAATQGMGPALQVAFRGGAITGMLVVGLGLLGVTAFAWFLVGNGRLTPTASLPALLNPLIGFAFGSSLISIFARLGGGIFTKGADVGADLVGKVEAGIPEDDPRNPAVIADNVGDNVGDCAGMAADLFETYAVTLIATMVLGALLVGAAPVAAVTYPLALGAVSIIASIIGCFFVQAGPGMRNVMPALYRGLAIAGVLSLVAFWFVTAWVIPDNALGGTGAQMRLFGACATGLVLTAALVWITEFYTGTQYSPVRHIAQASTTGHGTNIIAGLGVSMRSTAWPVIFVCAAIIVSYTLAGLYGVAVAAMSMLSMAGIVVALDAYGPITDNAGGIAEMAELPSSVRDITDPLDAVGNTTKAVTKGYAIGSAGLAALVLFADYTHKLESFGQAIRFDLSDPMVIVGLFIGGLIPYLFAAMAMEAVGRAAGSVVVEVRRQFSEIPGIMEGTAKPEYGRAVDMLTSAAIKEMIIPSLLPVAVPIIVGLALGPKALGGLLMGTIVTGLFVAISMCTGGGAWDNAKKFIEDGHHGGKGSDAHKAAVTGDTVGDPYKDTAGPAVNPLIKIINIVALLIVPLVVKFHAG

SEQ ID NO: 72273 - protein, 425 aa, Zea mays
ETSEDRLREYFGRFGEVTEAVIMRDRSTGRARGFGFVVFADAAVAERVTMDKHTIDGRMVEAKKAVPRDDHSIVSKSNGSSTGSPGPGRTRKIFVGGLPSSVTEADFRRYFEQFGIITDVVVMYDHNTQRPRGFGFITYDSEDAVDKALHKSFHELNGKMVEVKRAVPKEQSPGPVVRSPVGVGQNYATNRVHSFLNGFNQGYNPIPMGGYGMRVDGRYGFLSGARNGFSSFGPGYGMGMNVEGGMSGTFGATSGFISNSNGRQMGSYFNASSNRLGSPIGYLGLNDVPGSMLGSMSRNVWGNGSLNYPSNPANMSAFASPGNGGQVSLTGDNWGGLPSAHGIGNISGLGSGNLGRGAGDNNFGLPSGSYGRSNSTGTIGEPFSAAGNTYDVNNADTYGSSSVYGGTVWRFTSSEVDMHSFGHDI

SEQ ID NO: 72274 - protein, 186 aa, Acidovorax sp. JS42
MSFQPLNPQTMSLNNVKPGKNIPETFNVVIEIPAESDPIKYEVDKESGAVFVDRFLTTAMYYPCNYGYVPQTLSGDGDPVDVLVITPYPLHPGVVVPCRALGILKMEDEAGVDGKVLAVPTTKILKMYEPWKTVEDVNPMRLKAISHFFEHYKDLEEGKWVKVLGWEGIDAAHKEILDGVENYKKA

SEQ ID NO: 72275 - protein, 154 aa, Rhodococcus sp. RHA1
MPLEVGTTAPDFTLKDQNNQEVTLSDYRGKKNVLLVFYPLAFTGTCQGELCKVRDELPKFENDETAILALSVGASPTHKIWSAEQGYTFPLLADFWPHGAVAQQYGVFNEKLGFANRGTFVIDKEGVIRFAEMNGPGEARDQEAWEKALATLES

SEQ ID NO: 72276 - protein, 161 aa, Zea mays
GGFLFEKFFDTKVSIPFGGPPLNTPSLQKYKRMVDVWGGWSLFQTLFQPLKKGSLKPGVFFSTVGGKYILNQTFFAGSMVGGGLGFFEPFKDPNPFFSFELGEGGMNFFPEVLKGGGNLFVFFGGWGGGFRAFLALLLLGFSRPFFLCPILPSFKFLPFWV

SEQ ID NO: 72277 - protein, 521 aa, Oryza sativa Japonica Group
MPAASSLVVGVAFTAAVAVAVAAAVARRAWRHRGLRLPPGPPGWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEGARRARRRRHEARGARRGGAHRRLPPVPPPLPVAAAPPGGRAPPRADRHGAPAHQPGAAPSSAACGPARRPTPPSRRQYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 72278 - protein, 361 aa, Arabidopsis thaliana
MEAKEETPWSSILVPSVQEMVKDKMITTVPPRYVRYDQDKTEVVVHDSGLISEIPIIDMNRLCSSTAVDSEVEKLDFACKEYGFFQLVNHGIDPSFLDKIKSEIQDFFNLPMEEKKKLWQTPAVMEGFGQAFVVSEDQKLDWADLFFLIMQPVQLRKRHLFPKLPLPFRDTLDMYSTRVKSIAKILLAKMAKALQIKPEEVEEIFGDDMMQSMRMNYYPPCPQPNLVTGLIPHSDAVGLTILLQVNEVDGLQIKKNGKWFFVKPLQNAFIVNVGDVLEIITNGTYRSIEHRAMVNLEKERLSIATFHNTGMDKEIGPARSLVQRQEAAKFRSLKTKDYLNGLFSRELKGKAYLDAMRIEGK

SEQ ID NO: 72279 - protein, 891 aa, Cardamine flexuosa
MKIITEGRFHVSLLSLLLLLSASHLISAADYSPTDKILLNCGGVSDLVDTDNRTWISDVKSKFLSSSGDSKTSPAATQDPSVSQVPYMTARVFRSPFTYSFPVAAGRKFVRLYFYPNTYDGLNATNALFSVSFGPYTLLKNFSAAQTAEALTYAVIVKEFIVNVEGGSLNMTFTPESNAYAFMNGIEVTSMPDIYSSTDGSLIMVGASSDFTIDNSTALENVFRLNVGGNDISPSADTGLYRSWYDDQPYIFAAGLGIPETADPNMTIQYPTGTPTYVAPVDVYSTARSMGPTASININYNLTWVFSIDSGFSYLVRLHFCEVSPRITKINQRVFTIYLNNQTAEEEADVIAWAQGNGIPFHKDYVVNPPEGKGQQDLWLALHPNTRNKPEYYDSILSGVEIFKVNTSDGNLAGSNPIPGPKVTADPFKVLRPRTSQSRNHTTIIVGAAIGAVVLALIIGLCVMVAYCRRNRGDYQPASDATSGWLPLSLYGNSHSAGSTKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAHGTMREHLYKTQNSPLPWKQRLEICIGAARGLHYLHTGAKHTIIHRDVKTTNILLDEKWVAKVSDFGLSKTGPTLDHTHVSTVVKGSFGYLDPEYFRRQQLTDKSDVYSFGVVLFEALCARPALNPTLAKEQVSLAEWAPYCYKKGMLDQIVDPYLKGKITPECFKKFAETAMKCVLDQGIERPSMGDVLWNLEFALQLQESAEENGKGMSGDMDMDEIKYNDGNGKGKNEMSSDVYEGNVTDSRSSGIDMSIGGRSLASEDSEGLTPSAVFSQIMNPKGR

SEQ ID NO: 72280 - protein, 459 aa, Prochlorococcus marinus str. MIT 9303
MLPENFLLSGLRKPVISGLTRPEAWRRKQLKQIEVLIEKHQDEVLDALATDLGKPPTEALFELIALRGELKLAQRQLSRWMQPRHVQVPLAHQPGQAEVILDPLGCVLIIGPWNYPFSLTLQPLISALAAGNTAVLKPSEHAPATSRLIAHVIPQHFSSEVVQVIEGDGAIAAALIKQPFDHIFFTGSGAIGQKVMAAAAEHLTPVTLELGGKSPAIVIDGADLSVTARRLVWGKGLNAGQTCIAPDHLLIQEQLKQPLLQAMKGAITELYGGDPLRSPHLAKIINDCHFQRLQHLLDQAKQRGKVLSGGQIDPDQRRIAPTLIDVDKRDDPLMEEELFGPLLPVISVHSLNEALAEVRQQPKPLALYLFGGTHADQQQLLNTTSSGGVCFNDVVMHVGIPELPFGGVGASGMGRYHGLAGFETFSHQKSVLRRPFWLDLKLRYPPYKANLAMLKKLLG

SEQ ID NO: 72281 - protein, 525 aa, Pinus taeda
MSFDKLLQALPPPLPLPAILIATFIFFFSCWILHQSQRNERLPPGPYPWPIIGNFHQVRLPLHRTLKNLAEKYGPILFLRFGSVPTVVVSSSEKAKHFLKTHDLIFASRPPTSVGKYFFYNFKDIAFSPYGDHWRKMRKICVLELLTSKRIESFKHVRQEELSAMIHSIWEESESGRIAVNVSKAISTSLANILWRILARKKFSDNDLGADGKGFADLVVEVSIAVGSLNIGDFIPYLDCLDLQGIKRALKKANARFDAFAEKMIDEHINASTIRNGEADAGCHVKDIIDVLLEMAKNDNTGAKVTREIIKAITYELFSAGMETSANVLEWAMSELLRHPHAMKKLQQEIESVVGQQGTVKESDLASIVYLHCVVKETLRLYPSLPLALPHESLEAVTVGGYYIPKKTMVIMNLWAIGRDPSVWGADASEFKPERFMQMEENGIDLSGGQSDFRMLPFGAGRRTCPGSAMAILTVEFTLAQLLHTFDWRVEGDPSELDMKEACATKMPRQTPLLAYPRLRLPRCP

SEQ ID NO: 72282 - protein, 861 aa, Oryza sativa Japonica Group
MLEKDRIAYFYDDNLGEDCPVFDNLFEFCQIYAGGTLDAARRLNHKTCDIAINWAGGLHHAKKCEASGFCYINDLVLGILELLKYHARVLYIDIDVHHGDGVEEAFYFTDRVMTVSFHKYGDFFFPGTGDIKDIGEREGKYYAINIPLKDGIDDSGFTRLFKTVIAKVVETYLPGAIVLQCGADSLARDRLGCFNLSIEGHAECVKFVKKFNIPLLVTGGGGYTKENVARCWAVETGVLLDTELPNEIPDNEYIKYFAPDYTLKVSNVNMDNLNSKSYLSSIKVQVMESLRAIQHAPGVQMQEVPPDFYIPDIDEDELDPDERVDQHTQDKQIHRDDEYYEAPAPAEAPAKAPQRRQRRGPHDVEDEAWGLLRESVVRYCGSPVGTIAACDPNDASPLNYDQVFIRDFVPSGIAFLLKGDYEIVRNFILHTLQLQSWEKTMDCHSPGQGLMPASFKVRVVPLDGDDDVTEEVLDPDFGEAAIGRVAPVDSGLWWIILLRAYGKCSGDLSVQERIDVQTGIKMILKLCLADGFDMFPTLLVTDGSCMIDRRMESMTPIGNSVLLYNSTYRTTALFYSALLCAREMLTPEDGSADLIRALNSRLIALSFHIREYYWLDKRKLNEIYRYKTEEYSYDAVNKFNIYPDQIPPWLVEWIPPKGGYFIGNLQPAHMDFRFFSLGNLWSIVSSLATSHQSDAILDLVEAKWSDLVADMPMKICYPALEDQEWKFITGSDPKNTAWSYHNGGSWPTLLWQLTVACIKVDRSEIAAKAVEVAERRIANDKWPEYYDTKRARFIGKQSRLFQTWTIAGFLVAKQLLENPDKSRILWNNEDEEILNAMNRMTDASNLKRRRGRKGLKKTYIV

SEQ ID NO: 72283 - protein, 533 aa, Ralstonia eutropha JMP134
MACAVLDPMHERELRRHTVTWQPEIDELAYRRRLAERMGGEEKVARHREAGKLTVRDRVAGIADPGSFREVGGLSGSGRYDSNGRLVDLVPSNLVMGRAKMGGRPVVLVGDDFTVRGGANDGAVGDKLVHAEKMAHDLRLPMVRLVDGTGGGGSVRNIEIKGHTLIPTMKVWQHVVENMSVVPVVSLALGSVAGMGAARVAASHYSVMVKETSQLFTEGPPVVAHIGQQLSKNELGGSHIHTRNGVVDDEVATERDAFEHARRFLSYLPASVHELPPRTEPSDDPARRDEWLLSAIPRDSRAVYKIRPIVQALVDDGSFFEIGRQWGCAIVTGLARLDGWPVAVIASDPYFHGGGWDSATAEKFTRFVDLAQTFHLPVVNLVDTAGFLIGQEAEQAATMRHGVRALAAVYQATVPWCSVILRRAYGMSAAAHQHMGRFNCRYAWPSANWGAMPIEGGLEVAYKAEIEGADDPVQKRAEIEQRVRSLTSPFRSAEAFVIEDIIDPRETRTLLCEFANLAAPLREAGISRFGIRP

SEQ ID NO: 72284 - protein, 1105 aa, Ralstonia eutropha JMP134
MNKLLIANRGEIALRVLRAARDLDIATVAVYSQDDASSRHRMLADEAIALDGSGPAAYIDIAGIITAAKASGCDAIHPGYGFLSERADFAQACADAGIRFIGPTVEQLALFGDKGRALELAMESDVRVMPATRGGASLEDITSFFDKQGDAGVVIKAVGGGGGRGMRVVRRREDLAEAYARCRSEAASAFGVDALYAERLVSRARHIEVQIAGDGTHVVALGERDCTLQRRFQKLVEIAPSPVLRPQLRDEIIKSALRLARCVNYRSLGTFEFLVEETESGEQKDFVFIEANPRLQVEHTITEQVTGVDLVALQIGLAAGRTLADLGLDPASPPQPKGFAIQVRINAESTDAQGLARPAYGRLERFDPPSGPDVRVDSHGYTGYEPSPNFDTLLAKLIVSSAAPKFEAAVRRLQRSLAEFRIVGVPTNINLLRALVQRDDFLTQDVHTRHFEAILPALAASAEAVAEAGRAQEALLGDASRSPAAHASRSHEAEEEVEDGLVAIRAPLTGRVVEIAVGLDEIVKPGQTVAVLDAMKMEHAITAECGGRVVDLRLEKGALAAEGQILIVVEQVEAEGVAVDAAQKADPNAIRADLQRVLDRHAFLDDAARPDAVARRRSRGQRTARENLADLCDADTFVEYGGLALAAQSSRRTKDDLIVNTPADGLITGIGNINGALVGKDRARSAVMAYDATVLAGTQGKRNHIKTDRIVEVALRDELPLVLFAEGGGGRPGDVDFPSVSGLYQPSFAAFAELSGEVPVVGIVSGRCFAGNAAFLGCCDVIIADKSANIGMAGPAMIEGGGLGIYRPEEVGPAPVQFANGVIDVLVENEAEAVQVAKHYLSMFQGRVEHWSAPDPLALRHVVPENRLRVYDTRKAIEGIADAGSVLMLRGGFGAGIHTALARVEGQAVGIMANNPYHLGGAIDADAADKASRFMQLCDAHGLPIVSLIDTPGFMVGPECEAQAQVRHVSRMFLTAAKLRVALLAVTLRKGYGLGAMAMAGGGFRSASFTVSWPTGEFGPMGLEGAVRLGFKKELEAVPDGPERKALFDQLVGQSYERGHAINTAAAVEIDAVIDPAQTRKWIAQGIASAELRSRRARRGFVDAW

SEQ ID NO: 72285 - protein, 415 aa, Aquifex aeolicus VF5
MKILVQKFGGTSVGTLERIELCAKRVIKALEKGYKPVVVSSAMAGETDSLIELAKKVHPRPPEREMDTLLAVGEQKAIALFAMTLNKLGYPAVSLCGWQVPIITDNVHTKARIRKIGISRLLSLIEEGYIPVVAGFQGVTEDWEITTLGRGGSDTTAVALAAALKADCEINTDVPGVFTADPRIVPNAKKIKKISYEEMLELASLGAKVMQIRSVEFAAKYNVRIHVRSTFSEEEGTWIVPEDEVMEKVAVRGITVDTKETRFTVVRVPDKPGIAAEIFKALGDAHIVVDMIVQNVSHEGYTDMSFTVNKTDADKAEEIVKKIAQKIGAKEVVRDDKVAKISIVGIGMKSAYGVAGRMFDILARNGINIKAISTSEIKISCLIDEKYAELAVRALHEEFIEEMEEFETINGKNKE

SEQ ID NO: 72286 - protein, 1365 aa, Aspergillus nidulans FGSC A4
MAAGNHADGNYDLDSNDPSDTALDWEDKSPTGAAFASAHPPAPRPRLPYFRRPSGPPSQPRLDSSSPPTPDRPRSLLSSPPKVVIAARNPTGGIRGKLSCILNALSSALGLGRNGDGARARDSASVAADSNSALIAAEEAEAEVETADANNNGESDEGKDENPEGNDNEGEREEEYTVSDEAGEQRETENLGTQSTGTAWNFAAPGMGYYTESEVAEELEVDETGIERGTEDDEDEAGEAGEKRASAESNTDGQLPKTTTSHFYSLDIPLLEIEDGEVPIASPSLANPKSSWLSSDGGLRSAGVGLPSPSGSVANCRWSATLPVYTSNPPKQTKHEEYQPLADAASSDCAPISLSNGLDQPLVVPRDDEDGGADEDRGGQEEQEEKVGDRHIRTAGVNGPPEFNMLNSRIPNAFDRFLIEAPGPSIMPLPTVYGLSRPLQDQALQVWGDENEQPLSAQGNDTALLFHDADRLIPSIEVDHDHDHDRPNSSDGLRSDSATARASGPTKPSGRRPGTKRYNGSRSNKGDIAWGKANRGSYSIQEPTTEDTEEDVGEEREKRQDGVTTDRLEGGPGGILGEGYPEGGSSAGGGPDNSLGYSQERDNDRDRFPEMSPDPPTPVEYPESPVVLDFRGQTPEVSPDPPTPREDLEIPISRELTVSPDPPTPVEFPETPILLAFGNHTPEVSPDPPTPKEDPELPVPGNSTISPDPSTPLDSAESRPTAVASTSRWSIAPPPPPTPSRPAVTRPRSRIAYGKFGNLTVPDASLSNSGPRASKRRRKRGQVEDGEYVNEAGEEDDFSDDDRNNYGGGYDAQKRPSRGSGGRKRKSPSSSNALTAQKRVLRNRTIGFSNTEVGAPGLGEKRAASPSDAGTNAKRAKPGTPAASGFNRYASTSLVENSVPSRKCSVYVLGENGNGQLGMGNGTPVQYKQPTKNTQLPDVVQVAAGGEHCIALTHDNKIYTWGDNSHGQLGRLTNSMTAQMPGEVDFSEVNLPDYTIFAQVVATRSACFVLTMFGDVYGWGTFSEIYEDENGEQHCEPLGFRHQCKCQRTPLHIQELQNVKRLAAGSDHVLAQISILIGGNRASSSASKMKGSRVRKRKDTIAAEGSSTGSATKVRDVVRSWGAYKRGQLGRTAANIANCLNPLLCDFPGNSSRALKNPDNVSTIGSGKFHSFVIKESGDFLAWGYNKFAQTAFVPPAASVLRRDLKVDKPSTVASLRGQRVHFPTGGVDFSVALTAGGQCLSWGSFQDGVRSIPDTAMSDEPDFNKVAGRDEGTQIPAIMKVPTFVPGINAHDKGIKMVSAGWTHTIAVTNGGKALGWGSNDHYEIHPDETKHPINDPMEIPMEGLRVVEAAAGRFFTILLVQSD

SEQ ID NO: 72287 - protein, 348 aa, Musa balbisiana
MESDPPGIQPRRARDEDPTTAASSSAEIPAPTGLVAKPVEARGRCLWRKGGAAAVSWGAASTVGRRKEMEDAVAVAPAFMALTCERVGGCAAPPGSGEVSHVRFFGVYDGHGGAQVADYCAKRVHEVVAEEWDRIQNPECWKRRWETAFHDGFKRVDNEVIDEAVAPDIIGSTAVVVVISGCQIISSNCGDSRALLCRGNQRIQLTIDHKPDREDELMRIESLGGRVINWQGCRISGVLAVSRSIGDRYMRPWVIPVPEISFMSRSEDDDCLILASDGLWDVMSIEEVGDMACRHFRWQRRNGLVDGVSPAQAVADHLTELAYQKNSSDNISVVVVDLKSRSRRRPRQ

SEQ ID NO: 72288 - protein, 280 aa, Physcomitrella patens subsp. patens
MAERGGERGGFGRGFGRGDRGDRGGRGDRGRGDRRGGRRGAKRDEEEKWVPVTKLGRLVKDGKIKSLEQIYLFSLPIKEHQIVEFFLGSALKDEVMKIMPVQKQTRAGQRTRFKAFVVVGDNNGHVGLGVKCSKEVATAIRGAIILAKLSVIPVRRGYWGNKIGKPHTVPCKVTGKCGSVTVRLVPAPRGSGIVAARVPKKVLQFAGIEDVFTSSRGSTKTLGNFVKATFECLLKTYGFLTPDLWRETRFSKSPFQEFTDFLAKPHKISVVEDVEKTPVY

SEQ ID NO: 72289 - protein, 493 aa, Cucumis sativus
MGFQQTHETNQVLLSKIAISDGHGEDSPYFDGWKAYDNDPFHPENNPSGVIQMGLAENQLSPDLLVDWIKKHPKASICTDEGLLNFKDIANFQDYHGLPEFRNAIASFMGKARGGRVKFDPSRIVMGGGATGASEAVIFCLADPGDAFLIPSPYYAAFDRDLQWRTRAQIIPVHCNSSNNFQITREALEVAYKKAEESNIKVKGLIITNPSNPLGTIYDRDTLKSLVNFVNDNNIHLVCDEIYCATVFKSPSFISIAEIIEEMDHCKKELIHILSSLSKDMELPGFRVGILYSYNDTVVSIARKMSSFGLVSSQTQHLLAAMLSDDEFVDNFLVENSKRLAKRHARFTKELEKMGITCLNGNAGLFVWMDLRKLLKDQSFESEMELWRVIINEVKLNVSPGSSFRVTEPGWFRVCFANMDDNTVDVALGRIHSFVGKIDKKENNTIPMPPKKKPRENKLRLSFSFSGRRYEEGNVLKSPHMMSPHSPLVRAKT

SEQ ID NO: 72290 - protein, 407 aa, Physcomitrella patens subsp. patens
MCRGFASQEVNGYKLVYLDNAATSQKPASVLKALRDYYEGYNANVHRGIHALSAKATDEYELARKKVADFINAPSDREIVFTRNASEAINLVAYTWGLTNLKEGDEVVLSVAEHHSNIVPWQLVAQKTGAKLRFVELTPEETLDLEQLKGFLNERTKLVTTFHVSNVLGCVNPIADIVQWSHAVGAKVLVDACQSVPHMPVDVQGLGGDFLVASSHKMCGPTGMGFLWGTTEILESMPPFLGGGEMIVDVFLDRSTYASPPSRFEAGTPAIGEAIGLGAALDYLNKIGMDRVHKYEMELSKYLYDSLSKVPGVRIYGPPVGPNGENRASLCAFNVEGIHATDLSTFLDQQHGIAVRSGHHCTQPLHRHLGINASARASLYFYNTTDEVDTFIKGLQDTIDFFTAFNG

SEQ ID NO: 72291 - protein, 191 aa, Synechococcus elongatus PCC 6301
MTADNSVPSRLRNILVIAAALVLTILVVLGSRQPSAAASLASLAEQATPYEVAIANDRPMLLEFYADWCTSCQAMAGRIAALKQDYSDRLDFVMLNIDNDKWLPEVLDYNVDGIPQFVYLNGQGQPQGISIGELPRSVLAANLDALVEAQPLPYTNARGNLSEFSADLQPSRSSQTDPRSHSGQVQDGVLD

SEQ ID NO: 72292 - protein, 477 aa, Rhodococcus sp. RHA1
MTILAPATKSDASIDPRDPLARLEKLFDAGTVVPLHPRDKSGVLAASGNIDGVRTIAYCSDATVMGGAMGVEGCKHIVTAIDTALEEDAPIVGLWHSGGARLAEGVEALHAVGLVFEAMVRASGRVPQISVVLGFAAGGAAYGPALTDIVIMAPEARVFVTGPDVVRSVTGEQVDMVSLGGPDTHTKKSGVAHIAAHDEGDALHRARRLVSMFCEQGEFDQAAAAHGDTDLRALMPESAKRAYDVRPIVHELLDNVEGESSFEELQGNYARSIVTGLGRLGGRTVGVIANNPLRLGGCLNSESAEKSARFVRLCNAFGIPLVVVVDVPGYLPGVSMEWEGVVRRGAKLLHAFAEATVPRVTVVTRKIYGGAYIAMNSRALGATAVYAWPDAEVAVMGAKAAVGILHKRALAAAPEDEREALHERLAVEHESIAGGVDRAVAIGVVDEEIDPAKTRSVVTAALAAAPSSRGDHKNIPL

SEQ ID NO: 72293 - protein, 379 aa, Nicotiana tabacum
RPPAGQVIRCKAAVAWEAGKPLEIEEVEVAPPQKSEVRLKILFTSLCHTDVYFWEAKGQTPLFPRIFGHEAGGIVESVGEGVTDLKPGDHVLPVFTGECQQCRHCKSEESNMCDLLRINTDRGVMIHDGQTRFSKDGKPIYHFVGTSTFSEYTVVHSGCVAKIDPQAPLDKVCVLSCGISTGLGATLNVAKPTKGSTVAIFGLGAVGLAAAEGSRIAGASRVIGIDLNPSRFNDAKKFGVTEFVNPKDYDKPVQQVIAEMTDGGVDRSVECTGNVNAMISAFECVHDGWGVAVLVGVPNKAMRFKTHPMNLLNERTLKGTFFGNYKPKTDLPSVVGKYMNKELELEKFITHQVPFSEINKAFEYMLKGEGLRCMITMEH

SEQ ID NO: 72294 - protein, 513 aa, Chlamydomonas reinhardtii
MVLGRLFARSESAAPALADYNNEGNGSTIDTSVVAVEVEASGSPSSATVRGDSTLNEPLLEGFKDRGELPSLPESNASLSFPEESAPWWRKFFAFMGLGFLISVGYMDPGNWATDLAAGSSFGYTLLFVVLCSSLCAMFLQYLSLKLGIASDRDLAQACRDAYHPHVNKLLWVVAEAAIAATDLAEVVGCAIAFNLLLGIPLWAGVLITAADVIILLVAEARSFRFLEILVGALTALISACFIYELVKAQPDMGKVMRGYLPSKEIITNKDMLYLATGILGATVMPHNLYLHSSVIQTRAYPRTTAGRTIAIKLGLVDSTLSLLVAFVINSSILIVAAAAFHYATPPLEDIADITDAYELLASSLGSKAASILFGVALLAAGQNSTITGTLSGQIVMEGFLSFKMRPWLRRIITRGAAIVPAATVAAVMGREGVSQLLVLSQVILSLTLPFAVFPLVHFTSSRKYLGNFANRWYASVIAWLLFLFISALNVNLVVQSAISGSFGGLGHRRAAV

SEQ ID NO: 72295 - protein, 163 aa, Acidovorax sp. JS42
MKHIIAVLLENEPGALSRVVGLFSARGYNIESLTVAPTEDASLSRMTIQTHGSEDVIEQITKHLNRLIEVVKVVDLTEGAYTERELMMVKVRAVGKEREEMKRMADIFRGRIIDVTEKSYTIELTGDQSKNDAFLQAIDRTAILETVRTGASGIGRGERILRV

SEQ ID NO: 72296 - protein, 375 aa, Rhodococcus sp. RHA1
MKTKGAILWGLNEPWSVEEIEIGDPVAGEVQIRMEAAGMCHSDHHIVTGSMPMASFPVMGGHEGSGVITKLGPEVKDLEVGDHVVLSFVPACGRCPACSAGHQNLCDLGMGLLSGLAISDGTFRIHARGENVIPMCLLGTFSPYMVVHETSVVKIDKDIPFDVAALVGCGVPTGWGSATRMAEVKPGESVVIMGVGGVGMSALQGAVASGARQIFAIDPVPWKREQALKFGATHAFESAAAAIEPIIALTNGLMAQKTIITVGEMHGEYVEEALLLTSKFGTCVVTAMGAMTDMDVKLNLFLFSMLQKDLKGTIFGGGNARVEIPNLLAMYKSGQLNLDDMITRTYTLEGVNDGYQDMLDGKNIRGVIRYTEADW

SEQ ID NO: 72297 - protein, 635 aa, Nostoc punctiforme PCC 73102
MHLSEITHPNQLHGLSVRQLQQIARQIRDKHLQTVAVNGGHLGPGLGVVELTLGLYQTLDLDRDKVIWDVGHQAYPHKLLTGRYDRFHTLRQKDGVAGYLKLCENKFDHFGAGHASTSISAALGMALARDLKGEKFKAVAVIGDGALTGGMALEAINHAGHMPKTNLLVVLNDNDMSISRNVGAIPRYLNKMRLSQPVQFIKDNLEEQFKQIPFVGESLSPELGRIKEGMKRLAVPKVGAVFEELGFTYIGPVDGHNLEELITTFQQAHQIQGPVLVHVATVKGKGYEIAELDQVGYHAQSPFNVATGKAIPSNKPKPPAYAKVFSHTLVKLAEQNPKIVGITAAMATGTGLDKLQAKLPNQYVDVGIAEQHAITLAAGLATQGMRPVAAIYSTFLQRAYDQIIHDVCIQNLPVFFCLDRAGIVGSDGPTHQGMYDIAYLRCIPNIVIMAPKDEAELQRMVVTGVNHTSGPIAMRYPRGNGHGVPLMEEGWEPLEIGKSEILRTGDDVLIVAYGTMVYPGMQAAEILSEHGIEATVINARFVKPLDTELILPLAKKIGRVITLEEGCIMGGFGSAIAEALMDADILVPVKRFGVPDVLVDHAEPNESKTELGLTSHQIAERVLQAFFKQQVSAVV

SEQ ID NO: 72298 - protein, 391 aa, Synechococcus elongatus PCC 6301
MVRISGFCCAMSLAERQAALLVLADGSVFHGYACGAAGTVIGEVVFNTGMTGYQEVLTDPSYCGQIVSFTYPELGNTGVNPEDEESARPQVSGLIARNVARRHSNWRADRSLPDYLQQHNIVGIYGIDTRALTQHLRSTGAMNGGISTTILDPEELWAEVKAAPSMEGLNLVDQVTTDRPYEWQTPTSQTWEFIEGPTTESLTVVAIDFGVKRNILRRLASYGCRVIVVPADTPIEEILRHEPDGVFLSNGPGDPATVKNGISTAQALLQTGLPLFGICLGHQILGSALGAQTFKLKFGHRGLNHPCGLSQQVEITGQNHGFAIAADSLGPDVEVTHLNLNDRTVAGLRHRHLPVFSVQYHPEASPGPHDSDYLFEQFVALMRDRQPTPVA

SEQ ID NO: 72299 - protein, 518 aa, Pinus taeda
MDVNILTMFVTVSALALACSLWIASYLRNWRKKGVYPPVVGTMLNHAINFERLHDYHTDQAQRYKTFRVVYPTCSYVFTTDPVNVEHILKTNFANYDKGTFNYDIMKDLLGDGIFNVDGDKWRQQRKLASSEFASKVLKDFSSGVFCNNAAKLANILAQAAKLNLSVEMQDLFMRSSLDSICKVVFGIDINSLSSSKAESGPEASFAKAFDVANAMVFHRHMVGSFWKVQRFFNVGSEAILRDNIKMVDDFLYKVIHFRRQEMFSAEKENVRPDILSRYIIISDKETDGKVSDKYLRDVILNFMVAARDTTAIALSWFIYMLCKHQHVQEKLLEEIISSTSVHEDQYSTECNDIASFAQSLTDEALGKMHYLHASLSETLRLYPALPVDGKYVVNEDTLPDGFKVKKGDSVNFLPYAMGRMSYLWGDDAKEFKPERWIQDGIFHPKSPFKFPAFQAGPRTCLGKDFAYLQMKIVAAVLVRFFKFEAVKTKEVRYRTMLTLHMNEDGLNVQVTPRLNSD

SEQ ID NO: 72300 - protein, 348 aa, Salmonella enterica subsp. enterica serovar Paratyphi A str.
MTVRIAINGFGRIGRNVVRALYESGRRAEITVVAINELADAAGMAHLLKYDTSHGRFAWEVRHEREQLFVGDDVIRILHERTLADLPWRELGVDVVLDCTGVYGNQEHGEAHIAAGAKKVLFSHPGSNDLDATVVFGVNQNQLRAEHRIVSNASCTTNCIIPVIKLLDDAYGIESGTVTAIHSAMNDQQVIDAYHSDLRRTRAASQSIIPVDTKLAAGITRIFPQFNDRFEAIAVRVPTINVTAIDLSVTVKKPVKASEVNQLLQKAAQGAFHGIVDYTESPLVSIDFNHDPHSAIVDGTQTRVSGAHLIKTLVWCDNEWGFANRMLDTTLAMAAVDFRLDASASTKL

SEQ ID NO: 72301 - protein, 370 aa, Triticum aestivum
MVDLQAAALVITVVAAEGFPNFDGPDFVKEAAIEAIKAGKNQYARGYGVPELNSAVAERFLKDSGLQIDPDKEVTVTSGCTEAIAATILGLINPGDEVILFAPFYDSYEATLSMAGANVKAITLRPPDFAVPLEELKAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFVMVDHTPFGFDNDIEFCEYLIREVGVVAIPPSVFYLNPEDGKNLVRFTFCKDDDTLRAAVDRMKAKLRKK

SEQ ID NO: 72302 - protein, 97 aa, Brassica napus
KKIKELQDSYTAVTFTPLGVKGRMLMEKCKTLQEENEEIGRQAAEGKIHELAMKLSVQKSQNAELRKQFEGLFKHMEGLINDAERSNETVIILQDKL

SEQ ID NO: 72303 - protein, 488 aa, Prochlorococcus marinus str. MIT 9303
MAGRLNQQNQRVRPNSNEDQVVQQVKEHFERTLIEVGGTVAGSVAALEHQPHNKALNYGEVFLRDNVPVMIYLLTQKRYKEVKQFLSVCLDLQSTTYQTRGVFPTSFVEEQGELIADYGQRSIGRITSVDASLWWPILCWLYVKRSGDKNFGTNQKVQRGVQLMLDLVLHPTFEGTPVLFVQDCSFMIDRPMDVWGAPLEVEVLLYACLRSCIELMELSRKNHVSRLLDQRLLLTRQWVHDLRQFLLKHYWVTSKTMQVLRRRPTEQYGDNQHQNEFNVQPQVVPDWLQDWLENRGGYLIGNIRTGRPDFRFYSLGNSLACLFGLLTAPQQRALFRLVLHNRQHLMAQMPMRICHPPMEGAEWQNKTGSDPKNWPWSYHNGGHWPSLLWFFGASILLHERRHPEADVLLMGEMRALLEECYWSQLNQLPRQKWAEYFDGPTGTWVGQQSRTYQTWTMVGFLLLHHLLRVCPDDVLWLDLDELLPTHEV

SEQ ID NO: 72304 - protein, 363 aa, Isatis tinctoria
MGSTVDPPTPVQITDEETSLFAMKLASSSVLPMALQSALELDLLEIMAKNASQMSPAEIGSHLPTKNPEAPVMLDRILRLLSAYSILTCSIRKVPGGDTIERLYGLGPVCKYLTKNVDGVSIAALCLMNQDKVFIESWYHLKDAILVGGSAFNKAYGMSVLEYQRTDTRFNKVVNNGMSNHSTIAMKKILETYKGFDGLISVVDVGGGNGATLKMIVSKYPNLKGINFDLPHVIKDAPSYPGIEHVGGDMFVSVPKGDAMIMKWICHARSDKQCLKFLKNCYDALPENGKVIVAECILPENLDSSLLTKQALHVDCIMLAHSGGGKERTAKELEALAKGSGFHGIKVVCNAFGIHFIEMLKKF

SEQ ID NO: 72305 - protein, 501 aa, Ralstonia eutropha JMP134
MLAQIAAMYRYFMSVVPFRLTPAIISTVVLVTLLLLPAPEGLKPEAWHLVAIFLTTIVAIILKVMPIGVMAMMAIVIVSLAQVTSNSSKGAIADALSSFDNPLIWLIVVAILISRGLKKTGLGSRIGLIFISLLGKRTVGIGYGLAICELVLAPFTPSNTARGGGIVHPIMKSIAGAFDSDPAKDTQGKVGTYLALVNYHANPITSAMFVTATAPNPLVVDYVAKASGGALNLSWTTWALCMLVPGLLCLLVMPLIIYVLQPPELKATPNAIDYARGELERMGPLSGQERVMMGVFAVMLVLWANLPAMIFGPGLTLDPTVVAFLGLFALIITGTIDWDDVLSEKSAWDTLIWFGALVMLAEQLNKLGVITWFAADMRDAIEASGMGWLATAAVLVLAFVFSHYLFASTTAHISAMMLAFLTVGVHLIPQPYVPVFMLMMTAGSAIMMTLTHYATGTSPIIFGSGYVTLGQWWRVGAVMCVFELIVFAVVGGIWWKILGFW

SEQ ID NO: 72306 - protein, 291 aa, Musa balbisiana
MTDHVKWTSVESKTSTNAAPISSSSSSRSPSMASSSGAGTAVEHKRARDIRKHPVYRGVRMRAWGKWVSEIREPRKKSRIWLGTFATPEMAARAHDAAVLSVKGAPAAAAVLNFPELAGSLPRPASLSPRDVREAAARAAAMDMPRANAAALVVEDDELEEIVELPRLGQDLFGSAHLAGEFVFHDSISTASGALSFGASSKCPSCLLLHVLLLPSTAQLTRKERRNSVLLLARNRCKSISCLSPKRLSSRRNSWCSSRGTNSREQTAAIIPRLAFCSSLEDPTIIADAFH

SEQ ID NO: 72307 - protein, 706 aa, Oryza sativa Japonica Group
MEAQADAGGDDLAAMREQCRSLEEAIGFRRETQMGLVASLQRLVPDLVPSLDRSLRIIAAFNDRPFVPTPNPDGGHGKSPAALKPHHRRALPDPARSTRRKTSPGSSPASVAAAPGGLDAVRTMVAVCLLELVPFAEIDAAALARRLQAESSSASEAERTALADLAAELGGSAASAVVLALRRIAEDTGGVQIEEAMIGGKSMTMVWAIDRNKLLKELPESATLPLLQPPPAPQMPPSETDAGSAMIPRTPQQQQPQPDMWPHSMPPIFPRPRGMTMQGMQRVPGVPPGLMPLQRPFMGPAGVITMGGGVGPSPNQQKQKSEEDELKDLELLLNKKTYREKQNTKTGEELLDLIHRPTAKETAVAAKFKTKGGSQLKEYCTNLTKEDCRRQSGSFVACDKVHFRRIIAPHTDTNLGDCSFLDTCRHTKTCKYVHYELDQTPDIPPMMAGALAPPRQIRLQRAEYCSEVELGEAQWINCDIRNFRMDILGQFGVIMADPPWDIHMELPYGTMADDEMRTLNVPALQTDGLIFLWVTGRAMELGRECLELWGYKRVEEIIWVKTNQLQRIIRTGRTGHWLNHSKEHCLVGIKGNPLVNRNIDTDVIVAEVRETSRKPDEMYPMLERISPRTRKLELFARMHNAHAGWLSLGNQLNGVRLVDEGLRARYKAAYPDSEVQPPSPPRASAPIDGDQGTSQKPTVSDGERPA

SEQ ID NO: 72308 - protein, 174 aa, Physcomitrella patens subsp. patens
MADTKIIKEENPELFRNPGKGWVDHVHQQNLKKGIERLDRRSEHPNKGAVKKHGHGGKFTVDGPYREEDYANPVPVAMDKNDPNYVDPEEEEADNDAGVPVSDTAKDADTSAGAAHPAIHRSSVFKIAIRCYRTEFIWQLEGIACSHRDLDFCSCSSKVEPPVRDSTAIPLLPR

SEQ ID NO: 72309 - protein, 293 aa, Listeria monocytogenes EGD-e
MQDLTLFLEQYKKVIDESLFKEINERNIEPRLKESMLYSIQAGGKRIRPMLVFATLQALKVNPLLGVKTATALEMIHTYSLIHDDLPAMDNDDYRRGKWTNHKVFGDATAILAGDALLTLAFSILAEDDNLSFETRIALINQISFSSGAEGMVGGQLADLEAENKQVTLEELSSIHARKTGELLIYAVTSAAKIAEADPEQTKRLRIFAENIGIGFQISDDILDVIGDETKMGKKTGADAFLNKSTYPGLLTLDGAKRALNEHVTIAKSALSGHDFDDEILLKLADLIALREN

SEQ ID NO: 72310 - protein, 408 aa, Musa balbisiana
MWPLLLCSIVVIVLAVTSSNMSIISSFQTMFLIFPTVPSANRTGPAFVESQLASAAPPPVGSRIPRLAYLISGSKGDLDRLWRTLRALYHPRNIYVVHLDLESPASERLELALRVANDTVLSTVGNVHVVEKANMVTYRGPTMVASTLHACAILLKESKEWDWFINLSASDYPLVTQDDILHVFSSLPRNISFVEHTSRLGWKEGQRAKPLMVDPGLYMTRKTDVFWVSQKREVPTAFKLFTGSAWVALTREFAEFCVWGWDNLPRILLMYYTNFVSSPEGYFQTVICNAPEFSVTVANHDLHYISWDVPPKQHPHTLSMDDLPKMIGSNAPFARKFKRDDPVLDQIDAELLGRAKGSFVPGGWCAGAPLCTEIGDPTRLQPGPGAERLAALMDVIVRSKKFTQNQCR

SEQ ID NO: 72311 - protein, 609 aa, Listeria monocytogenes EGD-e
MSCFYLDLLKIKDPSFMKRLDIQELEALAADIRAFLITSTSKSGGHIGPNLGVVELTIALHYSFNSPKDKFIWDVGHQSYVHKILTGRANQFGTLREHGGLDGFPKRKESIHDVFETGHSSTSLSAAAGMVIARDIKKEDFYVIPIIGDGALTGGMALEALNHIGDMGKDMIVILNDNDMSIAPNVGAIHNILGKLRTSDTSKQTKTNVDGAFFEELGFMYLGPIDGHDIEEVITNLELAKRAKGPVLLHIVTKKGKGYQPAELDSRGTWHGTGPYKVETGSFIKPAKRAASWSSVISNELIRLAEMDERIVAITPAMPVGSKLEKFAKAFPERFFDVGIAEQHATTMAAGLATQGMKPFLAIYSTFLQRAYDQLVHDVCRQKLNVVIGIDRAGLVGADGETHQGIFDISFLNSIPNMTISMPKDEVEARQLMDTAFSYNDGPFAIRYPRGEAPGVQVVESNTLIPIGQWETIIQPLDAVILTFGPTIELALKAAEQLEIEGYRVGVINARYIKPLDEALLHKILKQKIPILTVEESLLKGGFGASVLEFIEANNYRDVIMHRIGLPDEFISHGSVSIILESFGISTTGLVLKIKEMLAQSGKLRAKRL

SEQ ID NO: 72312 - protein, 352 aa, Desulfitobacterium hafniense Y51
MAKIAVYGAGSWGTALAVSMGKAGHEVALVGRNLSEMDLMEQRRENRPYLPGVVLPPTVRPTGDAGVLEEAEMLVLSVPSHSVRETAQKIRAYLQPGTIVVNTAKGLEEGSHKRLSQVLTEELPHHPIVVLSGPSHAEEVGKDMPTTVVVASQNSQAAEAVQDMLMTPKFRVYTNPDTIGVELGGAFKNIIALCAGFADGLGFGDNTKAALMTRGIAEITRLGAAMGGNPLTFAGLAGVGDLIVTCTSRHSRNHRAGVALGEGKPLEQVLKEVGMVVEGVRTTRVAYELSRQYEISMPITEQAYQVLFQGADPRAAVSALMMRGKKHEIEEVALIAMEQGSYQENGPDDHGE

SEQ ID NO: 72313 - protein, 121 aa, Musa balbisiana
MEEFDEADVLWPDDARGADELAEQRHARRGSRQKASNPVEIPSRPRAAAHRTIREGRDDANSSSGDGDDDGSGDHRVPPHIIVARRKTNFSVCVGDGRTLKGRELCHVRNSILRMTGFLER

SEQ ID NO: 72314 - protein, 281 aa, Oryza sativa Japonica Group
MSAAAAAAASSPAPRLESKVALVTGGASGIGEAIVRLFREHGAKVCIADIQDEAGQKLRDSLGGDQDVLFVHCDVSVEEDVARAVDATAEKFGTLDIMVNNAGFTGQKITDIRNIDFSEVRKVIDINLVGVFHGMKHAARIMIPNKKGSIISLGSVSSVIGGLGPHSYTATKHAVVGLTKNVAGELGKHGIRVNCVSPYAVPTALSMPYLPQGERKDDALKDFFAFVGGEANLKGVDLLPKDVAQAVLYLASDEARYISALNLMVDGGFTSVNHNLRAFED

SEQ ID NO: 72315 - protein, 453 aa, Musa balbisiana
MESKSTGRFTLGKQSSLAPDRGCSDDSSYGDGFRFPDDVDANIRLMYLTSEGDLEGIEEILASGVDVNFRDIDGRTALHVAACQGFADVVRLLLDRGAQPLADAIHYNNHEVIDLLEKHGAKLSIIPMHVKNAREVPEYEIDPSELDFTHSVNITKGTFRLATWRGIRVAVKKYGEDVLVDENKLWVGRAFRDELALLQQIRHPNVVQFLGAVTQSSPMMIVTEYLPKGDLRAYLKHKGALKPSSAVRFALDIARGMNYLHEHKPEAIIHRDLEPSNILRDDSGNLKVADFGVSKLLKVAKTVREERSLTHLGTACRYVAPEVFCNEEYDTKVDVFSFALILQEMIEGCPPFCYKQDNEVPKAFVSKQRPPFGAPPKLYVHGLKELIEECWSENPADRPTFKDIIDRLLNIQNYIDRKRHWRVSFLNFYLMMHFFSFWSSYYLAHKKQLLFSL

SEQ ID NO: 72316 - protein, 151 aa, Oryza sativa Indica Group
MATAARRLLLPALRKSLPAANGAARGVSTERAVGAAAVVGSHTAKWMQVSLGALIDGHSHVFVSASYLKTMFRFERCIACTSDTSKKSPMELINAVPPIKVEGRIAACDGRQDKGRETGSLGHPIEYICLDLDQPAVCKYCGLRFVQDHHH

SEQ ID NO: 72317 - protein, 303 aa, Physcomitrella patens subsp. patens
MVLFLGTTVHAELQYGYYDSLGCAGVEDRVRTLVQRSFVADATASAAMLRLAFHDCQVGPGGCDASIMIDEDAGEMASGNNFGIKRLDIINSVKADMEDNCPNTVSCADIIAMAGRDAVAFNGGPDIQIPLGRKDADSSNAGEADSKLPPATSSIDRVFNVFGPFGMTPEEIVAILGAHSIGVGHCKNIQDRLQSNSPTAPNSLVFRTQLMAACAVNVFDIAVVNNDATQFTFDNQYFQDIQNGRGLFTVDHLLSTDPRTAPIVNTYASNEGAFFASFASAYVKLTSRAVTGNRGSVRSTCQL

SEQ ID NO: 72318 - protein, 519 aa, Synechococcus elongatus PCC 6301
MSDYSDRSDFSERQDRSSDDRPNFRRFDRDRPSEGRRLEGRSEGGYRGRDDRGGSGGYRQNRDDRGGFRGRDDRGGYRGGDRDRPSEGRRFEGRSEGGYRGRDDRGGSGGYRQNRDDRGGFRGRDDRGGYRGGDRDRPSEGRRFEGRSEGGFRGRDDRGGSGGYRGRDDRGGFRGRDDRGGFRGRDDRGSSGSYRGRDDRGGFRGRDDRRDDRDNFRPSRDRELNREVNTSPAGDQEATDHELIYGRHAVLAALQGNRTLNRIWVTPRLRYESTFLELIDAAKAGGAVVDEVPVERIRQLTDGAVHQGIAAQVAPYPYQELSDLIAQAKAATTDPVIVVADGITDPHNLGAIIRTAGALGAHGLVIPQRRAVGVTAAVAKVAAGALESFPVARVVNLNPALEELKDAGFWIYGAAGEAKQSIHETSFSGPVVLVVGSEDEGLSLLTRERCDHLISIPLRGKTNSLNASVAAGMVLYEVSRQRQQLTHHLEGIADNGATALTTAAVEFAGAAAGLGELGL

SEQ ID NO: 72319 - protein, 587 aa, Chromobacterium violaceum ATCC 12472
MSIILHGVAIGGGIAIGRAHLISRSMDDVAHYLLEDDEIPAEKTRFDEAVKATRKELEMLWGSIPENAPAELGAFLSLHIMLLGDVTISREPREIIEKQRCNAEWALKLQCDHLVEQFDAIEEDYLRERKNDVLQVIERIFTNLDGDSPQLPAPEDLVEDHILVAHDLSPADMVYFKDSNFAAFVTDVGGATSHTAILGRSLDLPSVIALHHARELIREDEMIIVDGEQGVVIINPDALVLAEYRRRLRAWRGARRKLSSIRKSNAVTRDGTVIELLANIERPQDVEEVRESGVVGIGLFRSEFLFLGRDTLPTEDEQYEAYRHVATAMKGMPVTIRTMDLGADKSPKWLNHCQAENPALGLTGIRLCLAEPLMFRAQLRALLRAQLRALLRASVHGRIRVLFPMLNSLPELRQAIAQFEYAKEELRDEGIGYADDVEVGAMIEIPSAALVAGSLAKHVDFLSIGTNDLIQYTLAIDRNDDTVSHLYDPIHPAVLKLILHTIKTGTKANLPVSVCGEMAGDARLTRLLLGMGLRKFSMHPANLLSVKQRVLTSHLDEIAPIATRMLRSEDPDKIADLLQMLNAEPGT

SEQ ID NO: 72320 - protein, 323 aa, Chromobacterium violaceum ATCC 12472
MTKILVTGAAGFIGRAVCEKLLERRDVQVVGIDNLNDYYAVELKHARLATLQGRSNFSFHRQDIADWPAMERLFSAEKFDYVIHLAAQAGVRYSLQNPHAYAESNLLGFTNVLEACRRHPVKHLVFAGSSSVYGSGSAVPFSEDQRADHPVSFYAATKRANELMAASYSHLYRLPTTSLRFFTVYGPWGRPDMAPWLFTDAILNGRPIKVFNHGKMQRDFTYIDDIVEGVVRVMEHVPSGELPHTIFNIGNHQPVELMTFIQLTEKYCGREAIKEYLPMQDGDVPITYAETSRLRDAVGFTPSTSLEVGMARFVEWFRNYHAV

SEQ ID NO: 72321 - protein, 405 aa, Klebsiella pneumoniae subsp. pneumoniae MGH 78578
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLQEIVEIARQHNLIIFADEIYDKILYDEAQHHSIAALAPDLLTVTFNGLSKTYRVAGFRQGWMVLNGPKKHAKGYIEGLEMLASMRLCANVPAQHAIQTALGGYQSISEFIIPGGRLYEQRNRAWELINDIPGVSCVKPKGALYMFPKIDAKRFNIHDDQKMVLDFLLQEKVLLVQGTAFNWPWPDHVRIVTLPREDDLEMAISRFGRFLSGYHQL

SEQ ID NO: 72322 - protein, 331 aa, Synechococcus elongatus PCC 6301
MIRSATLPFASALPSLPDNHRLRLFSGSSNSALSQEVSRYLGIDLGPMIRKRFADGELYVQIQESIRGCDVYLMQPTCWPVNDHLMELLIMIDACRRASARQITAVLPYYGYARADRKTAGRESITAKLVANLITQAGANRVLAMDLHSAQIQGYFDIPFDHVYGSPVLIDYLRSKNLADLVVVSPDVGGVARARAFAKKLDDAPLAIIDKRRQAHNVAEVLNVIGDVQGKTAVLVDDMIDTAGTICEGARLLRKQGASQVYACATHAVFSPPAIERLSASGLFEEVIVTNTIPIPEENRFPQLTILSVANLLGETIWRIHEESSVSSTFR

SEQ ID NO: 72323 - protein, 510 aa, Oryza sativa Indica Group
MAIALRFAAAPLRLRLVSPAPPAIGGAGDGGRRGGGGAERIGVLGRARCRRRRGGGGRLEVAAAAADDSARCRAKGVGAAAAAAETLGGIGVGGGDQLSVVMKFGGSSVSSAARMREVAGLILAFPEERPVVVLSAMGKTTNLLLLAGEKAVGCGVIRVSEIEEWNLIKDLHIKTVEELALPRSVIHTMLDELEQLLKGIAMMKELTLRTTDYLVSFGECMSTRIFAAYLNKIGVKARQYDTFDIGFITTDDFGNADILEATYPAVAKRLHGDWIRDPAIPIVTGFLGKGWKSGAVTTLGRGGSDLTATTIGKALGLREIQVWKDVDGVLTCDPNIYPNATTVPYLTFEEAAELAYFGAQVLHPQSMRPAREGDIPVRVKNSYNPKAPGTLITKQREMDKVVLTSIVLKSNVTMLDIVSTRMLGQFGFLAKELDHVVEELEKIAVVHLLQQRAIISLIGNVRRSSLILEKVNMSLIVHDSEAKQCIKALHQAFFEDDVLTEVEEEALHMS

SEQ ID NO: 72324 - protein, 892 aa, Cardamine flexuosa
MKIITEGRFHVSLLYLLLLLLVSASHLISAADYIPTDKILLNCGASSNSSDADKRAWSADNINKFLSSGDSKTSPAATQDPSVSEIPYMTARVSRSPFTYSFPVATGRKFVRLYFYPNTYDGLNATDALFSVSFGPYTLLKNFSAAQTAEALTYAVIVKEFIVNVEGGSLNMTFTPESNAYAFVNGIEVTSMPDIYSSTDGTLTMVGSSGAFTIDNSTALENVFRLNVGGNDISPSADTGLYRSWYDDEPYVFGAAIGIPYTADANMTIKYPADTPTYVAPEDVYSTARTMGPNATININYNLTWVFSIDSGFSYLVRLHFCEVASNNTKINQRVFTIYLNNQTAEPEADVIGWVGGNGIAFHKDYVVNPPDGKGQQDLWLALTPNPRNKPQLYDSILNGVEIFKMNTSEGNLAGPNPIPGPKVTADPSKVVPARTGKSGNHTAIVAGAASGAVVLALIIGLCVLVTYRRRNRVNYQPASDATSGWLPLSLYGNTHSAGSGKTNTTGSYASSLPANLCRHFSFAEIKVATKNFDESRVLGVGGFGKVYRGEIDGGTTKVAIKRGNPMSEQGVHEFQTEIEMLSKLRHRHLVSLIGYCEENCEMILVYDYMAYGTMREHLYKTQNSPLAWKQRLEICIGAARGLHYLHTGAKHTIIHRDVKTTNILLDDKWVAKVSDFGLSKTGPTVDHTHVSTVVKGSFGYLDPEYFRRQQLTEKSDVYSFGVVLFEALCARPALNPTLAKEQVSLAEWAPYCYKKGMLDQIVDPYLKGKITPECFKKFSETAMKCVLDQGIERPSMGDVLWNLEFALQLQESAEENGKGVGGDVDMDEIKYDDGNCKGKNDMSSDVYEGNVTDSRSSGIDMSIGGRSLASEDSEGLTPSAVFSQIMNPKGR

SEQ ID NO: 72325 - protein, 142 aa, Lactobacillus johnsonii NCC 533
MFDKKEALKKLNSEQYEVTQHAATEMPFSGKYNDFNQKGIYVDVVSGEPLFSSQDKYDAGCGWPSFTKPIKKLSYKRDQSHGMERTEVKSPIADSHLGHVFTDGPVDQGGLRYCINSASLKFIPYDKLEEEGYNQYKKIFEE

SEQ ID NO: 72326 - protein, 362 aa, Vibrio cholerae
FTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTTTFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGYDGI

SEQ ID NO: 72327 - protein, 328 aa, Bacillus cereus G9241
MKAIIVTSFGGPEVMQYTDVDIPAISKDQVLIRVVATSVNFADIKSRYGKKGNKALPFIPGIDVAGIVECVGSHVKNIHPGQRVIAFPQNGSYAEYVVANENLTFVLPDEVDFQTAAACPIVSFTSYNLLANVARLQQGESVLIHAAAGGIGTTAIQLAKLLGAGKVIGTVGSEGKKEIALDAGADYVFCHQDEDFVEKVNELTYGEGVNIILDSISGSVSERSLKCLAYYGRLVHFGNASGEIGNFHTKDLHASCRSILGFSFGTTRKKRPELLQETANEVFRYLRDGRLQIKATKSFPLQDAGKAHEWVESRKSTGKVILTVQSSS

SEQ ID NO: 72328 - protein, 274 aa, Rhodopseudomonas palustris CGA009
MDSIKTQGLNVPKLGLGTFKLQGKDCHEAVLTALSLGYRHIDTAEMYANEDFVGDALEDTDVPRDQIHLTTKVWWTNLAPDAIRKAFDQSLRKLKTDYVDFYLIHWPAPDMNLGAALETLLRIKDQGGARAIGVCNFPVALMKQAVEEIGAPIACNQVEHHVLLGQTKLLPYLQSKGIPLTAYAPLAQGRLASYPELQAIADKHGATAAQVALAWLLEQEGVMAIPKARGEASQRSNLGALKIKLDFDDRAVIAKLPKNQRFVTPAFSPKWDAE

SEQ ID NO: 72329 - protein, 124 aa, Zea mays
  misc_feature (84)..(84): Xaa can be any naturally occurring amino acid
MHPKPVPQKEPLSAALSALTLVVQFNGWLSFFLLLYYKLPLRPETHKTYYEYTGLWHIYGLLAMNSWFWSAIYHSCDTIWTEKXLYFSSDAAFLGYSLILTIVGEHVVASFMGSGRLTDLCVFH

SEQ ID NO: 72330 - protein, 271 aa, Glycine max
MASLIESGWQYLITHFSDFQLACLGSFFLHEGVFFLSGLPFIWLERAGWMSKYKIQAKNNTPAAQEKCIVRLLLYHFGVNLPVMVFSYPVFRYMGMRSSFPLPSWKVVLIQIIFYFILEDFIFYWGHRILHTKWLYKHVHSVHHEYATPFGLTSEYAHPAEILFLGFATIFGPAITGPHLITLWLWMVLRVLETVEAHCGYHFPWSLSNFLPLYGGADFHDYHHRLLYTKSGNYSSTFTYMDRIFGTDIGYRKLKALKSIGVEDNSEQKKQ

SEQ ID NO: 72331 - protein, 199 aa, Coccidioides immitis RS
MADHEHDDDLNPTKTEGFKVGEKKTVEEYQKLDANDESLNRWKASLGLGSGTAISDPNDPRKCIIKSLALEVEGRPDITVDLSAPGSVEKLKDKPFTIKEGCKFRMKATFVVQHEVLSGLKYVQVVKRKGVRVSKDQEMLGSYAPNTTDKPVYEKKFNEEQAPSGMLARGHYTALSRFVDDDDTTHLQFEWSFDFAKDW

SEQ ID NO: 72332 - protein, 296 aa, Escherichia coli
MSYYHHHHHHLESTSLYKKAGLANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 72333 - protein, 480 aa, Yersinia pestis CO92
MSRRLRRTKIVTTLGPATDRDNNLEKIIAAGANVVRLNFSHGSAEDHELRANKVREIAARLGRHVAILGDLQGPKIRVSTFKEGKVFLNINDKFLLDANMAKGEGDKNKVGIDYKGLPADVVPGDILLLDDGRVQLKVVEVQGMKVFTEVTVGGPLSNNKGINKLGGGLSAEALTEKDKADIVTAAKIGVDFLAVSFPRTGEDLHYARRLARDAGCNAQIVAKVERAEAVATDEAMDDIILASDVVMVARGDLGVEIGDPELVGIQKKLIRRARQLNRAVITATQMMESMITNPMPTRAEVMDVANAVLDGTDAVMLSAETAAGQYPAETVAAMARVCLGAEKIPSINVSKHRLDVQFDNVEEAIAMSTMYAANHLKGITAIIAMTESGRTALMMSRISSGLPIFAMSRHDHTLNLTAIYRGVTPVYCDPHTDGVLAATEAVKRLQDKGFLVSGDLVIVTQGDVMGTIGTTNTSRIIRVE

SEQ ID NO: 72334 - protein, 499 aa, Yarrowia lipolytica CLIB122
MSAPLNRLTIAKEVKKGSDLTPEQKFWKTYRSPLLVKEYNAISHVSFNHHNDFAVTSSTRIQIFSGKTRKVTKTISRFKDTVYCGEFRSDGKLIVAGDATGLVQIFDAVSRNILVTLQASQLATHVTKFHPTNLTTLLTASDDRSVKLYDITSSTPLIEFEGAQDYVRCGEFVDANVVAAGSYDGTVRLYDARSGKTPISSLAQDHPVEDVLYHNGMVLSAGGPIVKAWDMTTGKTIRQMGNFSKTVTCLAPTHGASGFFAGSLDGHVKVFDDTSFKVTYGWKYGSGVLCTGMSLDSQHIVAGLVSGIVAVRTQQPKKDEKISNGRVLDQKAAVEEEKKKKAEGPVLGGTKYEGQFEHVIVEEHERPNKKLLKRYENLLLGFRWGDALDAALSGEHLETSVLALEELKKRGKVRAALLNRDEDSLEPLFEFATKAIADSRYINIVADYVAVVLDMYTSVITKSPILEERVSEFYDALKSEVETAKESKKIQGMLELLSV

SEQ ID NO: 72335 - protein, 168 aa, Glycine max
  misc_feature (27)..(27): Xaa can be any naturally occurring amino acid
  misc_feature (29)..(29): Xaa can be any naturally occurring amino acid
MMSDYKVEMINDGMQEFYVHFHGPNEXLXHGGVWKVRVELPDAYPYKSPSIGFINKIYHPNVDEMSGSVCLDVINQTWSPMFDLVNVFEVFLPQLLLYPNPSDPLNGEAAALMMRDRATYEQRVKEYCEKYAKPEDIGAATEENSSDEELTEDEYDSSDEQVAGKADP

SEQ ID NO: 72336 - protein, 154 aa, Methanopyrus kandleri AV19
MAEVQREFVMIKPDGVVRGLVGEVIRRLERKGLKIVALEMRQLDRETAEKLYEEHRDKPFFEDLIEYVTSGPVVVMIVEGRKAVKVVRNIIGATDPAEAAPGTVRGDFALDIGRNVVHASDSPESAEREIEIVFGKDLSTIDYERCDEEWLYES

SEQ ID NO: 72337 - protein, 336 aa, Coccidioides immitis RS
MAGITIPTTQAAIQISRTGGPEVLEYHTSLPVPTPGPGEVLIKNNLSGVNYIDTYFRTGLYQSPKPEILGREGAGIIVALGSGPNPQGFKVGDRVAWLNTGGYAEYSVAQAEKRVVRIPEGISDEQALSVLLSGITTLSLVKEAYPVQKGDWILVHAAAGGAGFLMTQMLKDIGAKVIGTAGGPEKAELVKSLGADVVIDYKSPEGANWLGKVMEVTGGEGVAAVYDSVGKDTWEDSIKAVKRKGTMVFFGNASGPVPPLNIQLLSAKNIKVLRTSLFGYIATQEEFDYYTNELFNMVKSGKLKTRLHKIYPLEQAAQAHIDLEGRKTTGKLLLRP

SEQ ID NO: 72338 - protein, 475 aa, Listeria monocytogenes EGD-e
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHVLSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANYIAGKAAEKLDYDLVPRCIYTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 72339 - protein, 416 aa, Listeria monocytogenes EGD-e
MAVEKITMPKLGESVTEGTISSWLVKPGDTVEKYDAIAEVLTDKVTAEIPSSFSGTIKEILAEEDETLEVGEVICTIETEEASSSEPVVEAEQTEPKTPEKQETKQVKLAEAPASGRFSPAVLRIAGENNIDLSTVEGTGKGGRITRKDLLQVIENGPVAPKREEVKSAPQEKEATPNPVRSAAGDREIPINGVRKAIAKHMSVSKQEIPHAWMMVEVDATGLVRYRNTVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKAKVEKISKENTALY

SEQ ID NO: 72340 - protein, 472 aa, Listeria monocytogenes EGD-e
MAKQEIGVIGMGVMGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKEERVYASTVLTGPSNYRFEGDKKAFVESVRRALYFSKIASYAQGFAQMRAASEEYNWDLQYGEIAKIFRAGCIIRARFLQKITDAYNQDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 72341 - protein, 271 aa, Burkholderia thailandensis E264
MAITLKNEHDIAQMRIACRLASEVLDYITPFVVAGVTTGELDRLCHEYMINVQGTVPAPLNYQPPGYPPFPKAICTSVNDVICHGIPGDKTLKNGDALNIDITVIKNGYFGDTSRMFLIGEGSILAKRLVQTTYECMWLGIDQVKPGAHLGDIGHAIQKHAEAQGYSVVREYCGHGIGTVFHEDPQVVHYGRPGTGIELKPGMIFTIEPMINAGKRDIRTMPDQWTVKTRDRSLSAQWEHTILVTETGHEVLTVSAGTPARPTFAAPATAA

SEQ ID NO: 72342 - protein, 275 aa, Zea mays
  misc_feature (237)..(237): Xaa can be any naturally occurring amino acid
  misc_feature (266)..(266): Xaa can be any naturally occurring amino acid
YFMKYVNMSDERKSSTSVESHDLKKGKRHSEEDSVVAKRNRQVMEDEALARTSQESFAEESTSVTEVVSSLDSAGSSERNKERTHSVGPLKDVLPLTFRLMRVQGLPSWTNTSTVTIPDVIQGEVLLAVLSNYMVDMDWLLTACPSLRKVPHVLVLHGEDGASLERLKKTKPANWILHKPPLPISFGTHHSKAMLLVYPQGIRVVVHTANLIHVDWNNKSQGLWTQDFPWKKANDTXQNIGFENDLVDYLRALKWPEFRVISQFAXDVNINAAFF

SEQ ID NO: 72343 - protein, 394 aa, Lactobacillus johnsonii NCC 533
MPKLSNDLSLTKNTRLNSLGPSKIRAFDEKASQIPGIIKLTIGEPDLNTPDHVKDAAIADIKANDSHYAPQAGKPELLEAISNYLDRSLDVKYDPKTEICVTVGATGALNDVFMSILNPGDKILVPTPVWALYFQLIKLTGAIPVQIDTSKDDFILTPEHLETVLQNEGKGAKAIILTDPSNPTGRVYPAATLKALAEVITKYHLFSVTDEIYGELVYDNNVHHSLSQYIPERNILISGLSKAYAMTGWRLGYIAAPADIMKTIQKVNAFLVTSVTDNVQAAAIEALNNGQADPLEARKIYEDRLEFMKTGLEKLGFEMSTPQGAFYIFAKIPDTFGTDDEAFANELATKAKVGVTPGRYFGKGGQGYVRMSYASSTEQLQEALKRIAKFVENI

SEQ ID NO: 72344 - protein, 710 aa, Klebsiella pneumoniae subsp. pneumoniae MGH 78578
MLIPTGTSVGLTSVSLGVIRAMERKGVRLSVFKPIAQPRSGGDAPDQTTTIVRASSSTTTAAEPLKMSHVESLLSSNQKDVLMEEIIANYHANTQDAEVVLVEGLVPTRKHQFAQALNFEIAKTLNAEIVFVMSQGTDTPEQLNERIELTRNSFGGAKNTSITGVIVNKLNAPVDDQGRTRPDLSEIFDDSSKAKIVKIDPAQLQKGSTLPVLGAVPWSFDLIATRAIDMAHHLNATIINEGDINTRRVKSVTFCARSIPHMLEHFRPGSLLVTSADRPDVLVAACLAAMNGVEIGAILLTGGYEMDARISKLCERAFATGLPVFMVNTNTWQTSLSLQSFNLEVPVDDHERIEKVQEYVANYINADWIESLTATSERSRRLSPPAFRYQLTELARKAGKRVVLPEGDEPRTVKAAAICAERGIATCVLLGNPDEINRVAAAQGVELGAGIEIVDPEVVRESYVGRLVELRKNKGMTEAVAREQLEDNVVLGTLMLEQDEVDGLVSGAVHTTANTIRPPLQLIKTAPGSSLVSSVFFMLLPEQVYVYGDCAINPDPTADQLAEIAIQSAESAIAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQK

SEQ ID NO: 72345 - protein, 418 aa, Geobacter sulfurreducens PCA
MATDITMPKLSDTMTEGRLVAWKKGVGDRVERGDIIAEVETDKATMELEAFASGVLAEQRVKPGELVNVGTVIGVIGGADEVKPTEKAAAAPPELADWQPPPEAPANGAEPEIPERVLELPEASAPPAPLPPGDDTKASPAVRRLAREKGIDLHQVRGSGPEGRILMEDLDQVAANEEPPAAQAGQVSAGESPAPPEAEPMTRMRGAIARITAEAWRTIPHFYETVEIDMKEAGEIVRELKGSGNAVTYNDLVLKAAALALVQFPRMNASFRDGGVVAHREVNIGFAVAMEEGLQVPVVKGCQSLALKEIALQTVRLAERARSGAITQEEISGGTFSVSNLGMYGIDEFAAVIMPPQAAILAVGAVADRPVVRDGQLAVARTMRATLSCDHRVVDGAYAAQFLGELRRVLENPVLMLV

SEQ ID NO: 72346 - protein, 93 aa, Ajellomyces capsulatus
MRILMVGLDAAGKTTILYKLKLGEIVTTIPTIGFNVETVEYKNIQFTVWDVGGQDKIRPLWRHYFQNTQGIIFVVDSNDRDRVVEAREELQRM

SEQ ID NO: 72347 - protein, 898 aa, Cardamine flexuosa
MKIITEGRFHVSLLYLLLLLLVSASHLISAANYTPTDQILLNCGASSNSSDADKRAWSADDNNKFLSSSGDSKTSPAATQGSSVSEIPYMTARISQSPFTYSFSVAAGRKIVRLYFYPSTYDGLNATDGLFSFSFGPYTLLKNFSAAQTVEALPYAVIVKEFIVNVEGGSLNMTFTPESTPSNAYAFVNGIEVTSMPDIYSNTDGTLTMVGSSGAFTIDNSTALENVFRLNVGGSDISPSADTGLYRSWYDDQPYLFGAAIGIPYPADPTMNITYPTGTPTYVAPKDVYSTARTMGPNARININYNLTWVFSIDSGFSYLVRLHFCEVSTNTTKSNQRVFAIYLNNQTAEPEADVIAWTGNQGNGIAFHKDYVVNPPDGKGQQDLWLALTPNQRTKPQYYDSILNGVEIFKVNTSDGNLAGPNPIPGPKVTADPSKVLRPRTSQSRNHTAIVAGAASGAIVLALIIGLCVLVAYRRRNRVNYQPASDATSGWLPLSLYGNSHSAGSAKTNTTGSYASSLPSNLCRHFSFAEIKAATKNFDESRVLGVGGFGKVYRGEIDGGTTKVAIKRGNPMSEQGVHEFQTEIEMLSKLRHRHLVSLIGYCEENCEMILVYDYMAYGTMREHLYKTQNSPLPWKQRLEICIGAARGLHYLHTGAKHTIIHRDVKTTNILLDEKWVAKVSDFGLSKTGPTLDHTHVSTVVKGSFGYLDPEYFRRQQLTEKSDVYSFGVVLFEALCARPALNPTLAKEQVSLAEWAPYCYKKGMLDQIVDPYLKGKITPECFKKFSETAMKCVLDQGIERPSMGDVLWNLEFALQLQESAEENGKGVGGDMDMNEIKYDDGNCKGKNDMSSDVYEGNVTDSRSSGIDMSIGGRSLASEDSEGLTPSAVFSQIMNPKGR

SEQ ID NO: 72348 - protein, 198 aa, Francisella tularensis subsp. tularensis SCHU S4
MFFNIPNILTFGRLILIPFIVICYYFEFPHHHGITATLFLLGAATDWLDGYLARKWKQTSKLGAFLDPVADKLIVATALCLFIEMYPYWWATIPAIVMICREIVVSALREWMAELGQRSVVKVGVWGKVKTAAQMAALFIFLIKPAIDFRHSIDYTSFNTWFIFLGFLMLYVAVILTIYSMCNYLYVAFKSVFGASDN

SEQ ID NO: 72349 - protein, 434 aa, Stigmatella aurantiaca
MRPIGSARQAGRGTSALALIVQKYGGTSVGDTERIKNVAKRCIAAQKAGHDVVVVVSAMSGETNRLLKLVSQITERPNEREQDVVVATGEQVSIGLVALAIQTQKRKAVSFLGHQVRITTDSTFSKARIKSIDAERIVDALKKKNIVVVAGFQGQDEHGNVTTLGRGGSDTTAVALAAALKADACEIYTDVDGVYTTDPNMVPAARKLERIAYEEMLELASVGAKVLQIRSVEFAMKYKVPLWVKSSFTDDPGTLVCEEDAAMEDVLVSGIAYDKNEAKIAIRGVPDVPGVAAKIFGALDEQSIVVDLIVQNVSKDGRTDVTFTVGKADLTKAKDVVKKIAKSVKAEGVETDDQVSKVSIVGVGMRNHSGVAAKMFTVLAGAGVNVQMISTSEIKVSCVIHSNYTELAVRSLHTAFGLDKPEAGAVSEVVSLKG

SEQ ID NO: 72350 - protein, 507 aa, Zea mays
MASPAPASPAAAAAHCPPPRIGLAGLATMGQNLALNIAEKGFPISVYNRTAAKVDSTLSRARDEGSLPVLGHRDPRGFVLSLARPRAVVLLVQAGPAVDATIQALSPYLEPGDAIVDGGNEWYQNTERRIQEAAARGVLYLGMGVSGGEEGARNGPSLMPGGSADAYANIRDILQKAAAQTEDGACVTFVGPGGAGNFVKMVHNGIEYGDMQLIAEAYDVLRRLGGLSNSEIADVFAEWNRGELESFLVQITADIFTVADPLDGSGSGGGALVDRILDKTGMKGTGKWTVQQAAELAVAAPTIAASLDGRYLSGLKDERVAAAGVLEEEGMPAGLLETVNVDKKVLVDRVRQALYASKICSYAQGMNLLRAKSVEKGWNLNLAELARIWKGGCIIRARFLDRIKSAYDRNPELANLIVDREFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 72351 - protein, 123 aa, Methanopyrus kandleri AV19
MSKPMYVKFEVPEELAEKAYEALEIARDTGRIRKGTNETTKAVEREEAVLVLIAEDVDPEEVVAHLPELCDEKGIPYVYVPSKDELGAAAGIDVAAASACIIDPGDAKDLVDEIIEKVEELRE

SEQ ID NO: 72352 - protein, 393 aa, Solanum lycopersicum
MPQLVKLPLPFPINGKRTLPILKHFLTSSSPSPSPSHALTSVRSVTYMPRPGDGTPRAVTLIPGDGIGPLVTGAVEQVMEAMHAPVLLWRYDVHGDMKEYASGDVDGISNPGRNKVWFKREGWKTPVGGGVSSLNVQLRKELDLYASLVHCFNLKGLPTRHENVDIVVIRENTEGEYSGLEHEVVPGVVESLKVMTKFCSERIAKYAFEYAYLNNRKVVTAVHKANIMENLLMVYFWESCRRDRKQITLGSSTMRELWTTVACNLYQSLSNLMLWSPLISTEIWLTNTAAGIAGGTGCLCPGGNVGGDHAVFEQGASAGNVGNEKILEQKKANPIALFLSSAMMLRHLQFPSFADRLETSVKRVIAEGKYMTKDLGGDCTTQEITDAVIANLD

SEQ ID NO: 72353 - protein, 147 aa, Clostridium perfringens str. 13
MKYTKKEKEELKKVLTEEEYYVTQENGTERPFTNEYWDFNGEGIYVDITTGEPLFTSKDKFHSSCGWPAFSKPIDRSIIKEKVDKSHGMIRTEVRSKLGDSHLGHVFCDGPEELGGLRYCINSASLKFIPKEELKEKGYEEYLELFK

SEQ ID NO: 72354 - protein, 366 aa, Glycine max
MGLRSKLRMSASVVQQGMKEIRRSVTYMPRPGDGAPRGVTLIPGDGIGPLVTHAVEQVMEAMHAPIYFEKYDVHGDMRRVPEEVLDSIRKNKVCLKGGLRTPVGGGVSSLNVQLRKDLDLYASLVNCFNLPGLPTRHHNVDIVVIRENTEGEYSGLEHEVVPGVVESLKVMSKFCSERIAKYAFEYAYLNNRKQVTAVHKANIMKLADGLFLESCRHVATKYPGIKYNEIIVDNCCMQLVSKPEQFDVMVTPNLYGNLVANTAAGIAGGTGVMPGGNVGADHAVFEQGASAGNVGKEKMVEQKKANPVALLLSSAMMLRHLQFPSFADRLETAVKRVISEGNCRTKDLGGDSTTQQVVDAVIANLD

SEQ ID NO: 72355 - protein, 400 aa, Pseudomonas putida KT2440
MRAVSYHGANDVRVDSVPDPILQDADDIILRVTATAICGSDLHLYRGKIPETEQGDIFGHEFMGIVEEVGRDVTTLQVGDRVVIPFVIACGSCFFCQQDLFAACETTNTGRGSIINKKGIPPGAALFGYSHLYGGIPGGQADYVRVPKGNVGPFKVPTTLADDKVLFLSDILPTAWQAVINAEIGEGSSVAIYGAGPVGLLSAACARMLGAHTVFMVDDNDYRLAYAQEAYGVIPINFEKDDDPADSIIRQTPGMRGVDAVIDAVGFEAKGSTTETVMTALKLEGSSGKALRQSIAAVRRGGVVSVPGVYAGFIHGFMFGDAFDKGLTFKMGQTHVQKYLPELLEHIEAGRLQPELIVTHRLALEEAAMGYKMFDQKQDNCRKVILVPGAAPGTLGPDHL

SEQ ID NO: 72356 - protein, 986 aa, Coprinopsis cinerea okayama7#130
MEPYTPHTRSSRKKTLGLSSKEYTKIAGTIASVRRNRMAGDEEDSRESNTKDSSFIAETSFVRAPLNSRVAANYAHPRRSSKGKAKQESLDRVPLEIQEALILEDLLFVLMGIEGEHITYHPDYSPEDDDPLRGIQFVVSPYLDSSLRDLVDRILPLGTYYTAIHAFIENRSHMDFGLINHALCAAIRDMLKDYQTLLSQLEHAFNTSPQFSLQKLWFYVHPTIHTLSLIYQLILDLDDTGGSISSSESSSSEDEEERARNEALGLGGAGLKVVMSEFTKGDTTPAGANGIYVKGGEVLTIIYEKMQYMAGDPTAHTIYKSLLRAAAKPYVEMLRTWVTTGKLVDPYEELLVKESKFIDRGILEVDYTDEYWERRYTLRDGSSTTGSKRHMAGVPPPRPSGRLPGGACIPPLLEGWKHKILLAGKYLNVIRECGNDVNRDDLSDEELFLDEESFYTFIENAYSFANKTLLNLLLKDQELIPRLRSLKRYFFLSQASFLTHLLDLSATELRKASRSASIVKLQSLLDLALNNDALGEDALYREDVKVTMADSGLYDFLLKVVNVSGVIGGEEEAAHQEEPAKKEKEEKKSMQAIDALTLDYTVKFPLSLVISRKTILRYQLLFRFLLHLKHVEQSLSSMWIEQKTTPWRCRMPHHPDFERWRLRVCLLRTRMLAFIQQILAFATFEVLEPNWRNLAAKLEKVTTVDQLLRDHVDFLDTCLKECMLTSSKLLKAYSRLILTCSTFALYTASFTKTASNAIAVSENGEEDQGMAKRWDVLGKFETNFNHWFQIHLDCVQFYASSENVSLLPLVVRLNRSDNVAEQRQIEALGFRPKRVSQDMISTVSNMFPDIPIANIHYDLLRTGNVEQTTNKVLERGFLEAPPAAFHQLYPSSSTNTSSTRAPAAASASSSSSKPAPKPLSLIERYQLEERIKKGEVVPEDQVGGKAQWEDSPEKREASLRERKAQMILAARQRMLAQQVQSQAAKS

SEQ ID NO: 72357 - protein, 432 aa, Daucus carota
MASKAVITQRHKEAEGKQKNVQAERRNRRVLGDIGNVVKAVDAGKPKNPIKTNRPMTRSLCAQLVAKGLPVVGGKDPKDIQLIDGVVGRKDASVLEAAAVKKKDTDQRTTVTLSCEEEIKPKSSGRKSRPDYSEKTEKAFTSILSARSKAACGLINKPQNEIIANIDASDVDDELAAVEYVDDIYKYYKLTEGDGQVHDYMPSQTDINSKMRSILIDWLVEVHRKFELMPESLYLTINIVDRYLSMKIVPRRELQLVGVGSMLIACKYEEIWAPEVNDFIAISDNAYNREQVLLMEKSILAKLEWYLTVPTPYVFLVRYIKSSVPSDPEMENMTFFLAELGLTHYTTVMTYCPSVIAASAVYAARCTLKKSPFWTETLKHYTGYSEDQLRDCAKLLVSYHAALSESKLKAVYKKFARPEKGVVALVPPLKLI

SEQ ID NO: 72358 - protein, 441 aa, Pseudomonas putida KT2440
MVDQATGMKSGERYRVENVERAHQFPGFFQDGKYYLGPELLTAVGWLEGTRFIYDSLDAEGEPVFPNKEAGTVEGLTLTLVDGTALELSLVEADEIIAPFEHRSSGTEQEAPRRGYPVRGPLRGKVVVITGASSGIGRAAAHAFACKGARLVLAARDEEALFDVLDECTDCGTDAIAVTTDVTHSDQVQALAAQASAFGHGRIDIWVNNAGVGAVGNFEDTPLEAHEQVIQTDLIGYLRGAYVALPFFKAQGSGILINTLSLGSWVAQPYAAAYSASKFGLRGLTEALRGELTKFPNIHVCDIYPAVMDTPGFRDGGNYTGHALTPPSPIYDPERVAKTMVACAISPRAHTTVGTAARLAHLASYLVPGIALLSGWVTRWGINRSPIAETSSGNLFEPPSDRRSIDGGWRKPKAKTPLLIGAAALGIIAGLTIACSRRRKH

SEQ ID NO: 72359 - protein, 96 aa, Zea mays
  misc_feature (73)..(73): Xaa can be any naturally occurring amino acid
MKFNIANPSTGCQKKLEIDDDQKLRAFYDRKMGQEDRGDALGEEFKGYVFKIMGGCDKQGLPMKQGDMTYGRXQLVLHRGTTCLQGYGKQNEERKR

SEQ ID NO: 72360 - protein, 514 aa, Escherichia coli
  misc_feature (122)..(122): Xaa can be any naturally occurring amino acid
MADSQPLSGAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKALIVMPTATADIKVDAVXGFGGEVLLHGANFDEAKRKAIELSQQQGFTWVPPFDHPMVIAGQGTLALELLQQDAHLDRVFVPVGGGGLAAGVAVLIKQLMPQIKVIAVEAEDSACLKAALDAGHPVDLPRVGLFAEGVAVKRIGDETFRLCQEYLDDIITVDSDAICAAMKDLFEDVRAVAEPSGALALAGMKKYIALHNIRGERLAHILSGANVNFHGLRYVSERCELGEQREALLAVTIPEEKGSFLKFCQLLGGRSVTEFNYRFADAKNACIFVGVRLSRGLEERKEILQMLNDGGYSVVDLSDDEMAKLHVRYMVGGRPSHPLQERLYSFEFPESPGALLRFLNTLGTYWNISLFHYRSHGTDYGRVLAAFELGDHEPDFETRLNELGYDCHDETNNPAFRFFLAG

SEQ ID NO: 72361 - protein, 595 aa, Acidovorax sp. JS42
MYQYTEFDRQFVHLRAQQFRDQLERWQRGELTDEQLLPLRLQNGWYIQRYAPMARIAVPYGDINSTQLRMLAHIAREYDRPTPELLAHAQATQDQLQAAQPGLTLAAPPLRYGYGHFTTRTNVQFNWIPITRAADVMDLLASVHMHGIQTSGNDIRNITCEAYAGIAEDEIVDTRPFAEITRQWSSLHPEFTYLPRKFKIAFNGAAEDRAATGWYDIGLQALKNAAGEVGFAVKVGGGMGRTPVIGTVVREFLPWDQLLNYIEAIVRVYNSYGRRDNKWKARIKILVKSEGQQFIDAVEAEYRAILEQDGAPHTITQAELDRVTGHFVVPPLRPAGRPHGVNTSGQLYQRWLQQNVRGHRMAGLKAVTLSFKRVGFAPGDADGDTLDALAQLADQFSAGEARLTHEQNLLLPWVHEADLPALYEAARKLGLAQPNIGLLTDMIACPGGDFCSLANARSLPIAAAITERYQDLDELFDIGPIDLHMSGCINSCGHHHSGHIGILGVDKDGKEWYQITLGGSDGTQLSGPAIGGKVVGPSFSAAEVPDVIEALLDTYRALRKGNELFIDTLRRVGQDPFKAAANGARHPKAAEEAVA

SEQ ID NO: 72362 - protein, 341 aa, Lactobacillus johnsonii NCC 533
MQKKILLLSTGGTIASVVSEAGLVPKESGEQLINMLGELPYDITVEDILQLDSSNIQPEEWKLIAEKIYENRNKYDGIVVSHGTDTMAYTASMLSFMLQNINIPVVLTGSQVPINVVLSDAPDNLKLAFAAAASCHPNIYLAFDRKVMLGCRSVKVRTINFDAFESVNVPPVARVTSDGLVFSDQNVPKNTKDMKDTTLNTSINPHVSLVKLFPGFDPNLLFAMVESGCQGIVIEAYGLGGMNYIRRNMVAAIGKLIRRGIPIIATSQCLYERSDLTKYEVGREALLEGAISARDMTSESAITKLMWGLGQNWDVHQISDFFNTDVAGEVTIEKDDNLQID

SEQ ID NO: 72363 - protein, 472 aa, Geobacter sulfurreducens PCA
MAEQTFDLIVIGAGPGGYVAAIRAAQLGMTVAVAEQRETLGGVCLNEGCIPSKALLDSSEFFAQARDGFAGHGILIDPPRLDLARMMARKDDVVKKLTDGIAYLFKKNRITWLKGTARLAGRNGDLLRVEVGGNGTAPAHLLEAGKVLLATGSEAVPVPGLAFDGETVVSAREALAFDRVPEHLLVVGAGYIGLELGSVWRRLGSQVTVVEVLAKPLPATDGQVADALVRSLKKQGISFRMETRVTGIEKREGTAVVTVESSAGGRDAIACDRVLVAAGRRPVMAGLGLEPFNLAMEGGRIRVDDNYLTSAPGIYAIGDLIHGPMLAHKAMAEGEVFAERLTGEASVVDYEYIPGIVYTWPEAAGVGLTEEQLKEQGIPYAAGRFNFMANGRARCMGETEGFVKILAKPDTGRVLGIHVVGPRASDLIAEAVTVMTYGGSAADIAMTFHAHPTLAEAMKEAALDVEKRAIHA

SEQ ID NO: 72364 - protein, 409 aa, Geobacter sulfurreducens PCA
MEIKIPSVGESVFEALVATWLRQDGDAVRKDEPVCEIETDKITMELNAEADGVLSIAVPAGTTVKIGTVIGTIREGAAAPVAESPAPAQAAAAAPAAEPPLSPSVRKMARERGISPEAVPGTGRGGRVTVDDLFSFAEKREQGASPAGAPPPAAPQPPAQQPRPAAEQPRQAEPPEADRTTRTPMTPIRKRIAERLMAARQQTAMLTTFNEADLGRIVELRARHKEQFAKRHGVSLGFMSFFVKACVEALKAFPLVNARIDGNDIVRHHYYNIGIAIGADKGLVVPVLRDADRLHFWEIEQAIAAFVEKIKTNRLELSDLEGGTFSITNGGVYGSLLSTPILNPPQSGVLGMHAIQDRPVARDGQVVIRPMMYLALSYDHRIIDGREAVGFLRTVKEYVEDPEELFLEG

SEQ ID NO: 72365 - protein, 281 aa, Oryza sativa Indica Group
MAASTPAASRERRWSRAGKTALVTGGTKGIGRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVAMGRIGEPEEVASLVAFLCMPAASYITGQVICVDGGRTITA

SEQ ID NO: 72366 - protein, 420 aa, Arabidopsis thaliana
MALSSLLRSAATSAAAPRVELYPSSSYNHSQVTSSLGFSHSLTSSRFSGAAVSTGKYSAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 72367 - protein, 442 aa, Burkholderia thailandensis E264
MTEHVSQTPDLSAFWMPFTANRQFKEAPRLLVAAKGMYYTSHDGRRILDGTAGLWCVNAGHGRDEIVAAVQAQAREMDFAPTFQMGHPKAFEAATKIARHTPGDLKHIFFTNSGSEAVDTALKIALAYHRARGEGQRTRFIGRERGYHGVGFGGISVGGIAPNRKAYSGALLPSVDHLPHTLNLKEAAFSKGQPAWGAHLADELERLVALHDASTIAAVIVEPVAGSTGVLIPPQGYLERLRELCDKHGILLIFDEVITGWGRLGAPFASQFFGVTPDLLTMAKGTNNAAVPMGAVAASGAIHDAIVDGAPAGIELFHGYTYSGHPLAAAAAVATIDLYEREGLLTRAAQIAPIFEREIHKLKDARHVIDVRNLGLVGGVELKPRDGKPGARAYEVFVKCFANGAMIRYTGDILAFSPPLIVEEAQIVELFSIVAQALKETE

SEQ ID NO: 72368 - protein, 435 aa, Pseudoalteromonas tunicata D2
MNNKQPIDIEFDKNHIWHPYTSMTKPLPVYPVSHAEENFIYLQSGEKLTDGMASWWSAIHGYNHPRLNEAVTKQLAKMSHIMFGGLTHEPAVELCKLLVAMTPEPLQKVFLADSGSVSVEVAIKMALQYWLSQGVKGKSKLMTPNKGYHGDTFAAMSVCDPVNSMHSMYQGFLPQHVFVPAPQSGFFEHFDENEAHTLRDYFVRHHHEVAAFIVEPIVQNAGGMNFYHPDYLKTVRTLCDEFNILLICDEIATGFGRTGTLFAVEHANINPDIMCIGKALTGGYMTLSATLTTNKIAIGISEGEAGVLMHGPTFMGNPLACAVACASIELLQANNWQNQVAVLNKTLNDSLLPCQALESVINVRVLGAIGVVEVSHCVDVALIQQRFIEYGVWIRPFGRLIYLMPPYISTPDDIKQLGQAIFDVLTQYPEVLKRE

SEQ ID NO: 72369 - protein, 277 aa, Oryza sativa Indica Group
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHPLLRDAAAGGGAAASVVNISSTAAFYAAPHLAVYSATKGGMNQLTRCLAAEWARDGVRVNAVAPGATRTDICDTSGVALGEETRRRLADAGAMDRVPIRRIGEPEEVAAAVVFLCMPAASYITGQVICVDGGRTLL

SEQ ID NO: 72370 - protein, 137 aa, Geobacter sulfurreducens PCA
MKRKIEKTDAQWRGQLTPEQYEITRRKGTEPAFTGAYWDCHDRGTYRCVCCGAPLFDSADKFDSGTGWPSFTAPLDGDGVESEEDRSFFMHRTEVHCASCGAHLGHLFPDGPAPTGRRYCINSASLVLDRAGEGEKE

SEQ ID NO: 72371 - protein, 413 aa, Bacillus thuringiensis serovar konkukian str. 97-27
MIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDDIVHDMLTKATYETHPLGYPILGTEETLNTFTGDTLRQYIKDHYTPENVVVSIAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYETMQETLETLKNTGITEKELMNSKEQLKGNLMLSLESTNSRMSRNGKNELLLRKHRSLDEIIESVNTVTKENVDELIRNMFTDEFSAALISPDGKLPKGIKL

SEQ ID NO: 72372 - protein, 494 aa, Arabidopsis thaliana
METKTLIFSILVVVLSLIYLIGKLKRKPNLPPSPAWSLPVIGHLRLLKPPIHRTFLSLSQSLNNAPIFSLRLGNRLVFVNSSHSIAEECFTKNDVVLANRPNFILAKHVAYDYTTMIAASYGDHWRNLRRIGSVEIFSNHRLNSFLSIRKDEIRRLVFRLSRNFSQEFVKVDMKSMLSDLTFNNIIRMVAGKRYYGDGVEDDPEAKRVRQLIADVVACAGAGNAVDYLPVLRLVSDYETRVKKLAGRLDEFLQGLVDEKRDAKEKGNTMIDHLLTLQESQPDYFTDRIIKGNMLALILAGTDTSAVTLEWALSNVLNHSEVLNKARDEIDRKIGLDRLMDESDISNLPYLQNIVSETLRLYPAAPMLLPHVASEDCKVAGYDMPRGTILLTNVWAIHRDPQLWDDPMSFKPERFEKEGEAQKLMPFGLGRRACPGSGLAHRLINLTLGSLIQCLEWEKIGEEVDMSEGKGVTMPKAKPLEAMCRARPSVVKIFN

SEQ ID NO: 72373 - protein, 212 aa, Zea mays
  misc_feature (76)..(76): Xaa can be any naturally occurring amino acid
  misc_feature (85)..(85): Xaa can be any naturally occurring amino acid
  misc_feature (102)..(102): Xaa can be any naturally occurring amino acid
  misc_feature (113)..(113): Xaa can be any naturally occurring amino acid
MTSVWKTKVLPGLNKIFDKDGKKAAAAGFLKSFNKEEFDKEIEDKKTELEPKVVEAYEASPPEVKALFKDKKPVQXTKKNSAAVXTKFLDELAKIDFPGAKXVSEAVAKSGTXPLLPAITFFLAKVAPFFPKEEPKEEPAAEPPSREVPVEEKKEEADPAPATEAAPAPAEPPSEAAVVEEKKEEEKKEEEVNPAAEEAAPPPPAAAAAEEK

SEQ ID NO: 72374 - protein, 389 aa, Methanopyrus kandleri AV19
MDARELIDKYHMNTYSRFPVTLVPGEGARVWDDEGNEYIDLVAGIAVNVLGHCHPAVVEAVKEQVERLIHCSNLYYNEPQAEAARLLAEAAPKDLNKVFFCNSGTESVECAIKLARKFTGCTKFIAFEGGFHGRTMGALSATWKPEFREPFEPLVPEFEHVPYGDVNAVEKAIDDDTAAVIVEPVQGEAGVRIPPEGFLRELRELCDEHGLLLIVDEVQSGMGRTGQFFAFEHEDVLPDIVCLAKGLGGGVPVGATIAREEVAEAFEPGDHGSTFGGNPLACAAVCAAVSTVLEENLPEAAERKGKLAMRILSEAEDVVEEVRGRGLMMGVEVGDDERAKDVAREMLDRGALVNVTSGDVIRLVPPLVIGEDELEKALAELADALRASG

SEQ ID NO: 72375 - protein, 160 aa, Clostridium difficile
MKKEMLAMILAGGQGSRLGVFTKRIAKPAVSFGGKYRIIDFVLSNCSNSGIDTVGVLTQYRPLILNSHIGMGSHWDLDRINGGVYVLQPFMNEKEGNWYNGTAHAIYQNMDFVDTYNPEYVLILSGDHIYKMDYSKMLKFHKEKGSKATIAVIEVPWDEA

SEQ ID NO: 72376 - protein, 554 aa, Clostridium acetobutylicum ATCC 824
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 72377 - protein, 675 aa, Coccidioides immitis RS
MTQLFNSSSGSSGVGSEKRPFPGLSLPSRKHSGDPSHFPTRLKNFFRINSSSSSNTPTVSNSGGGSGSGGAHHTSSGHAHLSTKPESKSTFRQSRFLPTIGRNRSTTVASEGNPLDEIASPTADANPYFHHQGYPALRHRNDDSAPSSPPDTPELQVEGVPASDQATAAGKEELARKLRRVASAPNAQGLFSGDGSGDRPKTAELGKEPLVASGGASPKLSFVDQPGSQAASISDERASTLSVPRSFVNCRRTYSSNSIKVRNVEVGPGSFDKIKLIGKGDVGKVYLVREKKSNRLYAMKVLSKKEMIKRNKIKRALAEQEILATSNHPFIVTLYHSFQSEEHLYLCMEYCSGGEFFRALQTRPGKCIPEDDARFYAAEVTAALEYLHLMGFIYRDLKPERHIMLSDFDLSKQSGPGGAPTMIVGRNGTSSSSLPTIDTKSCIANFRTNSFVGTEEYIAPEVIKGDGHTSAVDWWTLGILIYEMLYGITPFKGKNRNATFANILRNDVPFPDHAGAQQISNLCKSLIRKLLIKDETKRLGARAGASDVKTHPFFRTTQWALIRHMKPPMIPHQGRAIDTVNFRNMKESASVDIGGTSKLKGVPMDSGLATPGEQIPDPFEDFNSVTLHHDGDYHGQLADDSFNGYYSRLVCIQPPSIKVLAEISKMQTEPLGMKI

SEQ ID NO: 72378 - protein, 251 aa, Brassica napus
MASFTSKYADELIANAAYIGTPGKGILAADESTGTIGKRLSSINVENVESNRRALRELLFTTPGALPCLSGVILFEETLYQKSSKGTPFVDILKEGGVLPGIKVDKGTISLPGTNGETTTQGLDGLGERCKKYYEAGARFAKWRAVLKIGPNEPSELAIRENAYGLARYAAICQENGLVPIVEPEILVDGSHDIQKCAEVTERVLAACYKALSDHHVMLEGTLLKPNMVTPGSESGKVAPEVVAEYTVRAL

SEQ ID NO: 72379 - protein, 291 aa, Sulfolobus solfataricus
MIIIGGSATNGIDESLSKILSIPLVKVENKIFPDGESYIRVPSSIRDEEVLLVQTTDYPQDKHLIELFLIAETIRDLGAKKLTAIVPYLAYSRQDRRFKDGEAISIKTILHILSEVGVNTLVVVEPHKPEELSYFKGELKIVHPYHQIARKIKEIIEDPFILAPDRGALDRARKIAEEINAPYSYIEKERDRTTGEVRIKEAPNINLKGKDVVIIDDIISTGGTIVQATRLAYSLGAKSVTAAAIHLLLVGGAKERLREVGVKTLIGTNTINVNDKDIITIDVSQSIALSL

SEQ ID NO: 72380 - protein, 923 aa, Coprinopsis cinerea okayama7#130
MRAAARFVAGQRRPAVAAVQAVRRTVPATTRGVQSAAQTDRDTITRLLYSIGTKREVERHLRIFSSSSHPSQPAKFAVLKVGGAVLDDLDELALSLSFLYRVGLYPVVLHGAGPQLNDIMEREGVVPDYIDGIRVTNAKTLQVARRVFLEQNLKLVAALEKLGTRARPITSGVFSADYLDREKYGLVGKITKVDKRPIEASIRAGALPILTSLAETPEGQILNVNADIAAGELAKELEPMKIVFLNDKGGLFHGVTGEKLDVINLDEEYDQLMKEPWVKYGTKLKLREFKELLDHLPRSSSVAVISASSLQKELFTDSGAGTLIRRGYKLFKHSSIEEIGADRFRQVVHDRDPDVLSGFSSVTEVLSSLKKTPYTIYGDEPLDVVAVVSHPEGEIPVLTKLLTTRQGVLNNVIDNVFDKIKKDHKKLFWTARVDDENRAWHWERAEGSFTRNGKSLFWYGLRDVDEVEDAVELFDKRGRIERAYLPVGPAAYKHDPKPTPAAAAAPAGARAYSTLARKAFGTTPGSKRGYATAAPSQPKAKKLALIGARGYTGQALVSLLNNHPHIELTHVSSRALKGYDLEGYKSKGLVDQASLGKEVIYSDLSEADIERMERNGEVDAWILALPNGVGARFVQAIDKGAKDRVVKEGEKKGVIVDLSADYRFETPGASEWVYGLPELYQRAPVQQATRVSNPGCYATSAQLMIAPLLEFIKPGTIPTLFGLSGYSGAGTNMVEGKDGGRPQSVPKRTPESLGGGVLSYSLTDHIHEREVGFHLSRLLPSETTTSPTGVPLNQKLKVGFVPTVAPWFSGILMTASIPLSKRFSARDVQQLYADKYKGEKLVNVFSLNEKENKELGRSGVVPMLQDVEGKQGWSVGGWGIHSEGERVVLVGGLDNLLKGAATQCLQNLNLALGFDEYTGIPLD

SEQ ID NO: 72381 - protein, 409 aa, Glycine max
MAACLQLWQCKLARPFDSLPVRRSIPLSLRCSAAPSSSKPTRSYSITLIPGDGIGPEIISVAKDVLVLAGYLEGIKYDFREMLMGGAALDATGLPLPHETLSAAKQSHAVLLGAVGGYKWDRNDKHLKPETGLLQIRKELGVFANLRPATVYSPLVDASTLKREVAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 72382 - protein, 192 aa, Listeria monocytogenes EGD-e
MNLPNKLTVIRIFMIPIFVILCVVPFDWGSVTWLDSTIPVTSLVATIIFIVAALTDWFDGHLARKYNLITNFGKFADPMADKLLVAAAFIILVEMHIAPSWVVILIISRELAVTGLRLLLVEGGEVLAAGQLGKIKTFTQMIAIPLMLLNNFPFAWTGIRVDLVFLYVCAFFAVWSGIDYFYKNRGVFKGSM

SEQ ID NO: 72383 - protein, 489 aa, Coprinopsis cinerea okayama7#130
MSSRRFIPLPSSHPHDTEGWQKVYSDIRKALVRSVKQVERETRASAISGRDSVYVGNSGVAFMQYHLASLDLGFSNSKLSPTTQEILGPDSLRVKADQNLFAVVRQNRIPAAVKDGSRCSFLETPVGVATLILRRCLESLSRPRYSENENILANLRKWWKPSLELLLGTLQCIPSEDRDEELMDEDGKEVEKVKGLKAYREEMEEGHKEGLEVVVSDKMLGVAVESLIARGRYGAKAYEGELGGAAAQEGHGLPPLMWKWHGRRYLGGAHGVAGILQMLLECPRSVIEPHVPDVVSTIGWLVGLQDTDGNFPSKAPSLSRPNPDNELIQWCHGAPAVVTLISTTLHLDSQLFTLSSDLRSRFLSSLKRGADLIYERGLLRKGLGLCHGVAGSVYTLLAASTILDLPEHNSSPSGSSSPYFKKAIHLAHLATLADQLVEEGAMRVPDRPWSLYEGLAGMCCAWGEIFHRLNGDAGSRRVSSGMPGYDDLR

SEQ ID NO: 72384 - protein, 230 aa, Vitis vinifera
MEAAAVLGARPSVSSSYLHSQTQRHCSLYVVSQKPTLRSDHRRLAAFHSPSNLFSYSPFRPHARSTKPRIFLPHLVASMEQVEETYIMVKPDGVQRGLVGEIISRFEKKGFKLTGLKLFQCPKQLAEEHYKDLKEKSFFPKLIEYITSGPVVCMAWEGVGVVASARKLIGSTNPLQAEPGTIRGDLAVQTGRNVVHGSDSPENGKREISLWFKEGELCEWAPVQAPWLRE

SEQ ID NO: 72385 - protein, 163 aa, Triticum aestivum
  misc_feature (95)..(119): Xaa can be any naturally occurring amino acid
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVXXXXXXXXXXXXXXXXXXXXXXXXXEVEEVKKEYPDAYVRIIGFDNMRQVQCVSFIAFKPPGCEESGKA

SEQ ID NO: 72386 - protein, 711 aa, Myxococcus xanthus DK 1622
MTVATREHTRTLRAAESLGKDLGRGLARMDPADMKRLGAHVGDIVTLSGKRRSAAKVMPSYPDARGRGILQIDGVTRANTGVQLDEPVKLTLAPARHAEKVVLAPLEFTPAQRDLAYIGTLLDGLPVVKGDRVRALLFGSRTADFRVVETTPVGAVVIHPNTLLEVAKAPEKEKVTHERARAVSYEDVGGLKRELGRIREIVELPLRYPEVFERLGIDAPKGVLLYGPPGCGKTLIARAVAHETAAAFFTITGPEIMHKFYGESEAHLRQIFDEAQRRAPAIIFVDEIDAIAPRRENVQGEVEKRVVAQLLSLMDGLAQRRHVIVLAATNIPNVLDPALRRPGRFDREIAISIPDRTARKEILAIHSRGMPLAEDVDLDHLAAVTHGFVGADLQALCREAAMLCLRRLIPHIDFASAEIPYDELIQVQVTMADFQAALHEVGPSAIREVFVETPDVGWKDVGGLGQLKQRLIEAVEWPLRYPEEFARAKVRPPKGVLLSGPPGCGKTLMAKAAAHESQVNFISVKGPALLSKFVGESERGVRETFQKARQAAPCIIFFDEIDSLVPTRSAGGMDERVTERVVSQFLAEMDGIEELTGVLVLAATNRADLLDPALLRPGRFDLLVDVPLPDREARRDIFQVHLRDKPVEKDLDLGGLAARSESFSGADIQAVCNQAAWEAVRHVISGKGKRLVITSESLLKAIRGHKEARRP

SEQ ID NO: 72387 - protein, 271 aa, Pisum sativum
MLNQKIFLQDDSLFNYALLTLFLIAPPTFISLAFLQAPYGKHHRPGWGPNLSPPLAWFLMESPTLWFTLYLFPFGNNSSNPKSIILITPFLIHYFNRTIIYPVRLFITMKTKKKSTLSKTPSGFPFSIALMAFVFNLLNSYVQARWVSHYKSYDDGLFFWVVFFCGVLVFSGGMGINVWSDKELLRLKGEGKGYVVPKGGFFEFVSCPNYFGEIVEWFGWALMTWSWAGLGFFAYTFANLGPRARANHQWYLEKFGEDYPKKRKAVIPYLY

SEQ ID NO: 72388 - protein, 826 aa, Zea mays
MAPVFFLLPLLLGQILLCAAGDTINSSTPLSGAQKIVSKGNKFTLGFYTPPQGTNTSSNQGNYYIAIWYSNIPLQTTVWMANPDLPVADPTTAALTIGSDGNLVLLDQSKNRQVLWSTNISTSSNSTIAVLQDGGSLDLRDATNSSMVYWRSIDHPTNTWLPGGKLGLNKTTGVSQRLVPWTNTANPSPGLFSLELDPRGTTQYLIQWNDSITYWSSGPWNNNIFSLVPEMTSGYNYDFQFINNATESYFIYSMKDNSIISRFIIDVDGQIKQLTWVPASQSWILFWSQPRTQCEVYALCGAYGSCNLNALPFCNCIRGFSQKVQSDWDLQDYSSGCKRRVPLQCQTNSSSSQAQPDKFYTMANVRLPDNAQTAVAASSQDCQVACLNNCSCNAYTYNSSGCFVWHGDLINLQDQYSGNGGGTLFLRLAASELPGSKRSKAVIIGAVVGGVAAVLIVLSIVAYFLFQKYRRERTLRIPKTAGGTLIAFRYSDLQHVTNNFSERLGGGAFGSVFKGKLPDSTAIAVKRLDGVHQGEKQFRAEVSTIGTVQHVNLVRLLGFCSEGSRRLLVYEFMPKGSLDLQLFLGETTALSWATRYQIALGTARGLNYLHEKCRDCIIHCDVKPENILLDESFVPKVADFGLAKLLGRDFSRVLTTMRGTRGYLAPEWISGVAITAKADVFSYGMMLFELISGRRNSDHGEQHGSTFFPTFAASKLHEGDVRTLLDPKLNGDANADELTRACKVACWCIQDDESARPTTGQIVQILEGFLDVNMPPVPRSLRVLGESPDVINFFSDISSNQTSQTQNSTTSQTRSTTSGSSHLQSP

SEQ ID NO: 72389 - protein, 478 aa, Burkholderia thailandensis E264
MHRATKIVATIGPASSSPEVLLQMMHAGLDVVRLNFSHGSADDHRERAEMVREAARRVGREIAIMADLQGPKIRVGKFEAGKTTLTPGQPFILDATCELGNDERVGLDYKDLPRDLKPGDVLLLNDGLIVLKVDRVFGDEIHTTVKVGGDLSNNKGINRQGGGLSAPALTAKDMEDIRTAMSLGADLVAVSFPKNATDMEMARQLANIAGAPYGIKPKMIAKIERAEAIPALQEILDASDGIMVARGDLAVEVGNAAVPALQKRMIRMARESNKLVITATQMMESMIHAPVPTRAEVSDVANAVLDGTDAVMLSAETATGKYPAVTIEAMAAICVEAEKSEHVELDKDFLDRTFTRIDQSIAMGALFTAYHLGAKAIVALTESGATALWMSRHYTHVPIFALTPRVGSERAMALFRNVTPLHVDFDSDRDSALQQALELIVRRGYVAHGDMVVLTVGEPMGQAGGTNTLKIVRVGEHY

SEQ ID NO: 72390 - protein, 507 aa, Oryza sativa Indica Group
MAPMAGGGGVPWGDRARVVGAQIRSRFRVGVVPVDRRWLWRRGDGRVASEAVRQWTERVRSLWQREKSTDQISSSPGTSQAAAAAKPSSSALRFYRKKVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRLVMDADSLPVVIPFVHTGMQDIMPVGKRIPRAGKRVIVVVGDPINFNDLIIDNSDETQHISRGILYDKATERIGQRLQELKAEVDRLAAEQKSELQHHHARDTVNYGTRLWQQVDWEAFGMESSMLSPEPSDVQEPLKKAKPVLHLESEHAKPELHLEPEQAKHELHTEQCVPAAPSAEICSDFGAPLFFRQHTDPSELMGFAARGLLKNGRFMEEEGYRELQRQGAMNMFWGSQANNTVL

SEQ ID NO: 72391 - protein, 428 aa, Lactobacillus johnsonii NCC 533
MLKSVIENVHALEIFDSRGNPTVEVFVTLSNGVVGKAEVPSGASTGENEAVELRDGGSRLGGKGVMNAVNNVNTEINDALKGLDPHDQPNIDATMIALDGTPNKGRLGANAILGVSMATAAAAAKDNHQPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKEDGKYHLEGKVLTDEELADYYDKLLDEFPELISMEDPYDENDVEGMVKFTQSHKDRIQIVLDDFICTNPKLLNKAIHEGAGNASLIKLNQIGTVTETLETIRLSRKNGYNTMISHRSGETGDTFIADFAVAVNGGQLKTGAPARSERVEKYNRLLEIEEELGKGERLAFFPDNVDLD

SEQ ID NO: 72392 - protein, 583 aa, Rhodopseudomonas palustris CGA009
MDTSRRLVAATKPSFRELFTPKLITVLREGYGLGDFRADMIAGLTVAIVALPLSTAIAIASGVTPDRGLYAAVVGGFLVSLLGGSRFQIGGPAGAFIVLVMLSVQRHGIDGVLLATFLAGIMLVIAGFLQIGTYVKFIPYPVTVGFTAGIAVIIFASQLKDLLGIDLAHEPGPFIPKLEALAQALPTMNVYALGIAVTAIVLIVGLKKLRPNWPGLLIAVAVTAALVWGFSLPVATIGTKFGGIPESFPLPSWPVFSVSKVIEVLPDAIAFALLGAIESLLSAVVADGMTGRRHRSNCELVAQGFANMGSALFGGICVTGAIARTATNIRTGARSPIAGMLHSVFLLVFMLVAAPLASYIPLATLAAVLAIVAWNMAEKHEFATLVRSSRGDAVVVLATFLLTVFRDLTEGIVVGFALGAVLFIHRMSEVTGVEAYSGLAQEDRADESGKRRGTAADLSLVTDPDVVVYRITGAFFFGAAATVSSVLNNIADRHKVFVVDFAAVPLLDSTAANAIYRVALSAQRKHIKLIITGASPTVRRALLTHGVKPPLAHYRADIASAVDEIKGKTPAPQEATAPQPASA

SEQ ID NO: 72393 - protein, 612 aa, Arabidopsis thaliana
MAAGGVDVSRSSVAVKKDYDFYRNGSRDVYVRQSGRDDERRQIKRPSDHDLRRNDGRHRSRLAYEKGELREEAEVQRPSEKRRKFSPIVWNAEKVGRAPSREKTKSPFPVPTTTVISNQAVAGKTTSNDQVNALMSPEPSYLAPVQPSEALLAVKHPVDDLEEGQLEEEQVMQEDVKEGLLEEEQVMQEPNIKTSRWGTGLTSPKEELISVNVSKTNRWNRSSLTPECEEVMVSEEQQCYSSGSGSGHLSVEKLSADGNSGREYYSSDHDELEHEDQDSLTPGEMNMMFGSRSVNEFQKLNKINEGTYGIVYKARDEKTKEIVALKKIKMKEDRFEEEYGFPLTSLREINILLSCNHPAIVNVKEVVVGGKNDNDVYMVMEHLEHDLRGVMDRRKEPFSTSEVKCLMMQLLDGLKYLHTNWIIHRDLKPSNLLMNNCGELKICDFGMARQYGSPIKPYTQMVITQWYRPPELLLGAKEYSTAVDMWSVGCIMAELLSQKPLFPGKSELDQLQKIFAVLGTPNEAIWPGFSSFPNAKAKFPTQPYNMLRKKFPAISFVGGQILSERGFDLLNSLLTLDPEKRLTVEDALNHGWFHEVPLPKSKDFMPTYPPKR

SEQ ID NO: 72394 - protein, 155 aa, Oryza sativa Japonica Group
MACAFSVSSAAAPLASPKGDLPLVGNKAPDFEAEAMFDQGFIKSKCMFVSSAEITAFSDRYEEFEKINTEVLGVSIDSVGIALRGLFIIDKEGVIQHSTINNLAIGRSVDETLRTLQALQYVQENPDEVCPAGWKPGEKSMKPDPKDSKEYFASI

SEQ ID NO: 72395 - protein, 166 aa, Francisella tularensis subsp. tularensis SCHU S4
MSNEVKKNEELIEKLVSVKRHSKTVKGGRIMSFAALTVVGDGKGRIGVGRGKSREVPAAIQKAMENAKKNMVSVNLNNDTLWYPVMSNHGASKVFMQPASAGTGIIAGGAMRSVFEAVGVHNVLAKTYGSTNPANVVRATIAGLAKIKSPDEIAEKRGLSVEEIQG

SEQ ID NO: 72396 - protein, 488 aa, Listeria monocytogenes str. 4b H7858
MADVRKLKNYIDGEWVESKTDKYEDVINPATGEVLCQVPISTRAELDQAAVIAEQAFEKWSQVAVPRRARVLFSFQQLLIQHKEELARLITLENGKNLSEARGEVQRGIENVEFAAGSPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLAALRTAAQNVKIGNGLDDGVFLGPVIREENQKRTIAYIEKGLEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 72397 - protein, 268 aa, Astragalus membranaceus var. mongholicus
GNLHHLKHPLHRTFTTLSQKYGDIISLWFGSRLVVVVASPSIAQECFTKNDVVLANRPKFLTGKYIFYNYTTLGSASYGDHWRNLRRITTIDVLSNHRLNSFHGVRKDETLRLVEKLRNDVVKEGNFSFTDVELRHRLTEMTFNAMMRMISGKRYYGDDGDVTDVKEAKQFRDIISEILSLLGANNKGDFLPLLRLFDLDHLEKRCKRISKRADAFLQGLIEQHQNANHSDNDGDTMIDHLLKLRETQPEYYSDHMIKGLIQAMLLAG

SEQ ID NO: 72398 - protein, 456 aa, Oryza sativa Japonica Group
MDTEPLLSPLSPSPHLLHPLPEHAEVSTFSPPLSPCPSPASSYKERIIFGAHPPPPPPPPPPPPPPPRGRRYYRRVSGDDLDVPSCSSSPSPPSDEENPPPNPPSLFDFIGGRTNLHRSRTAPAMAPLNAAAIAAAAASGDSRNPPPPPRRPAIVLHAFLFLLAYLAMGVTFYAALPGNFTSSAGPTHPVADALYFCIVTLCTIGYGDITPATPAAKLFSISFVLIGFGFVDILLSGMVSYVLDLQEHLLITALKNPRSVRKHRHNYIFDLKKGRMRVRMKVALALTVVAICVGVGAAVLKRVENLGWLDAVYLAVMSVTTVGYGDHAFRTLAGRLFASAWLLVSTLAVARAFLYLAEMRIDKRHRAMANWVLSRDMTVSEFLAADIDNNGYVTKSEFVVYKLKEMGKISEKDIMMICDQFQRMDSGNCGKITLSDLLESHQLVTDLNEKKKGKKS

SEQ ID NO: 72399 - protein, 291 aa, Ralstonia eutropha JMP134
MRVAFLGLGVMGFHMAGHLAAKGHEVTVYNRTAAKAQAWVEKFGGKAADTPAQAVRQADVVCSCVGNDDDLRSVLTGPDGAFFAAPTGCIFVDHTTASANVARELYAAARERGLHFVDGPVSGGEVGAEKGILTIMCGGDADVYARVEPVIAAYARAVTRIGEAGAGQLAKMVNQISIAGLIQGLSEAIAFGERAGLDMKLVLDVISKGAAGSWQLENRGPTMIENKFDFGFAVDWMRKDLGLCLDEARRNGASLPVTATVDQFYADLQQMGCGRSDTSSLIKRLRRFSQN

SEQ ID NO: 72400 - protein, 379 aa, Escherichia coli
MSFATISVIGLGYIGLPTRAFASRQKQVIGVDINQHAVDTINRGEIHIVEPDLASVVKTAVEGGFLRASTTPVEADRWLIAVPTPFKGDHEPDMTYVESAARSIAPVLKKGALVILESTSPVGSTEKMAEWLAEMRPDLTFPQQVGEQADVNIAYCPERVLPGQVMVELIKNDRVIGGMTPVCSARASELYKIFLEGECVVTNSRTAEMCKLTENSFRDVNIAFANELSLICADQGINVWELIRLANRHPRVNILQPGPGVGGHCIAVDPWFIVAQNPQQARLIRTAREVNDHKPFWVIDQVKAAVADCLAATDKRASELKIACFGLAFKPNIDDLRESPAMEIAELIAQWHSGETLVVEPNIHQLPKKLTGLWYSGAA

SEQ ID NO: 72401 - protein, 478 aa, Clostridium perfringens SM101
MAEQHNESKKLGFAQLAALIVGSMIGGGAFNLPSDMARGAGTGAVIIGWIITGIGMIALAFVYQSLANRKPELTGGVYSYAKAGFGEYIGFNSAWGYWLSAWIGNVSYSVLLFGAVGYFLPMFGAGNNVASIIGASVLLWAFTLLILNGVSGAALINLITTIAKLVPIFLFIVISLFMFNFDKFTFQFWGTSDLGGIVTQVKSTMLVTLWCFIGIEGAVVVSGRAKKQSDVGKATVLGLIGTLIIYMLITLMALGVMDRVKLSGLENPSMAYVLEFAVGKWGAVLINLGLIISLFGSLLGWALLAAEIPYVAAKDGVLPKVFAKLNKKGTPSGSLIITNLLVQAFLILTLVASSTYQALYSVASTAILVPYLLSAMYGFKLALTGETYDKDPTGRTRDKIFGGIATVYAIWLCYAAGLKYLLLCFILYAVGIIFFYIGKKQNNKDSVVFVGKEKILAIIVLVIAIIAIVMLFNGAITI

SEQ ID NO: 72402 - protein, 461 aa, Glycine max
MAKPGVLESDPGVMVKKAKELKRELQRLVKSIVHDEDCSTETIDQAKETLCVLKELKLRNRSSLSLKLHNKSVASSCPDEFKCPLSKELMRDPVIVASGQTYDRPFIQKWLNAGNRTCPRTHQVLSHTVLTPNHLIREMIEQWSKNQGIELSNTVQYIDEEGLNEADREHFLCLLKKMSSTLSDQKTAAKELRLLTKKHPCFRVLFCDSADAIPQLLKPICGSDSFGSVHPDLQEDVITTLLNISIHDNNKKLVAETPMVIPLLMRALRSGTIETRSNAAAALFTLSALDSNKELIGKSGVLKPLIDLLEEGHPLAMKDVASAIFNICVMHENKARAEKDGAVRVILAKINKQIHVAELLAILALLSSHQRAVHDMGDLGAVPSLLRIIRESSCERNKENCVAILQTICLYDRSKLKEIREEENSHKTISELAKHGTSRAKRKASGILERLNRAVNITHTA

SEQ ID NO: 72403 - protein, 202 aa, Vitis vinifera
MINEVSQCVESINGVKEGRWKATLTFYKPMFRDQAVPAEYPRDFLGISLPEQPNRYYFIIRSQKIVLEADSSIQMIMEKLQSYKSRVSLTFEGFQYQLGDFQLRVGKVAPSASENLRGIVFEVEYLPLSSMEKSRQILDGFVEIWQEAMSKRSLPGHFMHIEPNFAEFGLSDHYTSQHTAVQYATVMAQLISAVQTAQGVRN

SEQ ID NO: 72404 - protein, 292 aa, Exiguobacterium sibiricum 255-15
MKQISVVGSISMDLVVESDRRPSAGETVIGSAFHTVPGGKGANQAVAIARLGGHVEMVGCIGDDANGVAIRQNFETEHVGTTHLQTIADQRTGTAHITLAEGDNSIVVVQSANLAVVYDENQLDSLLGQADMILLQLEIPLATVKQVARYGKTHGIPVVLNPAPAIVLDDELLADVTYLTPNEHECGLIFGQQQPLEHWLTQYPNKLIVTEGSRGARFYDGEAIVTVPAIKTDVVDTTGAGDTFNGALAVSLTDGATLTEAIRFANKAAGMSVRALGAQGGMPTHEQMEVEA

SEQ ID NO: 72405 - protein, 541 aa, Bacillus anthracis str. Ames
MITVSNVSLRFADRKLFEGVNIKFTPGNCYGLIGANGAGKSTFLKILSGEIEPSTGDIHITPGERLAVLKQNHFEYEEFPVLETVIMGHTQLYKVMQEKNAIYMKEDFSDEDGMRAAELEGEFAELNGWEAESEAAILLKGLGIGEDLHDKKLSELTGAEKVKVLLAQALFGKPDILLLDEPTNHLDLKAIQWLENFLMNFENTVIVVSHDRHFLNKVCTHMADLDFGKIQLYVGNYDFWHESSQLALKLTQDANKKKEEKVKELQNFIARFSSNASKAKQATSRKKLLDKITLDDIRPSSRRYPFVGFTPEREVGNDLLTVEGLSKTIDGEKVLDNVYFTLNKGDKVAFIGRNDIAMTTLFKILMGEMEPDSGSFKWGVTTSQSYFPRDNSKYFENSDLNLVEWLRQFSPQDESESFLRGFLGRMLFSGEEVKKNVSVLSGGEKVRCMLSKMMLSGANVITLDDPTNHLDLESITALNNGLIAFKGTMLFTSHDHQFVQTIANRIIEVTPNGVIDKEATYDEFLENEELQKQVDAMYKGQ

SEQ ID NO: 72406 - protein, 461 aa, Escherichia coli
  misc_feature (193)..(193): Xaa can be any naturally occurring amino acid
MADNKPELQRGLEARHIELIALGGTIGVGLFMGAASTLKWAGPSVLLAYIIAGLFVFFIMRSMGEMLFLEPVTVAFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGXFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 72407 - protein, 573 aa, Rhodococcus sp. RHA1
MTSTTDASPAAVDAAPARTRTAKPARRRAEGQWALGYREPLNANEQAKKDDNPLNVRARIENIYSKQGFDSIDKGDLRGRMRWWGLYTQREQGYDGTFTGDENIDLLEAKYFMMRVRCDAGALNVEQLRTIAGISTEFARDTADLSDRENVQYHWVEVENVPEIWKRLEGVGLKTTEACGDCPRVVLGSPLAGESLTEVLDPTPAIDEIVRRYIGKPEYSNLPRKFKTAISGQQDVVHEINDVAFVGVNHPEHGPGLDLWVGGGLSTNPMLAQRVGVWVPLDEVPDVWEAVVSIFRDYGYRRLRNKARLKFLVKDWGIERFREVLETEYLKRKLIDGPAPEKPTRPIDHVGVQKTRNGLNAVGVAPIAGRVSGTILAKVADAAERAGSDKIRFTPYQKLIILDVADDKLEQLIADLDEVGLPARPSHWRKNLMACSGIEFCKLSFAETRKRSQVLVPELEQRLADINAQLDVPITININGCPNSCARSQVADIGFKGMLVDDGEGNQVEGFQVHLGGSLGFDSAFGRKLRQHKVTSTELGDYIDRVVRHFVKHRNEGERFAEWVVRADEGDLR

SEQ ID NO: 72408 - protein, 300 aa, Burkholderia thailandensis E264
MAYKTIEDTIGNTPLVQIVRLPDDEIRARNNVILAKLEGNNPAGSVKDRPALSMIRKAEERGRIKPGDTLIEATSGNTGIALAMVAAIRGYKMVLIMPEDLSVERRQSMAAYGAEIVLTPVKGGMEFARDLADQMQREGKGVILDQFANPDNPLAHYEGTGPEIWRETEGRITHFVSAMGTTGTIMGTSQYLKERNPAVEIVGAQPEEGSRIPGIRKWPEAYLPKIFDRSRIDRVENVSQAASEAMARKLAAVEGIFCGISSGGACEVALRVARQVENATIVFVVCDRGDRYLSTGVFPA

SEQ ID NO: 72409 - protein, 430 aa, Exiguobacterium sibiricum 255-15
MSMITEIYAREILDSRGNPTVEVEVYTEDGGFGRALVPSGASTGEHEAVELRDGDKSRYLGKGVLKAVDNVNEKLAPEIIGYDVFDQAGIDKKMIDLDGTKNKGNFGANAILGISMAAARAAADELGLPLYTYLGGFNAKTLPTPMMNIINGGSHADNNVDFQEFMIMPVGAPTFKEALRMGAEIFHALKSVLSGMGLNTAVGDEGGFAPNLKSNEEAITVILEAIEKAGYKAGEDVYLAMDVASSEFYDKAAGKYNLAGEGKVLSTEELVEFYAQLVDKYPIISIEDGCDENDWDGHKLLTDRIGHKVQLVGDDLFVTNTEKLAEGIEKGIANSILIKVNQIGTLTETFDAIEMAKKAGYTAVVSHRSGETEDSTIADIAVATNAGQIKTGSLSRTDRIAKYNQLLRIEDMLSDVAVYDGIKSFYNLKK

SEQ ID NO: 72410 - protein, 515 aa, Exiguobacterium sibiricum 255-15
MKKRPVALIILDGFGMRDEEFGNAVTAANKPNFDRYWEQYPHTLLNAKGEYVGLPEGQMGNSEVGHLNIGAGRVVYQSLSRINNAIKDRSFFSRQAMNDAAGHVKKYGSALHIFGLVSDGGIHSHINHLYAVLEFAKLHEIEKVYLHAFTDGRDCDPQSGAGFLRDAQAKMDELNVGQFASVSGRYYAMDRDNRWERVKKVYDVITFADGPTTKDPIAMVEASYKTDVTDEFIEPTVVVQEDGTPVAPIHDNDAIMFFNYRPDRAIQLAKTYKEKTGFTGFELPDNVPKNLLLVSMTKYSDAIDTDIVFPPEDIKNTLGETLSKQGLKQLRIAETEKYPHVTFFFNGQREEPYEGEDRILIPSPKVATYDLKPEMSVYEVTEALVDAINSDKHDAIILNFANPDMVGHSGMLEPTKKAIEAVDKCLGQVVDLIISKGGAAIITADHGNADKVLNADGSKMTAHTTEPVPCIVTVEDVELLKPLTGVLADLAPTVLDLLGADQPAEMTGKSIVLKK

SEQ ID NO: 72411 - protein, 115 aa, Ralstonia solanacearum GMI1000
MTHKGSCHCGRIAFEVDGEPGSAMACNCSICQRKGSLLWFVPREHLHLLTPDENASTYTFNKHVIRHRFCPVCGMHPYGEGTGADGKAMVAINIRCLEDIDLAAVPVTQFDGRSR

SEQ ID NO: 72412 - protein, 219 aa, Myxococcus xanthus DK 1622
MSRRPVRISPSLLSCDFGRLAEEVRAIEAAGADWIHVDVMDGRFVPNITIGPVVVEAIKRVATKPLDVHLMIVEPERYVEAFVKAGADVLTVHVEASPHLHRTLQQIRNAGAKPAVVLNPGTPLSAIEEVLGDVDMVLLMSVNPGFGGQSFIESTVERVRRLRGMLDARGLKDVDIEVDGGINATTAKRVVEAGATVLVAGSYVFGSKDYAEAIRSLRS

SEQ ID NO: 72413 - protein, 583 aa, Pseudoalteromonas tunicata D2
MYKLSSYLLCALLPLSVLSQTPVREDREPEAKTGFEIKKTVIGQKYMVAAANPYAVKAGQAMLEQGGSAVDAAIAVQLVLTLVEPQSSGIGGGAFILHYDQQKNTLITYDGRETAPATATPELFLDNNGKAVPWIKAVVGGRSVGVPGVLAALAKAHAKDGKLPWASLFKPAIELAEQGFVVSPRLALLLKKQFNPGVHQLAVTKDYFFPNGEALKAGTIKKNPELAAFYRTLAKEGISAFYQGDNAKKLAETVQNSAVAPGLLTEQDVNNYQAKLREPVCAPYHQYKVCSMGPPSSGGIAVLEMLSLLEQKNLKQYQPNDVMALHYFTQASRLAFADRDVYLGDPDFVSLDVMRLLDKEYINTRAKLITDKDMGEASVGEPNIKLAFAKDDAYEMPSTSHMSIIDAKGNAISMTTSIEMAFGSALMTNGYLLNNQLTDFALSPHKNGKPLINRVEGNKRPRSSMSPMMVFNADGSLRLIVGSPGGSRIINYVAQTIIGVLDWQLSLQQAIDLPKITNRNKITSLEKDTALVDAKTTFEQLGHTVQMVDLNSGLHGIEVINGKYYGGADPRREGIVLSDLTTH

SEQ ID NO: 72414 - protein, 564 aa, Pseudoalteromonas tunicata D2
MTNKDTKNFLYIPHSGPKLIETPLLNKGSAFTKRERESFNLMGLLPPRFESIEEQVKRCYQQYSSFTDNLNKHIYLRAIQDNNETLYYRLVRDHLEEMMPIIYTPTVGDACEQFSDIYRSARGLFISYEDRHQIDDILRNATKGKVKVIVVTDGERILGLGDQGIGGMGIPIGKLSLYTACGGISPAYTLPVMLDVGTNNEKLLNDPMYMGARHKRIGQEEYDEFLDLFINAVKRRWPNVLLQFEDFAQPNAMPLLKRYRNEICSFNDDIQGTAAITVGSLLAACRVKGEKLSDQTVAFVGAGSAGCGIAEQIISQMVFEGISDAQARSQIFMVDRFGLLTDGMADLRDFQQALVQNDTTLADWTFSGEYASLLDVMHCAKPHILIGVSGQPGLFTEQVIRAMYQGCERPIIFPLSNPSKQVEAVPHDVIHWTEGQAIVATGSPFSPVEYDGKTFPIPQCNNSYIFPGIGLGVIAAKAKTITDEMLMVSSETLAASSPLANTGKGSLLPALTQIEALSKEIAFAVAKKAIEQGVALEISDDALRSAIDKNYWLPQYRDYKRVSI

SEQ ID NO: 72415 - protein, 411 aa, Rhodopseudomonas palustris CGA009
MPTHDGCKEKTMPFLATALDRVKPSATIAVTDKARELKAAGRNVIGLGSGEPDFDTPANIKLAAIHAVEAGKTKYTAVDGIPELKQAIIDKFKRENGLTYKPNQIIVGTGGKQVLYNALMATINPGDEVIIPAPYWVSYPEMVALAGGESVPVVCTAEFGFKLQPAALEAAITPKTKWIILNSPSNPTGAAYSRAELKALTDVLVKHPHVWVMTDDMYEHLVYDDFEFTTPAQIEPKLFDRTLTVNGVSKSYCMTGWRIGYAGGPAELIKAMSTIQSQSTSNPCSIAQWAAVEALNGPQDFIDAHNKVFKERRDLVVSMLNQATGIDCPRPEGAFYVYPSCAGTIGKTAPSGKKIETDQDFVTELLEAEGVAVVQGSAFGLGPAFRISYATKTSDLEDACKRIQRFCGNLR

SEQ ID NO: 72416 - protein, 325 aa, Listeria monocytogenes str. 4b H7858
MNLNKHSERKFDLITVGRACIDLNAVEYNRPMEETMTFSKYVGGSPANIAIGTAKLGLKVGFIGKISADQHGRFIEKYMRDLNINTDGMVKDTEGRKVGLAFTEIKSPDECSILMYRENVADLYLTPEEISEDYIKEARVLLISGTALAQSPSREAVLKAVSLARKNDVAVAFELDYRPYTWTNTEETAVYYSLVAEQADVIIGTRDEFDMMENQVGGKNEATKAHLFQHQAEIVVIKHGVEGSFAYTKAGETFQAKAYKTKVLKTFGAGDSYASAFLYGLFSGESIETALKYGSAAASIVVSKHSSSDAMPTADEIKALIAQAE

SEQ ID NO: 72417 - protein, 96 aa, Synechocystis sp.
ASYTVKLITPDGESSIECSDDTYILDAAEEAGLELPYSCRAGACSTCAGKITAGSVDQSDQSFLDDDQIEAGYVLTCVAYPTSDCTIETHKEEDLY

SEQ ID NO: 72418 - protein, 522 aa, Arabidopsis thaliana
  misc_feature (169)..(169): Xaa can be any naturally occurring amino acid
MTVMVSFDLLNCFIFTLIFLISTLFLFVLFYKKPNDGFDVPPSPPSLPIIGHLHLLLFASIHKCFQKISSKYGPFLHLRIFHVPIVLVSSASTAYDIFKTNDINVSYRGDVAIDECIVFGSFGYFRAPCEDYWKFMRKLIMARALGPQALERTRGVRAAELERFHKKIXLDRALKKQSLKIGEEARILVNNTLGKKSLGSSFSIENNDGTKVSEYSIKLADLSQMFCVAQIFHKPLEKLGISLLKKQIMDVSHKFEELLENIVVKYEEKMDNHQSTEFMDALLAAYQDENAEYKITRNHIKALLAELFFGAGESSSSTTRWAMGEIFNNPRIFEKLRTEIDSVVGTTRLIQESDLPKLPYLQAVVKESLRLHPVGAVLPREFTQDCNIGGFYIHEGTSLVVNAYAVMRDPDIWEDPNEFKPERFLDASRLGQEEEKKEKTLKFLPFGAGRRGCPGLYLGYTLVETTIGVMVQCFDWEIEGDKVNMQEGSGLRFFLDLAHPLKCTPIPRIINHEPSNTQIPNS

SEQ ID NO: 72419 - protein, 472 aa, Myxococcus xanthus DK 1622
MARYDFDLFTIGGGSGGVAASRRAGAHGAGVALCEDRDVGGTCVHRGCVPKKLLVYGAHFREEFQDAEGYGWTVQEPLFTWSKLLAAKDKELDRLRGVYARLLRDSGVTLLEGRGRVVDPHTVEVAGKLYTAERILIATGSRPYLPPDITGIEHAITSDEALSFPELPRRLAVVGAGYIGVELAGVFHGLGSKVTMLIRGASVLGGFDDDVRSFLTDEMRKKGIELMTDTFIRDIEKRAEGGVSLLTGGGETVEADAVLFATGRVPNSGGLGLEEVGVTLDARGAVVVDAWSRTSVESIYAVGDITDRINLTPVAISEGRALAETLFNDNPTQMDHTNVPSAVFSQPPVASVGLTEQEARERHGKLDIYVTSFRPMKHTLSGRNERTMMKVVVERESNRVLGCHMVGTDAPEIIQGLAVAVKCGVTKKQLDATVGIHPTAAEEFVTLRDKRPDPDERLAAELGRDAAASTRR

SEQ ID NO: 72420 - protein, 322 aa, Ralstonia solanacearum GMI1000
MAVDPQILQFHQRLAERFGALPLPADALARRARFAAVAEVLARPDPEGIEASDLTLPLPGRTLDAVMFRPRSVQRPRLLVWFHGEGWMVGAARTTHRLMCALLAADTGCAVISVDYRLAPEHPFPAPTDDARDALAYLAEQRLHLSLDPDFLAVGGDSAGGHLAAQAAQAVHDRVRQGLVTAQLLVCPATMPAFGSESYSAFAQGPGLTRDEMRWYWAQFIGEAALDRPLAEQDARLFLMADPPAHLPPDTVVIVAAHDVLRDDGLAYADHLVQHGAQVVTIEASGMTHGFARLQPEAERAREWMRRAAHAFVGMIGGDAAG

SEQ ID NO: 72421 - protein, 356 aa, Myxococcus xanthus DK 1622
MARIAVIPGDGIGIEVTREVMRILQVLDAEMRLGLSLEAFDFGAERFLRTGVGLPPGQMDVFRTEFDAILLGAMGDPRVPDNAHAREILLGLRFGLDLYVNFRPCSPLAERLSPLKGKGPQEIDMTIFRENTEGIYGAIGGSFKRGTLDEVAIAEEIHTRKGVERIIRAAFKWASAHGKRHVALGDKSNAIAAHGLWLRTFREVAAEYPQIEARHYYVDALALQMVTRPESLQVIVTTNLFGDILTDLGAALSGGLGVAPSANLNPDSTPLFEPVHGSAPELTGKGLANPAAMVLSAALMLEHLGQAGAARRLSTAVQQTVAEGQCTRDVGGTLSTTEAADAILDRMLQGLRRTRT

SEQ ID NO: 72422 - protein, 67 aa, Arabidopsis thaliana
MDPCHSLIHTDDVPATPKANNDITYITSNGGRANCMQEWPPIGKKKYETVYNLTDLTESELANDVDY

SEQ ID NO: 72423 - protein, 398 aa, Bordetella bronchiseptica RB50
MFALNPHPSGRHFLQIPGPTNVPDRVLRAIDQPTIDHRGPAFGQLGLAVLAGLKHVFRTESPVLIFPASGTGAWEAALVNTLSPGDTVLMAETGHFASLWRRLAGRLGLEVDCLESDWRHPADPQAIGARLAQDTQHRIKAVCVVHNETSTGVTSDIAAVRAAIDQAGHPALLMVDTISSLGSIDYRHDEWGVDVTVAGSQKGLMLPPGLSFNAIGPRALAAAGQARLPRSYWDWREMLVANERGYFPYTPATNLLYGLHEALAMLREEGLPQVYARHRRHAHATRLAVAAWELELLCLDPAQCSPALTAVLMPGGHSADAFRQRALERFDISLGQGLGKLADRVFRIGHLGYFNDLMLCGTLAGVEMGLAAAGVPHRAGGVQAAMAFLAQTPAGQPA

SEQ ID NO: 72424 - protein, 317 aa, Corynebacterium glutamicum ATCC 13032
MNRDSFQSIDELIGKTPLVRLGRFNANTSINLWAKMESYNPGGSAKDRTAHAMVLASDLRPGDTVVESSSGNLGIALSREAVLGGWTFHCVVDSRANRNTIAHMKALGTIVHEITEPDYETGDWLVARRKRVAQLRAQMSEAICLDQYSNTAAFQAHEQGTMTEIVEQLGGAPDYLLVAVSTTGTIGGCLGYVAAHGLSTQVIAVDAVGSVLFDGNAGPRHLPGFGAGMVPELSKHLSPHRVFRIDDRTSVEAARKMAQTEAILPGASGGAVLAAMEILRPDIPAGSNVVVILHDDGNKYLDTIYNDEWVEENLCSR

SEQ ID NO: 72425 - protein, 375 aa, Triticum aestivum
  misc_feature (22)..(22): Xaa can be any naturally occurring amino acid
  misc_feature (30)..(30): Xaa can be any naturally occurring amino acid
  misc_feature (296)..(296): Xaa can be any naturally occurring amino acid
  misc_feature (341)..(341): Xaa can be any naturally occurring amino acid
  misc_feature (361)..(361): Xaa can be any naturally occurring amino acid
VGNVHPNVTESLLIEVFQGSGXLMERCKLXRKEKSSFGFVDYYDRRSAALAIMTLHGRHIYGQAIKVNWAYASTQREDTSGHFHIFVGDLSSEVNDATLYACFSTYPSCSDARVMWDNKTGRSRGYGFVSFRNQQEAETAITEMTGKWLGSRQIRCNWATKTNAEEKQETDNHNAVVLTNGGSSNAAMEANQDTGSKENPENNPDFTTVYVGNLGHEVNRDELHRHFYNLGVGAIEEVRVQQEKGFGFIRYTTHGEAALAIQMANGLVVRGKPIKCSWGNKPTPPGTSSKPLPPPXASYQPVAMAGVPQGFTAAELLAYQRQLALSQAAAGQIAGQHGLAXGQVSCGATRLLGSQALYDGXTPNQTSAQQLMYYN

SEQ ID NO: 72426 - protein, 792 aa, Coccidioides immitis RS
MMEASDSWTPTFVVGQHESDRKLPVSLDTVQRAHDCNYDVVTTPITTSEFHSNVLTLIGSHLCSLERPVQDACGTLATSQNTKPLTIPSLSLSDSHLSPNGSLGNVIAITSKWIDLCSPDPLIADVSRQILMHEVAYAAFCGVSYVIIQGPRLHHGSLRGEGLMYYARTIQEVLNVAPYIQVHIWFQMTDNPSAETTDIGNLAPFARAEYLHQQDPTVSTDPDQFGTWDAWDAVRRVCKHHSRLFVALTLPKYLPSAPVQSRWLSEPVHILTIDGNVFVKNQKGYPVLSRVHQGLISRFMRLKVQPWIILCDVGPIPDPFQQSDESPTPAEAVQRLGPNFSKKSYDPTPHLSYIRNLQTKQPPRTPMERFGVGYQDFLQAPLQPLTVNLESVTYEVFEKDPIKYEWYERAIAKALKDWIAKKKTTSSPDGRVVVAVVGAGRGPLVTRAIRASVEAGVDIEMWAVEKNQNAFVHLQRQNKTIWAGSVNLCQSDMRSWKGPHRVALRGPDGQDASTLHYPVDIFVSELLGSFGDNELSPECLDGVTHLLNPDHGISIPASYSAHLTPISSPRLHADVTAQSASNPAAPETPYVVMLHAFDFLSTVQPASGTASPKSSNGQNSLPSNKITKTPTPPPTFETPTPIVHTAWSFSHPNSNIPPPSRSSSVLSNAHNVRQTRLTFPCRERGVCHGLGGYFETVLYDDVELSTNPVTMDTKSEGMISWFPIYFPLKTPLHVPENSEAVVTMYRQTDDRKVWYEWIVEVYELREATGNGVRKLRVAMSEFHSSIKDGCLM

SEQ ID NO: 72427 - protein, 430 aa, Methylococcus capsulatus str. Bath
MSTAPAAAVSVHAAETLLFFTLLQLAVIVLIGRIGGALAWRAGQSPVVGEIIGGIVLGPSLFGLLSPDIFRFVFRSAPPEPLTILSQLGLILLMFQIGLEFDFSHLKERRNRRAVRNVALVGLVLPFVLGLGFGYQTAPLLSPDADRLASALFIATAFSITALPILGRIMIEFGMTDHKLGVIAISVAAINDVVGWLLLALVTTLTVAEYSHAEFALKVGLVAAFVVLGWFVVRPVMKWLVRRFQRSEAGLPGNLLGVLLAGIFLAGMCTYKLGIFAIFGGFMMGVVLHDEPTLRAAWKEKVGHFVTVFFLPIFFTFTGLRTEIGGLDTLQLWGWCALIILLATLGKLGGAYFAARLSGLSRSESGILGILMNTRGLMELIVLNVGYDLGVISRNVFTMLVLMAIVSTVLTTPCLRAWLPKAGFASSGRR

SEQ ID NO: 72428 - protein, 725 aa, Ralstonia eutropha JMP134
MSIIVDVLVLAGVLLAIVAVVQVAAARLVLPESTLLSAIGIAIGAGYVAIDAAHPAFAQHFLHPLIDPELPPEAYLWIFLPPLLFHAALTADVRSMLPDAAPILLLAVVAVIVATGVIGVATSAASGMPLAACLLLGAVVATTDPAAVIAIFRDVGAPARLIRLVEGESLLNDAAAIAIVGVLVAMLTGHSAQATLGAGVRELAWSFIGGVLCGALAGRLVAEVLPRLSGLAMAESALTLALPYPLYLLADQLLDVSGVVAVVCAGLMVSALGPTRLTPANWRHLRMIWEQFAGIAGAVVFLLAAVRVPSLLAGVTPHHGWLLLVLVAAALGARLLTLFGLLPVLSWLRLSAPISGAFKLAIAWGGLRGAVTLVLALGIAENTALPLQVRHFIAILATGFVLVSLLLNGTTLRALIHRLGLNQLSPQERALQQQAIRLSTEEVEAMLGRVAETFDLPPAAAREVAQHYRRGIELGSVEFDFDSALSERDRLTIGLVTLATRERELIPEYGDGVISVANLDAMMRNTSHMIDAAREQGRIGYKRAARAILQYHLGYRIAFFLHKWLGLDRPLARALADRFELLICRQTVLDRLRRYNRSLLTPVFGARMTTVLDGVLEERFHSAGEGLAQMREQFGDYTVALERRLLMLFALRKGQRSLATMREEAVISKEAFNQIDQIMQHAWQANLVRPPLRAAPDRWARWHKPPQTETRTPEETMPEPPRERR

SEQ ID NO: 72429 - protein, 246 aa, Methanopyrus kandleri AV19
MEVIKVGGEVLDRVEDLARVIDDSILVHGGGPEVSDVMERMGLEPRFVRGLRVTDRETLQVVMMVLAGLVNKRLVAELRSEGINALGLSGVDGGLLIAEKRSEVVDGEEVDLGYVGDVKRVNAELLESLLDAGYVPVVAPLGAGEDGTVYNVNADTAAGAIAGAVRADRLVLLTDVPGVLEDLDDPETLIERVRPEDVEELEEKGIVTGGMVPKLEAAKMAVEAGCREAVITNLEGLLEGRGTIVR

SEQ ID NO: 72430 - protein, 381 aa, Thermococcus kodakarensis KOD1
MKLKCPICGKTYDEPVQRCECGEPVEFEAFNAEPYLGKTVWERFWDFWPIEPAMDLSLGEGDTPLVKSKLGKELGVKLYLKNETANPTWSFKDRGTFLAVSYAVKAGYKAIGTVSTGNMAASVAAYAARAGLKAKILVSESASEEKLKTVSVYGADVIRVRGDYGRLYFESLELGEKLGIYFINSDNPFRVEGYKGIAFEMAEELTPDYVLIPTSSGGLFRGIAKGFIELKESGLIEKLPTLIAVQAEGCSPICRAFNEGNERIKRFENPNTIAKAIANPYPPSGNAVLKLLRDLGWKCTTVSDEEILEAQRELAKEGLFVQPASATGIAVLKKLVESEKIDEGAKVVSILTGSGLKVLAHMPSGKIVNCPLEGLENCVSF

SEQ ID NO: 72431 - protein, 250 aa, Exiguobacterium sibiricum 255-15
MRKPIIAGNWKMNLTLKDAVAFAEEVKGTVPASSKVDAAVCAPSVFLAHLTEATAGTDLKIGAQNMYDQESGAFTGEISPVMLKELGVTYVVLGHSERREYFGETDAFINSKTKKAFEHGLVPIVCVGETLEEREGGKFESVIREQTTNSLKGLTVDQVKNLVVAYEPVWAIGTGKSATEQDAQDSCKFVRDVIAAEFGTEAAEAVRIQYGGSVKPDNIKEYMAQPDIDGALVGGASLETGSFLKLLEAI

SEQ ID NO: 72432 - protein, 285 aa, Spinacia oleracea
MSAASLCQSTLQSQINGFCGGLNIRKLQPSTSSPNSLTFTRRKVQTLVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCELASTIHLHRTVNQIKSLGAKAGVVLNPGTPLSTIEYVLDVVDLVLIMSVNPGFGGQSFIESQVKKISDLRKMCVEKGVNPWIEVDGGVTPANAYKVIEAGANALVAGSAVFGAKDYAEAIKGIKASKRPEPVAV

SEQ ID NO: 72433 - protein, 394 aa, Exiguobacterium sibiricum 255-15
MNKKSIRDIDVKGKRVFTRVDFNVPLEDGKITDDTRIRAALPTIKHLVDGGAKVILASHMGRPKGEKNPEFSLAPVVARLSELLGKDIKLVEEAYGPVAEEAVSKLEEGDVIVLENVRFYPGETKNDPELAEGFAKLADVFVNDAFGAAHRAHASTEGIAHHVETAVAGLLIEKELQVLGKALSNPDRPFTAIIGGSKVADKIGVIDHLLDIVDTLIIGGGLSYTFLKAQGYEVGTSLLEVDKIEQAKEFMKKAEDKGVKFLMPVDCVITKEFGEETYVGSRDIDSIPADHMSLDIGPKTVELYAEAIKASKLVVWNGPMGVFELDKYANGTKGVAQALADSDAYSIIGGGDSAAAAEKFGLADKMSHISTGGGASLEFMEGKALPGVEALNDK

SEQ ID NO: 72434 - protein, 335 aa, Exiguobacterium sibiricum 255-15
MAVKVGINGFGRIGRLALRQILQFDGIEVVAINDLTDTKMLAHLLKYDTTQGRFDGEVEVHDGYFLVNGKEIKTLANRNPEELPWGELGVDIVLECTGFFTDKEKAELHLKAGAKKVVISAPATGDMKTVVFNTNHEILDGTETVISGASCTTNCLAPMAKVLQDNYGIVQGLMTTIHAYTGDQNTLDAPHPKGDFRRARAAAANIVPNSTGAAKAIGLVLPELQGKLDGAAQRVPVATGSLTELTTVLEKKVTVEEVNAAMKAAANESYGYTEDEIVSSDIVGISYGSLFDATQTKVVTVGDKQLVKTVAWYDNEMSYTSQLIRTLKHFAEIAK

SEQ ID NO: 72435 - protein, 714 aa, Klebsiella pneumoniae subsp. pneumoniae MGH 78578
MDTVSAFKLEVRADKIAVITIDAPGEKMNTLKAEFGSQVRGLIRQLRDDKSVRGVVFISAKADNFIAGADINMIARCRSAQEAEALARQGQQIMAEIHGLSIPVIAAIHGACLGGGLELALACHGRICSDDEKTRLGLPEVQLGLLPGSGGTQRLPRLIGVSTALDMMLTGKQLRPRQALKAGLVDEVVPQAILLQAAVELALKGRPTSREVPVRERVLAGPLGRHLLFQFVGKQTQRKTQGNYPAVKRILQVVENGLAHGCSSGYAEEARAFGELAMSPQSQALRSIFFASTDLKKDPGAEAGPGSLRSVAVLGGGLMGGGIAYVTACKGGLPVRIKDIQPRGINHALKYSWDLLNKQVRQRRLRPVERDRQMALISGTTDYQGFAHRDVVIEAVFEDLALKQRMVSEVEQYGGPQTIFASNTSSLPIGDIAAHASRPGQVIGLHFFSPVEKMPLVEMIPHKGTDPQTIATVVQLAKRQGKTPIVVADKAGFYVNRILAPYINEAMRLLVEGEPIEVIDNALVKFGFPVGPIQLLDEVGIDTGTKIIPVLESAFGERFSPPANIIDAILKDDRKGRKNNRGFYLYETKGRKSKKRPDPAVYPLLGIGRPQSRLSAQQVAERCVMMMLNEAARCFDEQIIRSARDGDIGAVFGIGFPPFLGGPFRYMDTIGAGEVAAILQRLAAQFGPRFTPCDTLLRMAEQGTTFWPADERLT

SEQ ID NO: 72436 - protein, 421 aa, Acidovorax sp. JS42
MAIVEVKVPQLSESVAEATLLQWKKKPGEAVAIDEILIEIETDKVVLEVPAPAAGVMAEIVVADGGTVASDQVIAKIDTEGKAGAAAPAAAAAAPAPAAASAPAAAAPAAAGGSKGDVAMPAAAKLLADNNLSVGDVTGSGKDGRVTKGDVLAAVAGGVKSTAAVIPTGVPTKALPQVAAPASKEELGERPEQRVPMSRLRARVAERLLQSQSTNAILTTFNEVNMAPVMDLRKKFQDAFTKEHGVKLGFMSFFVKAAVHALKKYPVLNASVDGNDIVYHGYFDIGIAVGSPRGLVVPILRNADQMSFADIEKKIAEFGKKAADGKLGIEEMTGGTFSISNGGTFGSMMSTPIINPPQSAILGVHATKDRAVVENGQVVVRPMNYLAMSYDHRIIDGREAVLGLVAMKDALEDPSRLLFDL

SEQ ID NO: 72437 - protein, 432 aa, Burkholderia thailandensis E264
MQLLTIGINHHTAPVALRERVAFPLEQIKPALSTFKSVFLGHPAPNAPEAAILSTCNRTELYCATDDRAARDAAIRWMSDYHRIPADELAPHVYALPQSEAVRHAFRVASGLDSMVLGETQILGQMKNAVRTASEAGSLGTYLNQLFQRTFAVAKEVRGTTEIGAQSVSMAAAAVRLAQRIFEQVAQQRVLFIGAGEMIELCATHFAAQGPRELVVANRTAERGAKLAERFGGRAMPLSDLPARMHEFDIIVSCTASTLPIIGLGAVERAVKARRHRPIFMVDLAVPRDIEPEVGKLKDVFLYTVDDLGAIVREGNASRQAAVAQAEAIIETRVQNFMQWLDARSIVPVIRHMHTQADALRRAELERARKMLARGDDPAAVLDALSQALTNKLIHGPTSALNRANGADRDSLIDLMRGFYQHAPRSSDTSDH

SEQ ID NO: 72438 - protein, 475 aa, Acidovorax sp. JS42
MSKQFDVIVIGAGPGGYIAAIRAAQLGMNVACIDEWKNAAGGAAPGGTCTNVGCIPSKALLQSSEHFEHANLHFADHGITATDVKMDVAKMIARKDNVVKQNNDGILYLFKKNKVTFFHGRGSFVKAVDGGYEIKVTGKAEETLTAKQVIVATGSNARALPGAAFDEEQILSNDGALAIGSVPKKLGVIGSGVIGLEMGSVWRRLGADVTILEGLPTFLGAVDEQIAKEAKKAFDKQGLKIELGVKIGEVKTGKKGVSIAYTNAKGEAQALEVDKLIVSIGRVPNTTGLNAEGVGLKLDERGAVVVDGDCKTNLPGVWAVGDVVRGPMLAHKAEEEGVAVAERMAGQHGHVNFNTIPWVIYTSPEIAWVGRTEQQLKADGVKYKAGTFPFLANGRARALGDTTGMVKFLADAATDEILGVHIVGPMASELIAEAVVAMEFKASSEDIARICHAHPSLSEATKEAALAVDKRTLNF

SEQ ID NO: 72439 - protein, 475 aa, Glycine max
MAAMQRPLKRTIAIAKLRACFSSLRPAAAADIVASPPPQLPPFDHQPHPYNGPFADEVLAKRKTFLGPSVFHYYKKPLNIVEGKMQYLYDDSGRRYLDAFAGIVTVSCGHCHPEILNAITEQSKLLQHATTIYLHHTIGDFAESLAAKMPGNLKVVYFVNSGSEANELAMMMARLYTGSLGMISLRNAYHGGSSSTLGLTALNTWKYPIPEGHVHHVMNPDPYRGAFGADAASYANDVQDHIDYGTSGKVAGFIAETMQGVGGAVELAPGYLKLVYDIIHKAGGVCIADEVQTGFGRTGSHYWGFETQGVIPDIVTMAKGIGNGLPLGAVVTTPEIASVLAQKIQFNTFGGNPVCSAGGLAVLRVLDKEKRQAHCADVGSHLLERLRFLMERHDIIGNVRGRGLMVGIELVTDRDNKTPAKAETAVVFEKLRELGVLVGKGGLHGNVFRIKPPMCFSKDDADFLVDALDYSLSKL

SEQ ID NO: 72440 - protein, 546 aa, Zea mays
  misc_feature (537)..(537): Xaa can be any naturally occurring amino acid
MCAFSGRLRTLVKQEKKKKKGGGRKEAVSINLAGGFPGGADGFELVARFCYNDGRVLLCTSNLPLLHCAAVSLEMTEEAFVNGLYYWTWGDVLAAVRSCEPFAAAADASGLLDRLISALFSKITGATPGPGPGTPNRSSSSCSSSPDTAGLRRSSSSANKTPDSMRPCAGREWWFDDMTSLSPPTVEKVMRVLGCYGVENKNLILTRFLLHYLRAATRRPPALEREGAALAGLAETAVHGVALVGGTAFSCRGLFWVLRIVSAVGLSRECRHKLERLMGLMLDQATLDDLLVSGDDGGGVYDVNLVMRLVRVFVASEEEADAPSERMRKVGRLVDKYLGEISPDQGLKVSKFLAVAESLPDSARDCYDGVYRALDIYLESHPALSLEERTTLCRCLNYEKLTLEACKDLAKNRRIPPGVAVQALASQQCKLHISEPGPGGSATAAAGKERRPDPSSCSQSQTPRRRVARRATRSVDLGRRSGGDDDEKELLRLNLQRMQSRVVELERACKEMKGQMSRMAKGKSLSLSFGSGAASCXHQTGGRGLP

SEQ ID NO: 72441 - protein, 226 aa, Vitis vinifera
MSFLFGKKKTPAELLRENKRMLDKSIREIERERQGLQAQEKKLIVEIKKSAKQGQMGAVKVMAKDLIRTRHQIEKFYKLKSQLQGVALRIQTLKSTQAMGQAMKGVTKAMGQMNRQMNLPSLQKIMQEFERQNEKMEMTMEVMGDAVDDALEGDEEEEETEELVSQVLDEIGIDIKSELLNAPSAAVAAPAAKNKVAQAEATGTTGNDDSGIDNDLQARLDNLRRM

SEQ ID NO: 72442 - protein, 494 aa, Salmonella enterica subsp. enterica serovar Paratyphi A str.
MSDVTLLAEVTTFLRQRHGQFIAGERQAGNGTNFSVTNPATGKIIADVVSATPTQAEEAMQSARRAFDVWRKMPTLQRGALLLKLADTLAAHREELAQLESVCSGKTILLSRGLELDQSVAFLRYFAGWAGKITGETLNVSLPSMGEERYTAFTQRQPIGVVVGIVPWNFSIMIVIWKLAAALVCGCTIVIKPSEYTPLTLLRVAELAKEAGFPDGVINVVNGAGGEIAQQLIAHPDCAKVSFTGSVATGEKVRRSATSSGKRVTLEPGGKNAALFLNDLTEQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLIHEETFGPVCSFIGYQNEKEALSHINDSPFGLAASVWSENMSKALHYAEDIDAGMVWVNMHTFLDPAVPFGGMKGSGIGREFGSAFIDDYTELKSVMVRY

SEQ ID NO: 72443 - protein, 467 aa, Ralstonia solanacearum GMI1000
MSIGTIVQCIGAVVDIQFPRDAMPKVYDALVLQDSGEASFAEKGLSFEVQQQLGDGVVRTIALGSSDGLRRGMPVSNTGAPISVPVGHGTLGRIMDVLGRPIDEAGPIAADEKRAIHQKAPKFDELSPSVDLLETGIKVIDLVCPFAKGGKVGLFGGAGVGKTVNMMELINNIAKQHSGLSVFAGVGERTREGNDFYHEMKDSNVLDKVAMVFGQMNEPPGNRLRVALTGLTMAERFRDEGRDILFFVDNIYRYTLAGTEVSALLGRMPSAVGYQPTLAEEMGKLQERITSTKTGSITSIQAVYVPADDLTDPSPATTFLHLDSTVVLSRDIAALGIYPAVDPLDSTSRQLDPQIVGTEHYEVARRVQQTLQRYKELRDIIAILGMDELSPEDKLAVGRARKIQRFLSQPFHVAEVFTGSPGKYVPLKETIRGFKMLVDGECDHLPEQAFYMVGSIDEAFEKAKKLQ

SEQ ID NO: 72444 - protein, 194 aa, Chlamydomonas sp. HS-5
MDESNATCGKRLDSIGVENTEENRRAYRDLLLSTPGLGQYISGAILFEETLYQSTKDGKTFVQVMNDQGIVPGIKVDKGLVPLVNSNGESWCMGLDGLDKRCAEYYKAGARFAKWRSVISIPAGPSIIAQRDCPTAWPATPPLPSPLAWCPSSSPRCCWTVTRTLTRLWRLPRTSGLRLSSTWPTTRSCSRVSC

SEQ ID NO: 72445 - protein, 325 aa, Corynebacterium glutamicum ATCC 13032
MSKQHSTPLNNDEEHTSAPQKVAVITTGGTIACTSDANGHLLPTVSGADLLAPIAPRFNGAQIAFEIHEINRLDSSSMTFEDLDSIIATVHKVLEDPDVVGVVVTHGTDSMEESAIAVDTFLDDPRPVIFTGAQKPFDHPEADGPNNLFEACLIASDPSARGIGALIVFGHAVIPARGCVKWHTSDELAFATNGPEEPERPDALPVAKLADVSVEIIPAYPGATGAMVEAAIAAGAQGLVVEAMGSGNVGSRMGDALGKALDAGIPVVMSTRVPRGEVSGVYGGAGGGATLAAKGAVGSRYFRAGQARILLAIAIATGAHPVTLY

SEQ ID NO: 72446 - protein, 446 aa, Physcomitrella patens subsp. patens
MAPSVQEDFPSTPGKGKMERNNFFGRAASRWHTSASAKLFALSVFLLVITIFICFRITGNGMIDGYITSAYSSTNGGTLLPAFKSDHAWDLKVAQSCTPERENGLVVLVTGAAGFVGSHVSLALKKRGDGLVGIDNFNDYYEVSLKRARQELLLKQGIFVIEDDINNAALLKHLFVKVQFTHVMHLAAQAGVRYAMQNPMSYIHSNIAGLVTLFEACKNANPQPAVVWASSSSVYGLNSKVPFSEADRTDQPASLYAATKKAGEELAHTYNHIYGLSITGLRFFTVYGPWGRPDMAYFSFTRDILKGKEINIYKGQNDRDLARDFTFIDDIVKGCVASLDTAGRSTGSGGKKRGAALFRTFNLGNTSPVSVPVLVEILEKYLKVPAKKVFIKMPRNGDVPFTHANVSLAQTQLGYKPTTNLDTGLKKFVTWYMKYYGVQSTKTRRL

SEQ ID NO: 72447 - protein, 149 aa, Ehrlichia ruminantium str. Welgevonden
MPNNKIKMLVVVSQFYPEITELMLNAAVAVFQEHTEPVEYDVVYVPGSFEIPAAITFAILSDKYHYDGYVALGCVIKGETDHYYYVSKGVTLSLSEIATNHAVPMGFGVITAETKELALARADMNKKNVGGKAAKAALAMVTLHKKFVR

SEQ ID NO: 72448 - protein, 736 aa, Oryza sativa Japonica Group
MAGIWFNTVPKFTPVWVANGENPVADLASCKLLVSSDGNLAIVATTHAKNSSMVWSSKANIPTNTTHAVLLDDGNLVLRSTSTTNASSTILWQSFDHPTDTVLQGGKIGWNNATGVNRRLVSRKNTVDQAPGMYSFELLGHNGPTSMVSTFNSSNPYWSSGDWNGRYFSNIPETVGQTWLSLNFTSNEQEKYIEYAIADPTVLSRTILDVSGQLKALVWFEGSRDWQTIFTAPKSQCDVYAFCGPFTVCNDITFPSCTCMKGFSVQSPEDWELDDRTGGCVRNTPLLCNSNKTAAGTADKFYPMTSVQLPDKAQSIGAATSADECAAACLSSCSCTAYSYGEGGCSVWHDKLLNVRQQGNGVLYLRLSAKEVLESRRNNRWGVILGASIGASTAALGLIFLLMIWIRKGKRYNLTMDNVQGGMGIIAFRYVDLQHATKNFSEKLGAGSFGSVFKGSLSDSTIIAVKRLDGARQGEKQFRAEVSSIGIIQHVNLVKLIGFCCEGDRRLLVYEHMPKSSLDAHLFPSSGAVLSWTIRYQIALGVARGLAYLHSSCRDCIIHCDIKPENILLDSSFTPKVADFGMAKFLGRDFSHVVTTMRGTIGYLAPEWISGTAITSKVDVYSYGMVLLEIISGSRNSSKQSSRDGVHEACFPVQVARNLLNRDIDSLVDANLHGEVKLEQVERVCKVACWCIQDNEFDRPTMSEVLQFLEGLSEVETPPMPRLLHTLAGGLDSKIM

SEQ ID NO: 72449 - protein, 715 aa, Mannheimia succiniciproducens MBEL55E
MKELFATTARGFEELLKLELSSLGATECQVAQGGVHFMADDETQYRALLWSRLSSRILLPIVKTKIYSDLDLYSAVVRQNWLAYFDERVRFLVDFNGTNREIRHTQFGAMRVKDGIVDYFERNGKARPNVDKDYPDIRIHAYLNRDDLVLSLDLSGEALHLRGYREDSGAAPLRETLAAAIVLRSGWKQGTPLVDPMCGSGTLLIEAAQMEAKIAPQLHRMHWGFDFWRGHNQAAWEKVKREAVAMAEAEFNKNPNPHFYGFDLDHRVLQKAQRNAQNAGVAHLIKWKQGDVAALKNPTPEDKGTVICNPPYGERLGTTPALIALYSVFGQRLKEQFPGWNASIFSSEQGLLDCLRMRSHRQFKAKNGPLDCIQKNYQISDRTLSPENKSAVENAGEFKPNANVATDFANRLQKNIKKIEKWAKQEGIEAYRLYDADLPDYNLAVDHYGDHIVVQEYAAPKNIDENKARQRLLDAVTATLAVTGVETNKLILKVRQKQKGANQYEKLANKGEYFYVNEYGAKLWVNLTDYLDTGLFLDHRLTRRMVGQMAKGKDFLNLFAYTGSATVHAALGGAKSTTTVDMSNTYLNWAEQNLILNEADGKQHKLIQADCLQWLANCAQQFDLIFVDPPTFSNSKRMEDSWDVQRDHIKLMGNLKRILRPNGTIVFSNNKRGFKMDFEGLTRLGLKAEEISAKTLPLDFERNKQIHNCWIVEFV

SEQ ID NO: 72450 - protein, 584 aa, Arabidopsis thaliana
MSKQTYKVCFCFRRRYRHTVSVAPAEIKTLFDNYSDKGLMTTDLLLRFLIDVQKQDKATKEEAQDIVNASSSLLHRNGLHLDAFFKYLFAVTNSPLSSLEVHQDMDAPLSHYFIYTGHNSYLTGNQLSSDCSELPIIEALKKGVRVIELDIWPNSDEDGIDVLHGRTLTSPVELIKCLRAIREHAFDVSDYPVVVTLEDHLTPKLQAKVAEMVTDIFGEMLFTPPSGECLKEFPSPAFLKKRIMISTKPPKEYKAATDDDLVKKGRDLGDKEVWGREVPSFIRRDRSVDKNDSNGDDDDDDDDDDDDDDGDDKIKKNAPPEYKHLIAIEAGKPKGGITECLKVDPDKVRRLSLSEEQLEKASEKYAKQIVRFTQRNLLRVYPKGTRITSSNYNPLIAWSHGAQMVAFNMQGLGRSLWVMQGMFRGNGGCGYIKKPDLLLKSNAVFDPEATLPVKTTLRVTIYMGEGWYYDFPHTHFDRYSPPDFYTRVGIAGVPADTVMKKTKTLEDNWIPAWDEVFEFPLTVPELALLRIEVHEYDMSEKDDFGGQICLPVWELRQGIRAVPLRNQDGVKCRSVKLLVRLEFV

SEQ ID NO: 72451 - protein, 866 aa, Thermococcus kodakarensis KOD1
MSEEVKEVKILEKPWVEKYRPQRLEDIVGQDHIVKRLKHYVKTGSMPHLLFAGPPGVGKCLTGDAKVIANGRLFELGELVEKVSKGRFGPTPVEGLKVLGIDEDGKLREFEVQYVYKDRAERLIKVRTRLGRELKVTPYHPLLVNRKNGEIMWVKAEELRPGDRLAVPRFLPAIAEEDPLAEWLGYFIGDGHADSKNKVITFTNTDPSLRQRFMELTERLFPDAKIRERIHKNRAPDVYVNSRRAWELVSSLGLAGRKADKVYIPEKGWEGIRSFLRAYFDCDAGVDKNAVVLATASREMAEQVTYALAGFGITSKIREKKVRGKTYYHVTISGSENLERFLSEIGFSHREKLERTLKLVKKPNPNLDSLNVNYELISYVRDRLKLNFSDDKRSWSHRKARKISWELMKEIYYRLDELERLKESLSRSILIDWNEMAERRKEIAEKTGIRADRLLEYIKGKRKPSLRNYIKIAKALGIDLEPTINAMRVFARKYSSYAEIGRKLGTWNSSVRIILESNTEKIKELEEIRKIELELIGEILSDEKLKEGVAYLIFLSQNELYWDEITEVKELKGDFVIYDLHVPGYHNFIAGNMPTVVHNTTAALALARELFGENWRHNFLELNASDERGINVIREKVKEFARTKPIGGASFKIIFLDEADALTQDAQQALRRTMEMFSNNVRFILSCNYSSKIIEPIQSRCAIFRFRPLRDEDIAKRIRYIAENEGLELTEEGLQAILYVAEGDLRRAINVLQAAAALDTKITDENVFLVASRARPEDVREMMTLALEGNFLKAREKLRDILLRQGLSGEDVLIQMHKEVFNLPIPEDKKVALADKIGEYNFRLVEGANEMIQLEALLAQFTIMGK

SEQ ID NO: 72452 - protein, 448 aa, Listeria monocytogenes EGD-e
MKKDKTERTKQSWRKAQNAPSLSEVNNSVAIPKNAKFFRKLFAFMGPGALIAVGYVDPGNWATSIAGGSEFGYTLLSVILISNILAVLLQSLASKLGIVTGRDLAQASSDHFSKPFGFVLWILAELAIIATDIAEVIGSAIALNLLFGIPLIWGVCITALDIFLVLFLQHKGFRYIEVIVITLMVTILVCFGAEMVMSHPDMQAIAKGFIPQSEIVTNPAMLYIALGILGATVMPHNLYLHSSIVQTRQYARTKEGKKEAIRFSFIDSTFSLTIALLINASILILAAAAFYTTGQHNVAGIEDAYKLLNPTLGSSIASTVFAVALLASGQNSTLTGTLAGQIVMEGFLNIRLKPVVRRLLTRVLAIVPAVIITALYGANGINELLIFSQVILSMQLSFAVIPLVMFTSDKQKMGEFVNPTWLKIISWAVAIFIAVLNIYLLFYTLTSL

SEQ ID NO: 72453 - protein, 184 aa, Bradyrhizobium sp. ORS278
MLGIGSKLPSFEIVGVKPGFHLQEEKGESAFETLTEASFPGKWKIIFFYPKDFTFVCPTEIAEFARLSKDFADRDAVVLGGSTDNEFCKLAWRRDHKDLHKLPIWQFADTKGSLVDGLGVRSPDGVAYRYTFIVDPDNTIQHVYATNLNVGRAPKDTLRVLDALQTDELCPCNREVGGETLKVA

SEQ ID NO: 72454 - protein, 404 aa, Klebsiella pneumoniae subsp. pneumoniae MGH 78578
MAESSPERRFTRIDRLPPYVFNITAELKMAARRRGEDIIDFSMGNPDGATPPHIVEKLCTVAQRPDTHGYSTSRGIPRLRRAISRWYEERYNVDIDPESEAIVTIGSKEGLAHLMLATLDHGDTVLVPNPSYPIHIYGAVIAGAQVRSVPLVEGVDFFNELERAIRESYPKPKMMILGFPSNPTAQCVELDFFEKVVALAKQYDILVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVECPKASMYVWAKIPEPYAAMGSLEFAKKLLNEAKVCVSPGIGFGDYGDTHVRFALIENRDRTRQAIRGIKAMFRADGLLASAS

SEQ ID NO: 72455 - protein, 297 aa, Oryza sativa Indica Group
MPAAAAAAARGPLLHLRRNPAPRLAAARRSFSSSGMRCVSAAAGAGGGGRERRSSPAFGGLLLDAGGTLLQLARPVAQTYASLGRRYGMSKSEESIKEGFKRAFSAPWPKTLRYQGDGRPFWRIVVAEATECTNNDYFEEVYEVDKESVLKYCSISAEETGKTFSATLQYYAHGDAWRLPAGAYETLRDLKDAGVKLAVVSNFDTRLRKLLKDLHVSDMFDAIVVSSEVGHEKPAPEIFKRALDQIGVEASKAVHVGDDETADKAGANAIGLECWLWGQDVRTFSEIQDRILTRFPQ

SEQ ID NO: 72456 - protein, 699 aa, Vibrio fischeri ES114
MTLETKNNTLEAVKNTSAFAWTKDDEQIAWLTIDVPNEKMNTLQAAFAEQVTQVLDEIEEQQAHIKGLVIQSGKPDNFIAGADINMIANCQNASEAQALAEKGQHLFQRIEDLPFATVAAIHGPCLGGGLELALACDYRVCSDDNKTKLGLPEVQLGLLPGSGGTQRLPRLIGLLPSLDIILTGKQLRPKTALKLGVVDASVPHTILSRIAADFALKKKAKRKLTAKEWGLSRNPLGRNVIFSQAEKQAQKKARGNYPAIAAILDCIEHGLDKGMKKGLQREAEQFARLAMTPESAALRSLFFAMTEMKKEKGSDAEPKSIDYVGVLGGGLMGGGIAHVSIAKAKKKVTIKDINNDGLLNAYQYHYQRLDTLRKRRIISKAQLQQQMLQLTGVTEFDGFKKLDVVVEAVFEDLNLKQEMVKAVQEQGKEDVIFATNTSSLPIGQIAEGAQKPENIVGLHYFSPVEKMPLVEVIPHATTSDETISTVVALAKQQGKTPIVVKDSAGFYVNRILAPYMNEAARLLLAGEPIEVLDEALLDFGFPVGPISLLDEVGVDIGAKIMPILEAELGDRFRSPDVFQTLIDDKRLGKKTKRGFYVYKGKKKEPDQEVYTLLNIKPQSQLSKNEIAMRCVLPMLAEAKRCLDEGIIASERDGDIGAIFGIGFPPFLGGPFTYMNTLGEEKLATLMRNYADKYGDRFIE

SEQ ID NO: 72457 - protein, 166 aa, Glycine max
MDCKKRVRDDSDESVLESPEAKRLRDDLLEFFDDADDAPSSQDLDSVMKSLQEEISGVASDSGESQAQIGYLLEASDDELGLPPAGNSSAPEEKNVETELVRVASDSSGIGELWEFEEQIPRYDSFDLGMGFGYECDTTEYAAFGGLFDHSDLYYDSWRHETLPTQ

SEQ ID NO: 72458 - protein, 324 aa, Mycobacterium sp. JLS
MKRVLITGIAGFVGSTLGERLIANDPSIEVIGIDRYTDYYPKSIKEANLEVLREYGVRILDEDILEANLDNLLDGVDVVFHQAGQPGVRRSWGDSFDAYLRDNILASQRLLEAARRSTSLRRFVYASSSSVYGDAERYPTLETDTPQPRSPYGVTKLAAEHLMGLYAQNFGVPTLSLRYFTVFGPRQRPDMAFTRFIARTLAGRPIEIFGSGEQIRDFTFVDDVVSANLAAATAAGVLPGTVYNISGGASVTVNEILATLEEILDGPILTHRAETVAGDVFRTGGSNEAARRGIGWEPTVSLHEGLRRQVEWLQSHRERYLDIV

SEQ ID NO: 72459 - protein, 555 aa, Klebsiella pneumoniae subsp. pneumoniae MGH 78578
MDMQPTYTIGDYLLDRLVDCGIDRLFGVPGDYNLQFLDRVIAHSALGWVGCANELNAAYAADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQRLLVEPAPADENQLAGFCEHASRLLRSSRRISLLADFLAQRYGLQKTLREWVAKTPVAHATMLMGKGLFDEQQSGFVGTYSGIASAPQTREAIENADTIICIGTRFTDTITAGFTQHLAREKTIEIQPFAVRVGDHWFSGVPMDKALAALMTLSAPLAAEWATPQVVAPEAEEGAEGELTQKNFWATVQGALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVASRCRRVTQTSELREAMTESITSDTLTLVEVMLPKMDIPDFLRAVTQALEERNSRV

SEQ ID NO: 72460 - protein, 496 aa, Pseudoalteromonas tunicata D2
MHKVPLYIAGEMCQSETSQWIDVLNPATQEIIAQVPCTTNEEMARAITSAKETFKTWKEVQISERARIMMRYAALLKEHHDEIATIICHELGKTFEDAKGDLWRGIEVVEQAANAPSMMMGETVENVARGIDTYSYMQPLGVCAGITPFNFPAMIPLWMFPMAIVCGNTFILKPSEQDPLTPMRLVELFEEAGAPKGVLQVVHGTKPQVDILLEDPAIRAISFVGSCGVGEYIYSKGTANLKRVQACVGAKNHMVIMPDAKKERLISNLVGASVGAAGQRCMGISVAVFVGQTKEWINDLKEAFSQVRPGVWDDPKAAYGPQTTPQAKARILSLIANGKKQGATCLLDGSDFTVEGYEQGNWVGPTLFTDVTTEMDLYKEEIFGPVLACICVDTLDEAIALINNSPYGNGTSLFTACGAAARKFQHEIEVGQVGINVPIPVPLPFFSFTGWKGSFYGDQHTYGKQGIRFYTETKTITARWFEDDIATGPNMSINLK

SEQ ID NO: 72461 - protein, 662 aa, Oryza sativa Indica Group
MSSRKKPSRIEPFRHKVETDPRFFEKAWRKLDDAIREIYNHNASGLSFEELYRTAYNLVLHKHGPKLYDKLTENMEDHLQEMRVSIEAAQGGLFLVELQRKWDDHNKALQMIRDILMYMDRVFIPTNKKTPVFDLGLDLWRDTIVRSPKIHGRLLDTLLDLIHRERTGEVINRSLMRSTTKMLMDLGSSVYQDDFERPFLEVSASFYSGESQKFIECCSCGEYLKKAQQRLDEEAERVSQYMDAKTDEKITAVVVKEMLANHMQRLILMENSGLVNMLVEDKYEDLTMMYSLFQRVPDGHSTIKSVMNSHVKETGKDMVMDPERLKDPVDFVQRLLNEKDKYLQEKDLFEKYYKQHLAKRLLSGKAASDDSERSMLVKLKTECGYQFTSKLEGMFNDLKTSHDTTQRFYAGTPDLGDAPTISVQILTTGSWPTQPCNTCNLPPEILGVSEMFRGFYLGTHNGRRLTWQTNMGTADIKAVFGNGSKHELNVSTYQMCVLMLFNSADCLSYRDIEQTTAIPSADLKRCLQSLALVKGKNVLRKEPMSRDISDDDNFYVNDKFTSKLFKVKIGTVATQKESEPEKMETRQRVEEDRKPQIEAAIVRIMKSRRVLDHNSIVTEVTKQLQPRFMPNPVVIKKRVESLIEREFLERDKTDRKLYRYLA

SEQ ID NO: 72462 - protein, 412 aa, Triticum aestivum
  misc_feature (220)..(220): Xaa can be any naturally occurring amino acid
MMRTAAVLFLCFFAFAGSGWGGARVAAVWAEGVRQTAAVVVDPAWRFPSPRLRDAYVALQTWKQQAIFSDPKNLTGDWVGPAVCGYTGVFCAPAPSSGELAVAGIDLNHGDIAGYLPSELGLLCDLALLHLNSNRFCGLVPDTFRRLVLLHELDLSNNRFVGAFPTVVLDLPSLRFLDLRFNDFEGGVPRELFDRPFDAIFLNHNRLRFQLPDNFGNSPXSVIVLANNHFGGCLPASLGNMSDTLNEILLINNGLTSCLPAEVGMLREVTVFDVSFNALAGPLPPEVAGMQKVEQLDIAHNLLSGTVPEAVCDLPRLKNFTFSYNFFTGEPPSCARVVPADGDRRNCLPNRPAQRMPQQCAAFYARPPVDCAAFQCKPFVPPRPPPPPAYPGPLPPVYPMPYASPPPPPRYR

SEQ ID NO: 72463 - protein, 535 aa, Pseudoalteromonas tunicata D2
MTILTSKVNPLDPTFVANKQKMQDLIHDLHLQVDKIIKGGGEELIARHVNRGKLFVRDRIDTLLDEGSPFLEISQFAAFGVYEQDIPCAGVVAGIGRVKGVECMIIANDATVKGGTYFPLTVKKHLRAQDIAERCHLPCIYLVDSGGANLPEQDEVFPDKLHFGRIFYNQARMSAKGIPQIAVVMGLCTAGGAYVPAMADESIIVKEQGTIFLAGPPLVKAATGEEVTAEELGGADVHCKISGVADHYAENDAHALSIARQCIARINHQRPTKPLLDEVKPPRFAAEEIYGIVGTDLKKPFDVREVIARVVDDSSFDEFKRYFGETLVTGFASIYGHPVGIVANNGILFSESAQKGAHFIQLCCQRNIPLIFLQNITGFMVGQKYEAEGIAKHGAKMVTAVSCADVPKFTVLIGGSYGAGNYGMCGRAFEPTMMWMWPNARISVMGGEQAAGVLTQVKQDGLARKGLSMSEQEIADFKKPIVSQYEQQGHPYYASARLWDDGIIDPAQTRHVLGLALSAASNAPKRDSQFGVFRM

SEQ ID NO: 72464 - protein, 142 aa, Vitis vinifera
MEASTLSRIGLAGLAVMGQNLALNIAEKGFPISVYNRTTSKVDETLDRAHREGHLPLSGHYSPRDFVLSIQRPRSIVILVKAGAPVDQTIAAFFWQGHSVSGHGRLRWRRGCAPRPVVDARWILSGVSEHRGYCEESGCSGR

SEQ ID NO: 72465 - protein, 197 aa, Triticum aestivum
  misc_feature (98)..(98): Xaa can be any naturally occurring amino acid
MASSLLRSGQRLLRHHRGRLPAAFSTAAAEELIDVRKLPTDYDPSTFDPTAPPSRPPPSDRVWRLVDDVSALTLAEAAELSALLLRRLDIPSAPPIAXILNSAAGLGGGGAAAAGAAGDKPAAAAEKTVFELRLDSFDAASKIKVIKEIRTFTDLGLKEAKELVEKAPAVIKGGLSKEEAEKIVERMKALGAKVVMD

SEQ ID NO: 72466 - protein, 306 aa, Vitis vinifera
MVHNGIEYGDMQLISEAYDVLKNVGGLSNSELSDIFGEWNRGELESFLIEITADIFKVKDEHGDGELVDKILDKTGMKGTGKWTVQQAAELSVAAPTIAASLDCRYLSGLKEEREAAAGVLSEAGLKDEVGFARSGVDKKRLIDDVRQALYASKICSYAQGMNLLRAKSVEKGWNLNFGELARIWKGGCIIRAVFLDRIKKAYQRNPNLASLIVDPEFAREMVQRQAAWRRVVGLAISAGISTPGMCASLAYFDTYRRARLPANLVQAQRDLFGAHTYERIDRPGSFHTEWTKLARKSDAGFATLK

SEQ ID NO: 72467 - protein, 206 aa, Coxiella burnetii
MLCLRLKWANWFGRKFGINFGLQTIEQFQMLYAFEDREPKLLGDNYFIADSADVIGSVIIHNNVSILPHAVIRADNEVIEIGEGSNVQDGALLHTDPGIPMRVGKGVTIAHRAMLHGCTIGDHSVIAIGAIVMNNAIIGKNCIIGANALILENQKIPDGSLVIGSPGKVKSQLSQKQIEEMQGYAKHYIEKIDRFKHELKVFQRVK

SEQ ID NO: 72468 - protein, 234 aa, Corynebacterium glutamicum ATCC 13032
MERREELQVRLQQVQARIDATLNEHNRPEGSVRLLPVTKFHPVEDIKILQEFGVTAVGENREQEARAKALELPDMDFHMIGQIQSKKANSIARWAAAVHSVDSEKIAEALGRGVALALDRGDRTSDELPCFIQLSLDGDPSRGGTPLSQVTQLADCISDTTHLRFEGLMCVPPLGWGPEKAFSQARDVLSGLEEHFDRSLEFSAGMSGDLVAAIKHGSTIVRVGTEILGNRPLA

SEQ ID NO: 72469 - protein, 469 aa, Bordetella bronchiseptica RB50
MASTMETDLLVLGGGPGGYTAAFRAADLGLSVVLVEQRPTLGGVCLNVGCIPSKALLHCAKALDEARAMSELGIEFSEPRIRLDKLRAHKEALVAKLCGGLGGLARQRKVQVVTGTGRFDGPHSLAVSDGSRVAFKQAVIAVGSRPVRLPFLPDDPRIMDSTGALELKEIPRRLLVIGGGVIGMELATVYAALGARVTVVELTDGLLPGCDRDLVKPLAQRVAGRYEAVLLGTRVSAAQARDDGIHVGFEGPQAPGPQVYDQVLVAAGRRPNGAAIDAERAGVRVDEGGFIRVDAQQRTNVGHIYAIGDVVGEPMLAHKAAHEGKVAAETAAGMRVANDARVIPAVAYTDPEVAWVGLTETAAQRDGIAYEKAAFPWAASGRALSLGRGEGLTKILVDPATHALLGVGMVGPQAGDLIAEAALAIEMGAEPGDIALTIHPHPTLSETLAFAAEAYEGTLTELYLTRKKS

SEQ ID NO: 72470 - protein, 431 aa, Clostridium acetobutylicum ATCC 824
MDKLSIREDNYNIKHKTISLNRASSVTRNLKGLLKFLGPAFVVSVAYIDPGNFATNISGGSSFNYNLIWVILWSNLMAIFLQTMSAKLGIATGCSLPEMCAKVFSKRANWIFWIVGELGAMATDLAEFIGGTLGLYLLFRIPMIYAGLLTGVLTFIIVYMEKYGQKMVETIIAALIAVICVAYTIELFLARPAWTQVGMHTLIPSLPNGEAVLIAVGMLGATVMPHVIYLHSELVQHRNTNSSDKEKLHHLKMEKIDILIAMNIAFVVNAAMVIVSAAVFFKHGIKVSTIEEAHRSLQPLLGNLSSGAFGIALLASGLSSSAVGTMAGQTIMKGFVNLSIPINLRRIITMLPALIIIALGINPMRVLVLSQVALSFILPFPIIQMLLIAGRKDLMGILVNKKFTKIVGFIIATMIILLNIILLYLTFTGQT

SEQ ID NO: 72471 - protein, 427 aa, Methanopyrus kandleri AV19 [sequence omitted]

SEQ ID NO: 72472 - protein, 505 aa, Vitis vinifera
  misc_feature (384)..(384): Xaa can be any naturally occurring amino acid
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGKPFYSQMMNAFRQLKRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLXGELHPPPIGIKAGALSLFAVMGVPLAITYSIPFALASIFCHSSGAGQGLSLGVLNLAIVVPQMMVSVASGPWDARFGGGNLPAFVVGAFAAALSGVLALTMLPAPPPDVPNTKDERTQPSS

SEQ ID NO: 72473 - protein, 192 aa, Gloeobacter violaceus PCC 7421
MILVIDNYDSFTYNLVQYLAELGAQVEVHRNDRIDIDGVRALAPGAVVISPGPGRPEDAGVSEAIIAELGSQLPVLGVCLGHQCIGRVFGGQIVRAPELMHGKTSLIHHRGEGVFAALPEPFVATRYHSLAIAAEAFPAVLEITAWTEDGTVMGVRHRTWRHIQGVQFHPESILTAVGKDLLRNFLESLPSA

SEQ ID NO: 72474 - protein, 533 aa, Listeria monocytogenes EGD-e
MLTVNNVGLRYGDKKLFEDVSIKFLPGNCYGLIGANGAGKSTFLKVLSGELDSQSGNVHIGSGERLAVLRQDHFQYDDELVLNTVIMGHERLYKIMDEKNAIYMKEDFSDEDGIRAAELEGEFAELDGWEAESDAAVLLNGLGIPTDLHGKLMKDLTGGEKVKVLLAQALFGKPDILLLDEPTNHLDIRAIHWLEEFLINFDNTVIVVSHDRHFLNKVCTHIADLDFSKIKLYVGNYDFWYESSQLAQTMMGDRNKKKEEKMKELQDFIARFSANASKSKQATSRKKMLEKITLEDIQPSSRRYPFIQFKPDREVGNDLLTVTNLSKTIDGVKILDNLSFSINRNDKVALVGDDEVAKTVLFQILAGEMEPDEGSYKWGITTSQSYFPKDNSEFFEENDMSLVEWLRQFSPEDDSEAFLRGFLGRMLFSGDEVLKKVRVLSGGEKVRCMLSKMMLSGSNVLLLDEPTNHLDLESITALNNGLEAFKGAIIFASHDHQLLQTIATRIINLSKDQFYNKEISYDEYLKEVMNVAE

SEQ ID NO: 72475 - protein, 446 aa, Listeria monocytogenes EGD-e
MAKFTYDVVIIGSGASGTTVAFEAQAAGLKVAIVEERNWGGTCVLRGCDPKKVLIGAREARNLSTRLRGKGIKQAATISWTDLMAFKETFVENVPESRLASFQEAGIETFFGAASFQDSHSLQVGDDLIYAEKIVIATGATPSTLKVEGKEYIQTSDDFLSLEKLPDSVVFIGGGYISFEFASIALAAGRDVHIIHHNSEPLKKFDPDFVAALVANIKDEGIHFHFDTDITKIENDGGKLHIKGKDSFSLQTDLIIGATGRMPNIAHLSLENASIDYTKKGIVVNEKLQTPNNPHIYACGDVAATKGAPLTPVVSLEAALVAKNVIGVNEKITYPAIPSVVFTSPKLASIGISTEEAKANPEKYQIKNHDTTSWYTYKRTNEQIALAKIIEDRESGQIKGAHFLSEEADYMINYIAILMKANLTLADLQSVIFAYPSPASDLTALN

SEQ ID NO: 72476 - protein, 403 aa, Listeria monocytogenes EGD-e
MKIIVQKFGGTSVQNEKSRLMAFNHIKQVLKEGYKVVVVVSAIGRYGDPYATDTLLELIGAKNTKLTAREQDTLLSVGETISASVFTNMLKEANIKAEAFSGGQAGIITSDDHLNAKITEVDTARLKDALTNLDVAVVAGFQGITANGDISTLGRGGSDTSAAALGVSLQANYIDIFTDVDGMMTADPRIVEHARSLPRVSYNEVSNMAYQGAKVIHPRAVEIAMTAKIPMRIRSTYLESTGTLVTSLADDSGHFDVKERMVTGVAHVTNLTQISVQADTVKAQQLAFKILADAGISLDFINISTNSVIFTVPEEKSHVVKQLLEDADLQTTVRQACAKVSIVGAGITGVPGVTAKIVGALSEKNIPILQSADSHTTIWVLVREKDLISAVNALHDVFCLEIK

SEQ ID NO: 72477 - protein, 413 aa, Klebsiella pneumoniae subsp. pneumoniae MGH 78578
MTSSRVENSSSRAARKVKLALMGPAFVAAIGYIDPGNFATNIQAGASFGYQLLWVVVWANLMAMLIQVLSAKLGIATGKNLAEQIRDHYPRPVVWFYWVQAEIIAMATDLAEFIGAAIGFKLVLGVSLLQGAVLTGVATFLILMLQRRGQKPLEKVIGGLLLFVAVAYVVELIFSQPALAPLTKGLVIPTLPNGEAVFLAAGVLGATIMPHVIYLHSSLTQHLHGGTRKERYNATRWDVAIAMTIAGFVNLAMMATAAAAFHFNGHTGVADLDQAYMTLEPLLSHAAATIFGLSLIAAGLSSTVVGTLAGQVVMQGFIRFHIPLWFRRAITMLPSFVVILLGLDPTRILVMSQVLLSFGIALALVPLLIFTSNAKLMGDLVNTRWVRGIGWAIVAIVVSLNGWLIVGSLLGVD

SEQ ID NO: 72478 - protein, 263 aa, Bradyrhizobium sp. ORS278
MTDIMDNPIAKSAAADASPPSLFRLIREDIGCVRSRDPAARSEIETLLTYPGIHALIWHRLAHRFWISGWRFPARLLSWLGRFLSNVDIHPGAQIGRRFFIDHGACVVIGETAEVGDDVTLYHGVTLGGTSWSPGKRHPTLENGVVVGAGAKILGPITIGPRTRVGANSVVIQSTPPDVTVVGIPAKVVRPEFTHRRTVGRIDLDHHLMPDPVGEALSVMLDRIEFLEAQLAHVRQKVRQGPPPPAPINGCEVDPTLTQGAKQ

SEQ ID NO: 72479 - protein, 372 aa, Oryza sativa
MMTYGPVLLCGLCLCLSPLPTRRLLSPSPSASLTTTTVRCSKGEMAVVKCIRVHELGGPEVLRWEQVEVGEPKEGEIRIKNTAIGVNFIDVYYRQGVYSAPLPFVPGREAVGVVTAVGPGLTGRKVGDVVAYAGNPMGSYAQEQIIPASVAVPLPPSIDHNTAAAIMLKGMTAHVLLRRVYKVQSGDCVLVHAAAGGVGSLLCQWANALGATVIGTVSNEEKAAQAAEDGCHHVIIYTKEDVVTRVKEFTAGKGVNVVYDSVGKDTYKGSVECLAWRGMLVSFGQSSGRPDPIPLSDLASKSLLVTRPSLMHYTATRDELLESAGEVFANVGSGVLRIRVNHTYPLSQAARAHADLQARKTTGSILLIPDDA

SEQ ID NO: 72480 - protein, 215 aa, Exiguobacterium sibiricum 255-15
MQKPVVIGVAGGTGSGKTTVARSLVDAFPSESIVMIEQDAYYKDQSELSMEERYQTNYDHPFAFDHDLLIEHIKALRENQAVEKPVYDYVAHTRATETIPLDPRDVIIVEGILALEDERLRESMDIKVFVDTDADVRILRRMQRDMNERRRSIDSVVEQYTKVVRPMHLQFCEPTKRYADIIVPEGGENHVAIDLLVTKIRAILDYRSSLDQRGY

SEQ ID NO: 72481 - protein, 375 aa, Nicotiana tabacum
MADANMGAGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTEFLGTPTEADLGFLQNEDAKRYIRQLPQHPRQQLAEVFPHVNPLAIDLVDKMLTLDPTRRITVEEALDHPYLAKLHDAGDEPICPVPFSFDFEQQGIGEEQIKDMIYQEALSLNPEYA

SEQ ID NO: 72482 - protein, 442 aa, Mycobacterium sp. JLS
MSRRIAVFGTGYLGATHAACMADLGHEVLGVDVDEGKLAKLAMGELPFYEPGLPEVLRKNIDAGRLRFTTSYKEAADFADVHFIAVGTPQKQGELAADLRYVDSVVETLAPLLTGPAVIFGKSTVPAGTASRLSARARDLSPAGDQVELAWNPEFLREGFAVKDTLHPDRIVLGVDSSRSSAAEDAARDVYAVLLEEQIPFLVTDLATAELVKTSANAFLATKISFINAIAEVCEATGADVSVLADAIGHDARIGRRFLNAGIGFGGGCLPKDIRAFIAMAGELGAGQAFALLREVDSINMRRRNKMVELAREAAGGSLIGARVAVLGAAFKPDSDDVRDSPALNIAGQMQLQGASVSVYDPEAMQNARQLFPTLHYASDIREACAGADMVMILTEWKQFVALDPAALGEVARRRTIIDGRNCLDPATWRGAGWTYRGIGKP

SEQ ID NO: 72483 - protein, 417 aa, Saccharomyces cerevisiae
MSDPIRTKPKSSMQIDNAPTPHNTPASVLNPSYLKNGNPVRAQAQEQDDKIGTINEEDILANQPLLLQSIQDRLGSLVGQDSGYVGGLPKNVKEKLLSLKTLQSELFEVEKEFQVEMFELENKFLQKYKPIWEQRSRIISGQEQPKPEQIAKGQEIVESLNETELLVDEEEKAQNDSEEEQVKGIPSFWLTALENLPIVCDTITDRDAEVLEYLQDIGLEYLTDGRPGFKLLFRFDSSANPFFTNDILCKTYFYQKELGYSGDFIYDHAEGCEISWKDNAHNVTVDLEMRKQRNKTTKQVRTIEKITPIESFFNFFDPPKIQNEDQDEELEEDLEERLALDYSIGEQLKDKLIPRAVDWFTGAALEFEFEEDEEEADEDEDEEEDDDHGLEDDDGESAEEQDDFAGRPEQAPECKQS

SEQ ID NO: 72484 - protein, 646 aa, Zea mays
MGARRRLRQGSGRLQLLFSFLVLLLQAQASVGAASINGEGLALLELKVRVEADPHGVFQDWDPMDSSPCSWSGVRCFDDKVEILNLTGRQLAGTLAPEIGSLRGLKSLLLPKNNFRGQIPREFGGLSALEVLDLSSNNLDGTVPEELWAMPLLKQLSLLYKWDFKDWISLGGLREKDNTNVPNFSEADVMHNLQSFASVMRRRLLSENDNLAALLGNDDKSSDLQNLKEIQRSVDVNSVGSGSFSAFPGIYGQALAPLLPEDIDATTVQQLSTDVTQTTNVEMSGTTYSKWAYIITIPAAILLISLIVLILVLRKRGRAPVAPWKTGLSGPIQKALVTGAQKLNRAELEVACEDFSNIINTFPTCTVFKGILSSGVEIGVVSTTISSSKDWSRSAESCFKKKIDRLSRVNHKNFINLLGYCLENEPFTRMMVFEFAPHGSLSQHLHVKEFEHLDWAARMRVIMGVAYCLQYMHHELSPPMAIHDVRSDTTFISDDYAAKIADVGVWNELAAKAKAGKEDGSSRAEAPPDLPSNAYCFGALMIETISGRVPDPYDHKPICSWASEHLKDKNYGKLVDASLKEHKESELEAVCEVIQECIDPDPTRRPSMRDVVGKLRDALGISPEAAAPRLSPLWWAELELLSVKST

SEQ ID NO: 72485 - protein, 416 aa, Bordetella bronchiseptica RB50
MSQLNDLLMPKLGLTMTEGMLIEWSVTSGAEVKAGDSLFVVETDKVANEIVAQADGTLAEILVAAGETVPVGTVVARWTGPGQGADDLADAPPAPAPQPPQPAAEAAPAAAREPARGGRVVATPLARRLAREAGLDLAQVSGSGPGGRIKAADVRQAPPALPVAPRDAASPAPAARASLAPAAGEQRIEASALVQSMARRMTQAKQVPHFYLSAEAEVSALLALRQRLNAQADAPRLTLNHFVIAAVARALAAMPHQNRIWNDDHIVQFQGIDVGVAVSTERGLMAPVLHGLDHASLDDIAAQSGALLGRVRAGKATREDMSGGAISISNAGMFNVTYMAPIINPPQSAILGVGSIRELFRPDEQGAPALRREMGLVLAADHRLHDGASALAFLNHVIDLLQDPYRLLRNRPHTKG

SEQ ID NO: 72486 - protein, 768 aa, Candida albicans SC5314
MDKKSKLFKYPLSEETAKFEYRLLNPNGKLSDIWLHEEYQKLSLSAIDKVSQQPSAVTTAPSQPHRENSRKRNAGDDDVYDQKNMPSCDDTASSDTDCQSQVSSTAHLHSYRSNGLVEPPSKRRLTTTNETSLSSAGATTFQIESPGSISAITTNNSTTSAGDSNNSNSFSDQHSRHPRTPNVMNSPTHTPISDIEEDPIQQLPLPSPSASPIQSDTENEHVTTSDSLQGKANLDSIENVMSNEPTTQSELVDLVTKLSGFLSEANQNHLVFKLLQKTTRPTLSTFNNLINNSLKRDILSNVPFEVTMKILSYLDYKTLLSVAQVCKKWFDIINNPDTWIKLLKRDKLITDDAVIKYELQYPDQLLREWSTLPEINSAQVLYKKRKIIVNRWMDPKFKPHRISVSGHGNKVVTCLQHDDEKVVTGVDDKCILIYSTQTGQLMKVLEGHEGGVWALKYTGNTLVTGSTDRTVRVWNMKTGQCTHIFRGHTSTIRCLDIIHPAVIGKNQDGEDIVFPEYPLLITGSRDHNIHVWKLPVVDDSQDYIETFEGEFDNPYLIAVLSGHTQSVRSISGYGNIIISGSYDSTVRVWDLLDDGHCTHVLQGHLDRVYSTAIDFHSKTCFSGSMDSNINVWNFETGELKKVLVGHASLVGLLDLVDDVLVSAAADATLRIWDAKTGELRSKLKGHGAAITCFEHDGLRVVSGSEKMLKLWNVEKGTFARDLLSDVTGGIWQVRFDYKRCVAAVQRIINEDEGETFIEILDFSQPLLQ

SEQ ID NO: 72487 - protein, 605 aa, Aquifex aeolicus VF5
MKRAEEVPGITVSFSIKFPFLMWFKNYSKEGFIRDLIAGITVAAVYVPQSMAYAMLAGMPPIHGLYVAFIATIVAAIFGSSRYLNTGPVAMTCLLSASVLYGIGFEPQTPEWIKYMALLALMVGLIRLTVGLFKLGFIVDLISNSVVVGFTAAGALVIALSQFKHFFGYEVKSSTHIFEVVMDLVSKIEMTNPYTLAIGVLAYFLIWGSRRISVYLPGALIAVVVTSLLVYWYKLYDKGVAIVGEVPQGLPSPEPPPLDFAMMSKMWGGAFVVAFFGLIEAVAIAKTLAIRVGDKWDPNQELIGQGLANVAVSFFKGFPAGGSFSRSSLNFALGAVSPLASVISGALVGLTLFLFAPAFYYLPKATLAAIVLSAVVNLIRPQDILKLYRINKIDGVVAGLTFLSVFFMDLWVAITLGVLLSLGSFVYKTMYPRIVTLTRDPVTRTFVNAEKRGLPECPQIMFIRPNMSIYFGNAQYVYDYIMNKVEDALFNGRPLKFVLIDMEAVNYVDATGAETIVRLVKDIKQKGVEVAFANIGCDVYPILENAGFDEVVNQDLVFNAKGEAIGKLFEKLDHDYCREKCPYAVFDECLEVKPPEKVQELKKAS

SEQ ID NO: 72488 - protein, 329 aa, Burkholderia mallei ATCC 23344
MQVPLDVVTYGEAMAMFVAAEPGPLDSATHFTKRIAGADLNVAIGLARLGFRVGWMSRVGADSFGRYVLDTLAREQVDASCVTVDARYPTGFQLKSRATDGADPSVEYFRKGSAASRLSLDDYVPDYVLGARHLYLTGVAPALSDSSRELAFHLARTTRAAGKTVSFDPNLRPTLWPSPEAMARTLNALAEHADWVLPGLAEGRQLTGLDTPADIARFYLERGARGVIVKLGAAGAYFRVADGREGEIAAERVEHVVDTVGAGDGFAVGVVSALLEGRAIDEAVARGNRIGALAIQVIGDSEGLPTRAALDRIENLSNARDRLEAPLAR

SEQ ID NO: 72489 - protein, 433 aa, Aquifex aeolicus VF5
MIKFLILGVILMVQVLTAQELYIRDLPNGAKLIVKPRDDTEAVALHVWFRVGSVYEKYDEKGMAHFLEHMLFNGTEKYKYGEIDRIIESLGGNINAGTSKDYTYYHVEIAHPYWKQALEVLYQLTMKATLDEEMIEKEKPIVIEELRRGKDNPTTVLWEEFEKLVYKVSPYRFPIIGFEETIRKFTREKLLKFYKSFYQPRNMAVVIVGKVNPKEVEEEVMKTFGKEEGRPVPKVQIPTEPEQIGIRFKKLKDPRIEKAYWIIGWRVPAIGKTDYKGLLVFSEILCGGRISVFYRELREKGLVYSYSCGDMGRPRDNIFIITATFPPENYEKVKKRVFELLKETYENLTDEQVEEAKSRIINSRLFEEERVENDAFDIGYSYTVVRDLDFYRFFDKNLSRVRRVDVMRIFERYIKEDKYSEILMVPEDGNKAE

SEQ ID NO: 72490 - protein, 150 aa, Haloarcula argentinensis
ERTFVMVKPDGVQRGLIGDIVSRFEDRGLKMVGGKFMQIDQELAEEHYGEHEDKPFFDGLVDFITSGPVFAMVWEGQDATRQVRNMMGETDPAESAPGTIRGDYGLDLGRNVIHGSDHEDEGANEREIELFFDEDELVDWDQIDSSWLYE

SEQ ID NO: 72491 - protein, 280 aa, Thermococcus kodakarensis KOD1
MFLLGSGGKHFEDELRNAGAKILEVEIKRFPDGEKYVRVMGNGDEATVVSSTFYPQDEKIVELLLLGDALREKGFEKLKLVVPYFAYSRQDRVTKDGEPISVRAVMRALGIYYEELYIFDTHNPETLRFFPGKAVNVSPARVIGEYFREKLGDGLVLAPDKGALERARAVAEVLGLEYSHFEKRRISPTEVEMHPVDVDVKGKNVLIVDDIISTGGTMVRAAELLRKLGAKKIYVSATHGVFAEGAIERVSRAVDELAVTNTIPTPVSRISIVPELLKLE

SEQ ID NO: 72492 - protein, 150 aa, Haloarcula californiae
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 72493 - protein, 523 aa, Mannheimia succiniciproducens MBEL55E
MNNIHNHKILILDFGSQYTQLIARRVREIGVYCELWAWDVTEQQIREFNPTGIILSGGPESTTEDNSPRAPEYVFNAGVPVLGICYGMQTMAMQLGGLTEPSSHREFGYASVSLENSTALFAQLNDDLNSSLPKLDVWMSHGDKVTRLPEGFQLTGTTSTCPIAAMSDESRHFYGVQFHPEVTHTKSGLALLTNFVVNICGCTTNWTPENIIEDAVARIKAQVGDDEVILGLSGGVDSSVTALLLHRAIGKNLHCVFVDNGLLRLNEGDQVMEMFGDKFGLNIIRVNAEDRFLDALKGIDEPESKRKMIGKVFVDVFDEESHKQTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELYNSGWYYKVSQAFTVFLPVKSVGVMGDGRKYDWVVSLRAVETIDFMTAHWAHLPYDLLGKISNRIINEVDGISRVVYDVSGKPPATIEWE

SEQ ID NO: 72494 - protein, 406 aa, Methanopyrus kandleri AV19
MYENISTMDDFEFENKWVLLRIDINSTVIDGKIEDDERIKRHLGTIKELMEHDARVAILAHQGRPGEDDFTTLEPHAEIMSEELDNFEYVPDVFGPTAKKKIRSLEPGEVILLENVRFYSEERINRDPEWHARRHLVRNLAPLFDIFVNDAFAAAHRSNASLVGFTRRLPSCVGRVMEREIEVLETMVRDEMEDGVFVIGGSKIEDAIKVIRRAIEMDNVRRVLLGGLVGNLFLWASGVDLGKPSRKFLDMKGYTGYLDEARELLEEGDDVILVPEDVALNRGGEREEVDVDELPADAPVFDIGTGTIERYRKEVESAGMVVANGPMGVYEEPGFEKGTYEVLNAIADSEAFSVIGGGHIIAAAKACGAYDSIDHVSTGGGAMLRMLAGERLPAIDAILTCPFSGC

SEQ ID NO: 72495 - protein, 111 aa, Vitis vinifera
MEKFRLYDGSDVGPFRYSSTSTVDMLKERVVSDWPKGKTIIPKAANEVKLISSGKILENDKTVGQCRIPFGELAGGVLVMHVVVQPSLAKTKTEKKIDKSPKKVVCSCSIL

SEQ ID NO: 72496 - protein, 406 aa, Aquifex aeolicus VF5
MGEIFVAGVNFKVAPVEVREKLACSLEETKKVLPILKRETPLEEVMLLSTCNRVEVYAYNFVENSEDLINKLLEIKRLNPSFKRYFFVKRGEEAVYHIFKVASSLDSMVIGEPQIVAQFKEAYRVAKEAGTVGKILNRVYEKALRASKRVRTETGISRSAVSVSYAAVELAKKIFGDLKEAKVLLIGAGEMGELAANYLRRFGAKLHITNRTYERALKLVKELSGNVLRFEELKEYLPLMDIVIVSTGAKDYILKREDFERSVRERHYEPQFVIDIAVPRNVDPEAGNVEGVFLYDIDDLKQVVEENLKERIKEAQRGEIILWDEVKKFMNWYESLKAEPYILELKASVEGKEVSPYIKKLVHRAIKEIKRNPEVADIILRIFKEVEKNEPRRKELSNVYNGTHGA

SEQ ID NO: 72497 - protein, 150 aa, Haloarcula japonica
ERTFVMVKPDGVQRGLIGDIVSRFEDRGLKMVGGKFMQIDQELAEEHYGEHADKPFFDGLVDFITSGPVFAMVWEGQDATRQVRNMMGETDPAESAPGTIRGDYGLDLGRNVIHGSDHEDEGANEREIELFFDEDELVDWDQIDSSWLYE

SEQ ID NO: 72498 - protein, 176 aa, Triticum aestivum
  misc_feature (156)..(156): Xaa can be any naturally occurring amino acid
MAPTVMASSATSVGPFQGLKSTVGLPVSRRSNGASLGSVSDGGRIRCMQVWPMEGIKKFDTLSYLPPIRTEALLKQVDYLIRSKWVPCLKFSKVGCIFREHNASPGYYDGRYWTMWKLPMFGCTDATQVINEVEEVKKEYPDAYVRIIGCDNMRHXVTASSFIAFKPPGCEESGKA

SEQ ID NO: 72499 - protein, 58 aa, Glycine max
MATIKAVKARQIFDSRGNRTGQVDVILSDGSFHRAAVPSGASTGVYEALELRDGGSYY

SEQ ID NO: 72500 - protein, 270 aa, Corynebacterium melassecola
MTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKH

SEQ ID NO: 72501 - protein, 522 aa, Vitis vinifera
MASSPFFHSSLTPKPRPSVIRPGGNGRYLPIIKCTSSTFDPSTPAAKHRRPAVENIREEARRIRSADAAAAGQQFSAKYVPFNAGPDSSESYSLDEVVYRSRSGGLLDVEHDMQALKRFDGEYWRALFDSRVGKTTWPYGSGVWSKKEWVLPEIDSDDIVSAFEGNSNLFWAERFGKQFLGMNDLWVKHCGISHTGSFKDLGMTVLVSQVNRLRKMNSPVVGVGCASTGDTSAALSAYCASAGIPSIVFLPANRISIAQLVQPIANGAFVLSIDTDFDGCMKLIREVTSELPIYLANSLNSLRLEGQKTAAIEILQQFDWEVPDWVIVPGGNLGNIYAFYKGFKMCHELGLVDRIPRLVCAQAANANPLYQYYKSGWTEFKPVKANSTFASAIQIGDPVSIDRAEFALKNSNGIVEEATEEELMDAMANADSTGMFICPHTGVALAALIKLRNSGVIGPTDRTVVVSTAHGLKFTQSKVDYHSKKIPDLACRFANPPVEVKADFGAVIDVLKKHLSSKTRKH

SEQ ID NO: 72502 - protein, 315 aa, Fulvimarina pelagi HTCC2506
MYLSCGDALFDLFGEKEGDDVAAIDLAGRVGGSPLNVALGIARLGHPTGFFTKISSDVFGRRLARFMDQEKIDRRYSIPTERHTTLAIVSLDETGTAVYDFYIEGTADRSIETSELPRTLDDVVGIHLASYATVTEPTASALSALAKRESAKKFISYDPNIRLSIEPDVEVWRAKVAQLVAQSTLVKASEEDLELLYPGRSIEDVQADWLALGPELVVITLGGKGAKAASRSGLRAFEESQRITVVDTVGAGDTFQAGLIVWLMENHRLSRTGLAECSETDLHAMLSFAMKAAAVTCSRQGADLPRRADLGLSPL

SEQ ID NO: 72503 - protein, 323 aa, Klebsiella pneumoniae subsp. pneumoniae MGH 78578
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEQFLLLQQFSNPANPEIHEKTTGPEIWEDTDGQVDVFISGVGTGGTLTGVSRYIKNTKGKKDLITVAVEPTDSPVIAQALAGEELKPGPHKIQGIGAGFIPGNLDLKLVDKVIGITNEEAISTARRLMEEEGILAGISSGAAVAAALKLQEDEAFTNKNIVVILPSSGERYLSTALFADLFTEKELQQ

SEQ ID NO: 72504 - protein, 326 aa, Leuconostoc mesenteroides
MELFEQLKNKITGQNKTIVFPEGEDPRIQGAAIRLAADNLIEPILLGDAQEISKTAQAHNFDLSNIETIDPASYDKNELAKLNATLVERRKGKTDAETAAKWLQNVNYFGTMLAYTGKADGMVSGAVHPTGDTVRPALQIIKTAPGSSRISGAFIMQKKAKERYVFADAAINIDIDSDTMAEIAIQSAHTAQVFDIKPKVAMLSFSTKGSAKSPLVDKVATATALAKKLAPELADSIDELQFDAAFVECSCCRKAPDSKVAGKANTFIFPSLEAGNIGYKIAQRLGGFEAIGPILQGLAKPVSDLSRGANEEDVYKVAIITRAQAL

SEQ ID NO: 72505 - protein, 386 aa, Vitis vinifera
MATCRIECWKKNHFFAEYNSKLLESTNYITRRQAVKLLGDILLDRSNSVVMTRYVSSRDNLRILMNLLRVWSQARVFRLKLFMFSSCLLLIKTSPRDIVSILVANKSKLLRLFADFKTEKGSLSQFLETAVDAAKRAGEIIRRGFYQTKNVEHKGQVDLVTETDKACEDLIFNHLQQHYPEHKLIGEETTAACGTMELTDSPTWIVDPLDGTTNFVHGFPFVCVSIGLTIGKVPAVGVVYNPILDELFTAIRGKGAFLNGKPIKVSSQTELVKSLLATEVGTKRDKSTVDATTNRINGLLFEVRSLRMSGSCALNLCGIACGRLDLFYELGFGGPWDVAGGALIVEEAGGLVYDPSGKDFDIISQRVAASNPHLKDAFVKVLGQSV

SEQ ID NO: 72506 - protein, 191 aa, Triticum aestivum
  misc_feature (141)..(141): Xaa can be any naturally occurring amino acid
MAAAECGSREERWSLAGATALVTGGSKGIGGAIVEELAGFGARVHTCSRNAAELEECCLRWEEKGMRVTVSVCHVSVPADREKLMDTVRQTFDGKLSILVNNAGQHLVKPTVECTMEEYKNVMATNLESSFHLCQLARPLXARAVGGNIINISSIASSIGFAGSTIYTITKDQIAEAEAEEVHDGGRRQRR

SEQ ID NO: 72507 - protein, 195 aa, Brassica napus
  misc_feature (180)..(180): Xaa can be any naturally occurring amino acid
MSGPLDRFARPCFEGFLSSDEKKERKSDFENSEDERRTRIGSLKKKAINASTKFKHSLKKKSGRRKSDGRVSSVSIEDVRDVEELQAVDAFRHALLIDELLPSRHDDYHMMLRFLKARKFDIEKAKHMWSDMIQWRKEFGTDTILQDFDFEEINEVLKYYPHGYHGVDKEGRPIYIERLXGKVDPKQLYAVTSMD

SEQ ID NO: 72508 - protein, 575 aa, Klebsiella pneumoniae subsp. pneumoniae MGH 78578
MISGILASPGIAFGKALLLKEDEIVIDRKKISADKVDQEVERFLSGRAKASAQLEVIKTKAGETFGEEKEAIFEGHIMLLEDEELEQEIIALIKDKHMTADAAANEVIDGQATALEELDDEYLKERAADVRDIGKRLLRNILGLAIIDLSAIQDEVILVAADLTPSETAQLNLNKVLGFITDAGGRTSHTSIMARSLELPAIVGTGSITAQVKNGDYLILDAVNNQVLINPSNEQIEALRSLQAQVAEEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAVRIAMDRKEILRDQVRAILRASAFGKLRIMFPMIISVEEVRALKKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 72509 - protein, 446 aa, Oryza sativa
MRSPVGRREVVVSGVFTALLVLSILSLPSLLLTGPAYKSWPFLAAARDDSTTGSGGGAGYYPVSFAYLISASTGDAARAARLLAALYHPANCYLLHLDREAPAEEHRRLAELVSGQPVYARAGNVWIVGRPNLVTYRGPTMLSTTLHAVAMLLRLGRRWDWFVNLSASDYPLVTQDDLMDVFSRLPRDLNFIQHTSHLGWKIKKRARPVILDTALYEADRSELIRPANLTTNRRNLPTAFKLFTGTGSTHLGIWHTKRKSYLKPYLVNGAGSAWTMMSRQFAEYFTVGYDDNLPRTLLLYYTNFVSSPEFYFQTLACNSRRFRNTTVNHDLHFIRWDSPPKQHPLYLGPRDYRRMLLSAAPFARKFREDDPVLDRIDRDILRRDGAAPGRAFAYGGWCSEGGVRLCSNPQEAGRKGMIKAGAGSRRLRAMLNKMMNARNFRRQQCR

SEQ ID NO: 72510 - protein, 168 aa, Triticum aestivum
  misc_feature (44)..(44): Xaa can be any naturally occurring amino acid
MASGAVRPKLAYIVCYVDDVVKAAAFYADAFGYSVRRVDDSHKXSPSPFAPRPTLAACRASLTCVCIVCSARRWAELDTGSTTIAFTPLHQRETDALTGEVQLPKSPRERGPVEICFDYDDVDAAYRRAVENGAVPVSAPEQKNWGQKVGYVRDCDGITVRLGSHVRE

SEQ ID NO: 72511 - protein, 414 aa, Burkholderia sp. 383
MRPFFLLPRLPRPARPMNTATDSLVRLAARVDAIQPFYVMELMKEAQRLESSGRDVIHMGIGEPDFTAPEPVVEAAAAALRRGVTQYTSALGIAPLREAIAAHYARAYGLTISPERIVVTAGASAALLLACLALVGRDDEVLMPDPSYPCNRHFVAAAEGRAVLVPSGPDARFQLTEDDVRTRWGDRTRGVLLASPSNPTGTSLEPDELKRIVEAVRARGGFTIVDEIYQGLSYDAAPVSALSFGDDVVTVNSFSKYFSMTGWRLGWLVVPPALVGTFEKLAQNLFICPSALAQHAALACFEPAALDIYEARRLEFKRRRDFIAPALERLGFTVPVMPDGAFYVYAHCGGVAHPAAGDSAALTTAMLHDAGVVLVPGMDFGVHAPRDYIRLSYATAYSRLEEAVDRLATLFGQH

SEQ ID NO: 72512 - protein, 172 aa, Burkholderia sp. 383
MEIGQYQPNLEGDGLRIGIVQSRFNEPVCNGLADACVEELERLGVTGEDVLLVSVPGALEIPLALQKLAESGQFDALIALGAVIRGETYHFELVSNESGAGITRIGLDFNLPIANAVLTTENDEQAVARMTEKGRDAARVAVEMANLTMALDQLGDDDEDEEEDEDDEEERA

SEQ ID NO: 72513 - protein, 528 aa, Vitis vinifera
MGNCNGLPSGDTQFQINAGRDGGVRPSSHAHSSNGLNVRPPSPSPPPPPRTAAPVVHRPLAGNGRVLGRPMEDVRQTYIFGRELGRGQFGVTYLVTHKETKEQFACKSIATRKLVNRDDIEDVRREVQIMHHLTGHRNIVELKGAYEDRHSVNLVMELCAGGELFDRIIAKGHYSERAAAALCRQIVTVVHNCHTMGVMHRDLKPENFLFLSTAEDSPLKATDFGLSVFFKPGDVFKDLVGSAYYVAPEVLRRSYGAEADIWSAGVILFILLSGVPPFWGENEQSIFDTILRGHIDFSSDPWPSISNSAKDLVKKMLRADPKERLTAIDVLNHPWMKEDGASDKPIDIAVLTRVKQFRAMNKLKKVALKVIAENLSEEEIIGLKEMFKSMDTDNSGTITYEELKNGLPKLGTKLSESEVRQLMEAADVDGNGTIDYIEFISATMHMNRMEREDHLYRAFEYFDKDKSGYITMEELEHALKRYNMGDEKTIKEIIAEVDTDHDGRINYEEFAAMMRKGNPDLITNRRRK

SEQ ID NO: 72514 - protein, 640 aa, Debaryomyces hansenii CBS767
MSLISNRKRPRGFSEAFDTTSDKTAANKTKTSNGYFDTNSSSSGSTYNEISPSSSNNLNLNMNINLNESDTTINTNDSNNKKVNFGMDGYNKDHAVIEDLDSECDEDDDIIILEERQIKSTKSKRNNSDSVLTYTDAFAAYNMFNVNNTEDFEISHTSFSISNTSKKQRTNSLPQLPQVKCFYNKPINYVLQYPKLGNIRTDIIPHQMNLPPCDDKDGHYIIKINDLFANRFVILKLLGQGTFGKVVECYDKVNRETVAIKIIRNIPKYRDAAKIELRILSTLKKFDNQNDNHCIHLRECFDFRGHICIVTDLLQISLYDFLEKNKYIAFPGSHIQAISKQLIRSVTFLHDLSLIHTDLKPENILLHDDSFNKKLLRSNTITASYISLTKLNESSSKKIPKYSKILKNPLIQIIDFGSAIFDDEYHSSIVSTRHYRAPEIVLGVGWSFPCDMWSVGCILVELVIGEPLFKTHDNLEHLAMIEKVCGHKIDKSMVLLSKAKENECGLQYFTDEYNGFSDDESEQDDDVIVDDELTRGNSLSLIFPTESTPQKFINSVNLLARIDLFISSRIGLNINLDYSLSKNFDKNKHLINFGNFTFWWFFIDLLKNLLIINPDERLTALEALDHPWFNLGIEDEGTVG

SEQ ID NO: 72515 - protein, 200 aa, Oryza sativa Japonica Group
MGGGSPCASCKLLRRRCTKDCIFAPFFPADDPHKFAIVHKVFGASNVSKMLQELPAQQRGDAVSSLVYEANARMRDPVYGCVGAISFLQNQVSQLQMQLAVAQAEILCIQMQHRDDGAAHQLDAAADHHPLLDQQQQQQMVVDAADAAASFLVQNGGGGGGPAAQLISGYGSPAAGGGGGHGVVHYAAAQEHLKRESLWT

SEQ ID NO: 72516 - protein, 285 aa, Glycine max
MTLRFESVVWALNPKLSHHRFSIPNLRRNPHSLFAPPPPPRIRTSFLAFEEGGGGEIEPEKNENNNDNRTGAEESWKQALDTFREQASKIRDASQEAYELYSEKAIAVLKDATEELRVAAKEIGDEGKQYLTVVAENSPEVKEVVESFTSPSRDLSEISQLRDFYVGVPYGLVLSVGGFVSFMVTGSIAALRFGIVLGSVLLALGVSSLRAYKRGQPSSLMLKGQTAIASILFLREIRLLAAEGSPLVTYFTSLISGAVVAFYVYRLVLEHKQKNASNLENGAEN

SEQ ID NO: 72517 - protein, 150 aa, Haloarcula sinaiiensis
ERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 72518 - protein, 420 aa, Methylococcus capsulatus str. Bath
MAILTLGVNHTTAPVSIRERLAFPAEQLQSALRDLIDLPQVGEAAILSTCNRTEVYCELDGRDQRPIVDWMCDQRQFDDQDISQYLYSHFDAGTIRHMFRVACGLDSMILGEPQILGQMKTAYQAAREAGTVGKILTKLFHRTFAAAKKVRTDTAIGCSPVSVAFAAIRLAQRIFDDLGDLTAILVGAGETIELTARHLTENRIGHLIIANRTFDRAHTLANQFGGFAISLEELPKHLAKADIIVASTGSPLPILGKGSFESALRSRRHKPMFIVDLAVPRDIEPEVEQLQDVYLYTVDDLQHTVEENLKTRQEAALQAEEIIDLEVEHFLSWLRAQAATETIRDVRRQAELHRDAALQRALRELRRGKSAEDTLRWLADTLTNKIIHAPSSQIWQAGVNERADIVAAARELFQLKDPDT

SEQ ID NO: 72519 - protein, 332 aa, Gloeobacter violaceus PCC 7421
MVFPDLLPRRSTVQPVRLMGDERLRLFSGSANPELAQLVARYLGLAPGPLVRKSFADGELYVQIQESIRGCDVYLVQPTCSPVNDSLMELLILIDACRRASARQITAVLPYYGYARADRKTAGRESITAKLVANLITAAGVDRVLAMDLHSAQIQAYFDIPLDHVYGSPVLLQYIKEKQLGDMVIVSPDVGGVSRARAFAKKLDDAPLAIVDKRRQAPNEVEVMNVIGDVKGKTAILVDDMIDTAGTISEAAKVLLRQGAKEVYACATHAVFSSRAIDRLSDGTFTEVLVTNTIPVPPDRRFPQLRVLSVADLIGEAIWRIHEDSSVSSMFR

SEQ ID NO: 72520 - protein, 334 aa, Yersinia pestis CO92
MEYMTIKVGINGFGRIGRIVFRAAQERSDIEIVAINDLLDADYMAYMLKYDSTHGRFDGTVEVKDGHLVVNGKTIRVTAERDPANLKWNEVNVDVVAEATGLFLTDETARKHIAAGAKKVVLTGPSKDDTPMFVMGVNHKAYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLEKPASYKEICAAIKAASEGELKGVLGYTEDDVVSTDFNGEKLTSVFDAKAGIALNDNFVKLVSWYDNETGYSNKVLDLISHISK

SEQ ID NO: 72521 - protein, 205 aa, Ehrlichia ruminantium str. Welgevonden
MNLITKQAIDFTAKAVMPDDKICEFNLKQYISGKYAILVFYPRDFTFVCPTEIISLHNRIPQFIEKNTEIIGISTDSEFCHSHWRNISVNKGGIDKISFPLIADDSHSISNNYGVLYNNSIALRATFIIDDHFIVRHQSINDLPIGRNVDELLRIIDAIKHHQIHGEVCPAGWIKGDPAMEASQHGIEDYLKSHIDNLEKSIMDK

SEQ ID NO: 72522 - protein, 343 aa, Mannheimia succiniciproducens MBEL55E
MSQYTRKTFDEVMIQNYVPADFIPVKGKGCKVWDQQGRDYIDFTSGIAVNALGHCPDEIVDVLKKQGETLWHSSNWFTSEPTLELASKLVEHTFAERVMFANSGGEANEAALKLARRYAVDNYGYQKDTIISFKKSFHGRTLFTVSVGGQAKYSDGFGPKPAGIVHLPFNDLDAVKAMIDDHTCAVIVEPIQGESGIIPATKEFLQGLRRLCDENNALLIFDEVQTGVGRTGYLYAYESYDVVPDILTSSKALANGFPISAMLTTTKIAASFKPGVHGTTFGGNPLACAVGAKVIETIANPAFLENVQKTSALFISELNKLNEKYHLFNEVRGQGLLIGGGIN

SEQ ID NO: 72523 - protein, 399 aa, Ehrlichia ruminantium str. Welgevonden
MSFLSKRMECIKPSPTLEIASQAQKLKMLGRDIISLSAGEPDFDTPEHIKQAAINALNLGKTKYTAVDGIIELKKAIISRLKQDHNLIYDVSQISVGNGAKQCIYNLFMSTLNDGDEVIIPAPYWVSYPDIVKIAGGNPVIIDCSSTSKLSAELLENAITDKTKWLILNSPNNPSGLVYTYDELKDIAQVLLKYSNVHIMTDDIYSKIVYDDLKFFTIAQVEEDLYSRVFLVNGVSKAYAMTGWRIGYIAGASEVIKAISVIQSQSTTNPNSIAQFAAVEALTGDQKFLEERNKVFIERRDIMLDMINNTPLLSAEKPQGAFYVFISCKELIGRTTKSGFCITSAMDFTKYLLEDYNIAVVPGEAFGVQGFFRVSYATSTQCVSEACDRILTACNELIY

SEQ ID NO: 72524 - protein, 215 aa, Triticum aestivum
MSLARILCRATGMKAAAPLRSAPKLFGRSSLMAPNSVAFKPAAFRRAAFGLCASRFFHNSAARLSPEFTSKAMVQSPAPAWKADAVVNGQFKTVSSTDYKGKWLVLFFYPLDFTFVCPTEIIAFSDRANEFRALGCEVVGASVDSKFSHLAWINLPRKEGGLGKMDIPLIADLDKKISKDYGVLLPAGIALRGLFIVDPSGTLRISTVNDLPIAA

SEQ ID NO: 72525 - protein, 272 aa, Bacillus anthracis str. Ames
MDKQIGFIGCGNMGMAIIGGMLNKKIVSSNKIMCSDLNTTNLENASEKYGISITTDNNEVAKNADILILSIKPDLYASVINEIKEEIKSDVIVVTIAAGKSVKSTEDSFDTKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETGIHPGELKDMVCSPGGTTIEAVATLEEKGLRTAIISAMQRCTQKSVELSGQTKK

SEQ ID NO: 72526 - protein, 286 aa, Hordeum vulgare
MAKDIEAAPQGGEFSSKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 72527 - protein, 329 aa, Vitis vinifera
MGSSSGSDVEAGFAKLQGEDFEYYMQTYSIILGRNSKKSTVDVDLSSLGGGMNISRHHARIFYDFQRRRFALEVLGKNGCLVEGVLHLPGNPPVKLDSQDLLQIGDKEFYFLLPVRSILGGTGASVRHHHSAASLHLPPPPPAPIPGRISVASGIGGKKGRGGRLLSEYFDDDYDDEEGSGSGKKMRREGHEVFGGKAGLSGQLVLVDKKAEARSRVDRDADNHQLLQLEEKDVVSSVATVLSDLCGPGEWMPMEKLHAELVEQYSSVWHHSRVRKYLTSEEWSSPESKGKPWFGLLMLLRKYPEHFVINTRSKGRITLEFVSLVSLLS

SEQ ID NO: 72528 - protein, 254 aa, Exiguobacterium sibiricum 255-15
MLNQFSRNELAIGKTGLDALASKSVAILGIGGVGSFSAEALARSGVGRLILVDKDDIDITNVNRQIHALLPTVGQPKVDAMADRLMQINPDLEIVRLKMFYNEETYETFFAENPDYVIDASDTVSFKIHLIKECKQRQIPIISSMGMANKMDPTRIKIVDIKDTTYDPLAKVIRTRLRKEGIHKGVPVVFSDEPPVKIIEEVRQVVGNDEAVIRKAKMPPSSNAFVPSVGGLIAASYVINEIVREAGVVIERVR

SEQ ID NO: 72529 - protein, 474 aa, Bacillus anthracis str. Ames
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 72530 - protein, 102 aa, Brassica napus
EAKGCAPNDVTYNTLLYGLCKGRLMDKGIEFYEMMKSKGLKLESYAYATLVRALVRSGKVAEAYEVFDYAVGSKSLSDASAYATLETSLKWVKKAKEQGLAD

SEQ ID NO: 72531 - protein, 380 aa, Burkholderia sp. 383
MTLASTLDIIAELKAGRMVILVDEEDRENEGDLVIAAEFVTPEAINFMAKYGRGLVCLTLTQERCKQLHLPLMTYRNGTQYGTAFTVSIEAAEGVTTGISAADRARTIATAVAHDVRPEHIVQPGHVFPIMAQPGGVLVRAGHTEAGCDFTALAGLTPAAVICEIIKDDGTMARLPDLIEFAQEHNLKIGTIADLIQYRSRTESIIERIAERTMQTAHGTFRAVLYRDQPSGSPHIALVRGAPSPDVDTPVRVHEPLSVLDLLETGVSTHSWTLDAAMREIAERDLGVIVLLNCGDTKEHLIDVFKAFDEEEKAAALKRRPVDFKTFGIGAQILRDVGVSKMQVLSNPRKLGSMSGYGLEVTGFIPMPGGEAKSCPASNA

SEQ ID NO: 72532 - protein, 418 aa, Glycine max
  misc_feature (236)..(236): Xaa can be any naturally occurring amino acid
MEMASSSFILGSDFKCMFSSRNTKTMSGFGALRHPHPNGLFSKCFHFHTLSTRTVSGTTKMVSDVYVGGVTSFRVNSKMYTKLDSCLVIPPTPNRAKPRAIVKFLGGAFIGAVPEVTYGYLTELLAKEGFLVVVVPYNVTFDHSQAAKQVYERFQACLGTILTSGIFSENKLPAQLEDLPLFSIGHRLVVCLMLSIILTGINVMKRNIFLANAIIAYNNRPATEAVPYFEQCCPAXLGPAVSQMMPVVEATPFYSIARNASGDVWKMMLDAVRSTLQETEQEILNSLTKFVDQLPSVMNEVTQGVSEFKPTPSENRDCFKCLYNVEHTLLVKFNSDAIDETDILEETLKLRVESLGGTLEKVTLSGNHITPCIQEPRWQVGKLYTPADAVAQGLKSLSLNDTKILARTISDWFRRFEG

SEQ ID NO: 72533 - protein, 1049 aa, Oryza rufipogon
MQPPHFSYKTQSNRLPIPVLSLALVLLLNFTSPTSSCTEQEKNSLLNFLTGLSKDGGLSMSWKDGVDCCEWEGITCRTDRTVTDVSLPSRSLEGYISPSLGNLTGLLRLNLSYNLLSSVLPQELLSSSKLIVIDISFNRLNGGLDKLPSSTPARPLQVLNISSNLLAGQFPSSTWVVMANLAALNVSNNSFTGKIPTNFCTNSPSLAVLELSYNQFSGSIPPELGSCSRLRVLKAGHNNLSGTLPDEIFNATSLECLSFPNNNLQGTLEGANVVKLGKLATLDLGENNFSGNIPESIGQLNRLEELHLNNNKMFGSIPSTLSNCTSLKTIDLNSNNFSGELMNVNFSNLPSLQTLDLRQNIFSGKIPETIYSCSNLTALRLSLNKFQGQLSKGLGNLKSLSFLSLGYNNLTNITNALQILRSSSKLTTLLISNNFMNESIPDDDRIDGFENLQVLDLSGCSFSGKIPQWLSKLSRLEMLVLDNNQLTGPIPDWISSLNFLFYLDVSNNNLTGEIPMALLQMPMLRSDRAAAQLDTRAFELPIYIDATLLQYRKASAFPKVLNLGNNEFTGLIPQEIGQLKALLLLNLSFNKLYGDIPQSICNLRDLLMLDLSSNNLTGTIPAALNNLTFLIEFNVSYNDLEGPIPTGGQFSTFTNSSFYGNPKLCGPMLTHHCSSFDRHLVSKQQQNKKVILVIVFCVLFGAIVILLLLGYLLLSIRGMSFTTKSRCNNDYIEALSPNTNSDHLLVMLQQGKEAENKLTFTGIVEATNNFNQEHIIGCGGYGLVYKAQLPDGSMIAIKKLNGEMCLMEREFSAEVETLSMARHDNLVPLWGYCIQGNSRLLIYSYMENGSLDDWLHNKDDDTSTILDWPRRLKIAKGASHGLSYIHNICKPRIVHRDIKSSNILLDKEFKAYIADFGLSRLILPNKTHVPTELVGTLGYIPPEYAQAWVATLKGDVYSFGVVLLELLTGRRPVPILSTSKELVPWVQEMVSNGKQIEVLDLTFQGTGCEEQMLKVLEIACKCVKGDPLRRPTMIEVVASLHSIDPDGLT

SEQ ID NO: 72534 - protein, 1046 aa, Oryza rufipogon
MQPPHSSCKTQSNRFPIPVLGLALVLLLNFTSPTSSCTEQEKSTLLNFLTGFSQDGGLSMSWKDGMDCCEWEGINCSQDKTVTEVSLPSRSLEGHISPSLGNLTGLLRLNLSYNLLSGAIPQELVSSRSLIVIDISFNHLNGGLDELPSSTPARPLQVLNISSNLFKGQFPSSTWKVMKNLVKLNVSNNSFSGHIPTNFCTNSPSFAVLELSYNQFSGGVPPELGNCSMLRVLKAGNNNLSGTLPDELFNATSLECLSFPNNNLEGNIGSTPVVKLSNVVVLDLGGNNFSGMIPDTIGQLSRLQELHLDNNNLHGELPSALGNCKYLTTINLKSNSFSGDLGKVNFSTLPNLKTLDIDMNNFSGKVPESIYSCSNLIALRLSYNNFYGELSSEIGKLKYLSFLSLSNNSFTNITRALQILKSSTNLTTLFIAYNFMEEVIPQDETIDGFENLQALSVDHCSLSGRIPLWLSKLTNLKLLFLSNNQLTGPIPDWISSLNRLFYLDISNNSLAGEIPITLMDMPMIRTTQNKTYSEPSFFELPVYDGKFLQYRTRTAFPTLLNLSLNKFMGVIPPQIGQLKMLVVLDFSHNNLSGQIPQSVCSLTSLRVLDLSNNNLTGSIPGELNSLNFLSAFNVSNNDLEGPIPIGAQFSTFPNSSFDGNPKLCGSMLTHKCKSAEEASASKKQLNKRVILAIVFGVLFGGAAIVLLLAHFLFSLRDAIPKIENKSNTSGNLEAGSFTSDPEHLLVMIPRGSGEANKLTFTDLMEATDNFHKENIIACGGYGLVYKAELPSGSTLAIKKLNGEMCLMEREFAAEVEALSMAQHDNLVPLWGYCIQGNSRLLIYSYMENGSLDDWLHNRDDETSSFLDWPTRFKIARGASQGLSYIHDVCKPHIVHRDIKSSNILLDKEFKAYVADFGLSRLILPNKNHITTELVGTLGYIPPEYGQGWVATLRGDVYSFGVVLLELLTGRRPVSILSTSEELVPWVLEMKSKGNMLEVLDPTLQGTGNEEQMLKVLEVACKCVNCNPCMRPTITEVVSCLDSVGSD

SEQ ID NO: 72535 - protein, 1051 aa, Oryza rufipogon
MQPLHFPSYRYSSKLPTISSLSLGLLLLISLASLTSSCTEQEKGSLHQFLAELSQDGNLSMSWRNDRNCCVWEGITCNRNGAVTDISLQLKGLEGHISPSLGNLTSLLRLNLSHNSLSGYLPWELVSSSSISVLDVSFNRLRGELQDPLSPMTAVQPLQVLNISSNSFTGQFPSTTWKAMKNLVALNASNNRFTGQISDHFCSSSPSLMVLDLCYNLFSGGIPPGIGACSRLNVLKVGQNNLSGTLPDELFNATSLEHLSVPNNGLNGTLDSAHIMKLSNLVTLDLGGNNFNGRIPESIGELKKLEELLLGHNNMYGEVPSTLSNCTNLKTIDIKSNSFSGELSKINFSTLPNLQTLDLLLNNFNGTIPQNIYSCSNLIALRMSSNKFHGQLPKGIGNLKSLSFLSISNNSLTNITDTLQILKNSRSLSTLLMGVNFNGELMPEDETIDGFENLQFVSIDDCSLIGNIPFWLSKLTNLQMLDLSNNQLTGQIPAWINRLNFLFYLDISNNSLTGGIPTALMEIPRLISANSTPYFDPGILQLPIYTGPSLEYRGFRAFPATLNLARNHLMGAIPQEIGQLKMLRTLNISFNSISGEIPQPLCNLTDLQVLDLSNNHLIGTIPSALNNLHFLSKLNVSNNDLEGSIPTGGQFSTFQNSSFVGNSKLCGSNIFRSCDSSRAPSVSRKQHKKKVILAITLSVSVGGIIILLSLSSLLVSLRATKLMRKGELANNRNEETASFNPNSDHSLMVMPQGKGDNNKLTFADIMKTTNNFDKENIIGCGGYGLVYKAELPDGSKLAIKKLNSEMCLMEREFTAEIEALTMAQHDNLVPLWGYCIHGNSRLLIYSYMENGSLDDWLHNRDDDASSFLDWPTRLKIAQGASLGISYIHDVCKPHIVHRDIKSSNILLDKEFKAYIADFGLSRLILPSKTHVTTELVGTLGYIPPEYGQSWIATLRGDIYSFGVVLLELLTGRRPVPLLSTSKELVPWVQEMRSVGKQIEVLDPTVRGMGYDEQMLKVLETACKCVNYNPLMRPTIMEVVASLDSIDADRNT

SEQ ID NO: 72536 - protein, 1049 aa, Oryza rufipogon
MHPLHSPCKKHSNKFPIPVLALALVLLINLASLTSSCTEQDRSSLLRFLRELSQDGGLAASWQDGTDCCKWDGITCSQDSTVTDVSLASRSLQGRISPSLGNLPGLLRLNLSHNLLSGALPKELLSSSSLITIDVSFNRLDGDLDELPSSTPARPLQVLNISSNLLAGQFPSSTWVVMKNMVALNVSNNSFSGHIPANFCTNSPYLSVLELSYNQLSGSIPPGFGSCSRLRVLKAGHNNLSGTIPDEIFNATSLECLSFPNNDFQGTLEWANVVKLSKLATLDLGENNFSGNISESIGQLNRLEELHLNNNKMFGSIPSNLSNCTSLKIIDLNNNNFSGELIYVNFSNLPNLKTLDLMRNNFSGEIPESIYTCSNLTALRVSSNKLHGQLSKGLGNLKSLSFLSLAGNCLTNIANALQILSSSSNLTTLLIGHNFMNERMPDGSIDGFENLQVLSLSECSLSGKIPRWLSKLSRLEVLELDNNRLTGPIPDWISSLNFLFYLDISNNSLTGEIPMSLLQMPMLRSDRAAAQLDRRAFQLPIYISASLLQYRKASAFPKVLNLGKNEFTGLIPPEIGLLKVLLSLNLSFNKLYGDIPQSICNLTDLLVLDLSSNNLTGTIPAALNNLNFLSEFNISYNDLEGPIPTGGQLDTFTNSSFYGNPKLCGPMLVRHCSSADGHLISKKQQNKKVILAIVFGVFFGAIVILMLSGYLLWSISGMSFRTKNRCSNDYTEALSSNISSEHLLVMLQQGKEAEDKITFTGIMEATNNFNREHIIGCGGYGLVYRAELPDGSKLAIKKLNGEMCLMEREFSAEVETLSMAQHDNLVPLLGYCIQRNSRLLIYSYMENGSLDDWLHNKDDGTSTILDWPRRLKIAKGASHGLSYIHNICKPRIVHRDIKSSNILLDKEFKAYIADFGLSRLILPNKTHVTTELVGTLGYIPPEYGQAWVATLKGDVYSFGVVLLELLTGRRPVPILSTSKELVPWVQEMISEGKQIEVLDSTLQGTGCEEQMLKVLETACKCVDGNPLMRPTMMEVVASLDSIDPDLKMQ

SEQ ID NO: 72537 - protein, 1063 aa, Oryza rufipogon
MQKQQQLHSSCKKCSNRCFIDFLRFNLAFALLLLLSLASPTSSCTEQERSSLLQFLSGLSNDGGLAVSWRNAADCCKWEGVTCSADGTVTDVSLASKGLEGRISPSLGNLTGLLRLNLSHNSLSGGLPLELMASSSITVLDISFNHLKGEIHELPSSTPVRPLQVLNISSNSFTGQFPSATWEMMKNLVMLNASNNSFTGHIPSNFCSSSASLTALALCYNHLSGSIPPGFGNCLKLRVLKVGHNNLSGNLPGDLFDATSLEYLSFPNNELNGVINGTLIVNLRNLSTLDLEGNNIAGWIPDSIGQLKRLQDLHLGDNNISGELPSALSNCTHLITINLKRNNFSGNLSNVNFSNLSNLKTLDLMGNKFEGTVPESIYSCTNLVALRLSSNNLQGQLSPKISNLKSLTFLSVGCNNLTNITNMLWILKDSRNLTTLLIGTNFYGEAMPEDNSIDGFQNLKVLSIANCSLSGNIPLWLSKLEKLEMLFLLDNRLSGSIPPWIKRLESLFHLDLSNNSLIGGIPASLMEMPMLITKKNTTRLDPRVFELPIYRSAAGFQYRITSAFPKVLNLSNNNFSGVIPQDIGQLKSLDILSLSSNNLSGEIPQQLGNLTNLQVLDLSSNHLTGAIPSALNNLHFLSTFNVSCNDLEGPIPNGAQFSTFTNSSFYKNPKLCGHILHRSCRPEQAASISTKSHNKKAIFATAFGVFFGGIAVLLFLAYLLATVKGTDCITNNRSSENADVDAPSHKSDSEQSLVIVSQNKGGKNKLTFADIVKATNNFDKENIIGCGGYGLVYKADLPDGTKLAIKKLFGEMCLMEREFTAEVEALSMAQHDNLVPLWGYCIQGNSRLLIYSYMENGSLDDWLHNRDDDASTFLDWPKRLKIAQGAGRGLSYIHDACKPHIIHRDIKSSNILLDKEFKAYVADFGLARLILANKTHVTTELVGTLGYIPPEYGQGWVATLKGDIYSFGVVLLELLTGRRPVHILSSSKELVKWVQEMKSEGNQIEVLDPILRGTGYDEQMLKVLETACKCVNCNPCMRPTIKEVVSCLDSIDAKLQMQNSVKT

SEQ ID NO: 72538 - protein, 480 aa, Desulfovibrio desulfuricans G20
MSESAPSSAMERCHAVILAGGSGTRLWPLSRALFPKQLLALNGELTLLQQTVKRALDIFPPQRIHIVTNEEHVFEVRAQAKALDAALEDNVLAEPMIRNTLPALMLGLNAAMKQDAAPLLAVFPSDHMIHNAASWQRAVQAGAELAAQNHFVTFGIPPAHPETGYGYIHRGARIADGCYAVEGFVEKPPREKAEEFLRGGMHFWNSGMFVFNGEDLIAALETYQPALAAWWNTRTATSLRQGYSAIPSLSIDYGIMEHVSRIAVVEADFGWDDLGSWEAIFRLGEKDEQGCVVQGDAMAIDCENSLLLSRGGKLAAIGLKDVIAVQTRDATLLCAKDQVQRVREVVSRLKAEGSPLTEVHLTVHRPWGSYTVLEENAGYKIKRIAVHPGARLSLQRHYHRSEHWVVIQGTALVQVGDKEMLLSQNQWAEIPETAVHRLTNPGRIPLEIIEIQTGPYLEEDDIERFEDVYGRPKGGKNKSN

SEQ ID NO: 72539 - protein, 1050 aa, Oryza rufipogon
MEKTMQPLHFSNKNHKNRFHMTYLGHALVLLLFLASPTSSCTEQERNSLIQFLTGLSKDGGLGMSWKNGTDCCAWEGITCNPNRMVTDVFLASRGLEGVISPSLGNLTGLMRLNLSHNLLSGGLPLELVSSSSIVVLDVSFNYMTGGMSDLPSSTPDRPLQVLNISSNLFTGIFPSTTWQVMKSLVAINASTNSFTGNIPTSFCVSAPSFALLELSNNQFSGGIPPALGNCSKLTFLSTGRNNLSGTLPYELFNITSLKHLSFPNNQLEGSIEGIMKLINLVTLDLGGNKLIGSIPDSIGQLKRLEKLHLDNNNMSGELPWTLSDCTNLVTIDLKSNSFSGKLTNVNFSTLPNLKTLDVVWNNFSGTVPESIYSCRNLTALRLSYNGFHGQLSERIGNLQYLSFLSIVNISLTNITRTIQVLQSCRNLTSLLIGRNFKQETMPEGDIIDGFENLQVLSLANCMLSGRIPHWLSKLKNLAVLFLYNNQFTGQIPDWISSLNFLFYLDLSSNSLSGEIPKALMEMPMFKTDNVEPRVFELPVFTAPLLQYRRTSALPKVLNLGINNFTGVIPKEIGQLKALLLLNLSSNKFSGGIPESICNITNLQVLDISSNDLTGPIPAALNKLNFLSAFNVSNNDLEGSVPTVGQLSTFPNSSFDGNPKLCGPMLVHHCGSDKTSYVSKKRHNKTAILALAFGVFFGGITILFLLARLILFLRGKNFVTENRRCRNDGTEETLSYIKSEQTLVMLSRGKGEQTKLTFTDLKATKNFDKENIIGCGGYGLVYKAELSDGSMVAIKKLNSDMCLMEREFSAEVDALSTAQHDNLVPLWGYCIQGNSMLLIYSYMENGSLDDWLHNRNDDASSFLNWPMRLKIAQGASQGISYIHDVCKPQIVHRDIKCSNILLDKEFKAHIADFGLSRLILPNRTHVTTELVGTFGYIPPEYGQGWVATLRGDMYSFGVVLLELLTGRRPVPILSSSKQLVEWVQEMISEGKYIEVLDPTLRGTGYEKQMVKVLEVACQCVNHNPGMRPTIQEVVSCLDIIGTELQTTKLN

SEQ ID NO: 72540 - protein, 476 aa, Arabidopsis thaliana
MASLTLRCDSTHLLPSRDVVKGTKPFGTSLVYPRIISKKFNVRMRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 72541 - protein, 677 aa, Zea mays
  misc_feature (125)..(125): Xaa can be any naturally occurring amino acid
MLPPRAAAVPLLLLALAAGAAGGADDLASDAAALQAFLAPFGSATVSWNSSQPTCSWTGVVCTGGRVTEIHLPGEGLRGALPVGALGGLNKLAVLSLRYNALSGPLPRDLASCVELRVINLQSNXLSGELPAEVLALPALTQLNLAQNRLSGRISPAIAKNGRLQLLFLNGNRLTGELPNVSMPSLTALNVSFNNLSGEIPKSFGGMPSTSFLGMPLCGKPLPPCRAPGSEASPSQPPTPTLRPEAPAPTDNRGRGRHHLAGGAIAGIVVGCAFGFLLIAAVLVLVCGALRREPRPTYRSRDAVAAELALHSKEAMSPNGYTPRVSDARPPPPPSVPPPPAVSAAAVGRKKLFFFGRIPRPYDLEDLLRASAEVLGKGTHGTTYKAAIESGPVMAVKRLKETSLPEREFRDKVAAIGGIDHPNVVPLQAYYFSKDEKLMVYEFVAMGSLSSMLHGNRGSGRSPLSWESRRRIALASARGLEYIHATGSMVTHGNIKSSNILLSRTVDARVADHGLAHLVNPAGAATTTRVAGYRAPEVVADPRRASQKADAYSFGVLLLELLTGKAPAHAVLHDEGVDLPRWARSVVKEEWTSEVFDTELLRHPGAEDEMVEMLRLAMDCTEPAPDQRPAMPEIVARIEGLGGTASTSTATARSGRSASVDEADDRPLRTTGSIRQS

SEQ ID NO: 72542 - protein, 260 aa, Mycobacterium tuberculosis CDC1551
MTSLDLTGRTAIITGASRGIGLAIAQQLAAAGAHVVLTARRQEAADEAAAQVGDRALGVGAHAVDEDAARRCVDLTLERFGSVDILINNAGTNPAYGPLLEQDHARFAKIFDVNLWAPLMWTSLVVTAWMGEHGGAVVNTASIGGMHQSPAMGMYNATKAALIHVTKQLALELSPRIRVNAICPGVVRTRLAEALWKDHEDPLAATIALGRIGEPADIASAVAFLVSDAASWITGETMIIDGGLLLGNALGFRAAPSTEH

SEQ ID NO: 72543 - protein, 463 aa, Streptomyces venezuelae
MQFHDSMISLVGNTPLVKLNNVTAGIQATVLAKVEYFNPGGSVKDRIAVRMIEAAEQSGELKPGGTIVEPTSGNTGVGLAIVAQQKGYKCIFVCPDKVSLDKINVLRAYGAEVVVCPTAVDPEHPDSYYNVSDRLVRETPGAWKPDQYSNPNNPRSHYETTGPELWEQTDGKITHFVAGVGTGGTISGTGNYLKEASGGSVKIIGADPEGSVYSGGSGRPYLVEGVGEDFWPTAYDRNVTDRIVAVSDKDSFQMTRRLAKEEGLLVGGSCGMAVVAALEVARELGPDDVVVVLLPDSGRGYMSKIFSDEWMAGHGFLEDTSSATVADVLRHKEGGTMPSLVHMHPDETVGQAIEVLREYGVSQMPIVKPGAGHPDVMAAEVVGSVVERDVLDALFTQRASLEDSLESHMSAPLPQVGSGEPVAALMSVLGDAADAAIVLVEGKPTGVVSRQDLLAFLANGGAK

SEQ ID NO: 72544 - protein, 137 aa, Yersinia pestis CO92
MAKELNPTENIEKLSDIQRYVTQERGTEAPFTGKLLHNKRDGVYQCLCCHQPLFISESKFDSGCGWPSFYQPIDADSIRYIDDYSHNMHRIEIRCGNCDAHLGHVFPDGPQPTGERYCINSASLNFVDDQNGEQTAG

SEQ ID NO: 72545 - protein, 399 aa, Methylococcus capsulatus str. Bath
MSELSVLRLKKNEERRLRAGHLWVFSNEVDGEKTPLKRFAPGEYVIVEDSRQQPLGLAYVNPESLICARLLSRDHRVAIDHAFLLKRLSRALHLREMLFAKPYYRLVYGESDGLPGLVIDRLGDVLVLQASTLGAERLQEQVMDVLDKLLSPRTLVVKNTSSLRQFEKLENYVRVLGAPLEGPIPIEENGARFLVDPVEGQKTGWFFDHRLNRAVAARLSKCQRVLDLFSYTGGWGVQAALGGAESVDCVDSSESALALAAENARLNGVADRMGFIRQDVFEFLKQLRHKRQRYDLIVADPPALIKRKKDVKAGVEAYHRLNQAAMQVLNPGGVLVSASCSFNLPRSTLHDILRTSSRHLDRHLVILGQGCQGPDHPVHPAIPETEYLKTFFCHLSMPL

SEQ ID NO: 72546 - protein, 409 aa, Bordetella bronchiseptica RB50
MSRADLDTRLSDRLAASRPSATGAVSELARRLAAEGRSVISLSEGELDFDTPAHIQQAAIDAIKGGQTRYTSVGGTPALKAAIARKFARDHQLDYAPAELIAATGAKQILFNALLATIDPGDEALVVAPFWVSYTEMARIAGGTPVVITPDAANQFKLTPELLAAHITPRTRWLILNGPCNPSGALYSREELAALAEVVRQHPRLLVMSDDIYEQLVYEGKFTSFVEAAPDMRERTLTINGVSKTYAMTGWRLGYAGGPAWLIKALELLQSQSTSNPSSISQAAAAAALDGPQDFLQDWRASLSSRRDMALSVLRDAAPAMTFTRPPAAFYLFADCSQAIGMRTPKGERIGDDADFARYLLEEAGVAAVPGSAFGLAPYLRLTFCVAEARLRQACERIVAACARLARPA

SEQ ID NO: 72547 - protein, 370 aa, Saccharomyces cerevisiae
MSKQWASGTNGAFKRQVSSFRETISKQHPIYKPAKGRYWLYVSLACPWAHRTLITRALKGLTSVIGCSVVHWHLDEKGWRFLDMEKQLEDSEDFLEHWHDVAGGIRTAKEDSSKSFAEIKNDSQRFMVDATNEPHYGYKRISDLYYKSDPQYSARFTVPVLWDLETQTIVNNESSEIIRILNSSAFDEFVDDDHKKTDLVPAQLKTQIDDFNSWVYDSINNGVYKTGFAEKAEVYESEVNNVFEHLDKVEKILSDKYSKLKAKYGEEDRQKILGEFFTVGDQLTEADIRLYTTVIRFDPVYVQHFKCNFTSIRAGYPFIHLWVRNLYWNYDAFRYTTDFDHIKLHYTRSHTRINPLGITPLGPKPDIRPL

SEQ ID NO: 72548 - protein, 181 aa, Nicotiana benthamiana
MGLTFTKLFSRLFAKKEMRILMVGLDAAGKTTILYKLKLGEIGTTIPTIGFNVETVEYKNISFTVWDVGGQDKIRPLWRHYFQNTQGLIFVVDSNDRDRVVEARDELHRMLNEDELRDAVLLVFANKQDPPNAMNAAEITDKLGLHSLRQRHWYIQSTCATSGEGLYEGLDWLSNNIANKS

SEQ ID NO: 72549 - protein, 436 aa, Gloeobacter violaceus PCC 7421
MLSLNRYQWTVLFAAWLGWGFDIFDSLLFNFVAPNCVPTLLGLTIGSPEAKEATLQWTGILTSLLLLGWAAGGILFGKIADQIGRTKTLLFTIILYAVGTASCAFAPNIWVLALCRLVASLGIGGEWAAGATMVAEVVPENKRVEAGAILYTAAPAGLLLATFLNLQVAGVFLKSSPETSWRYVFLFGLIPAAAALFVRLFLKEPERWQQVAGKQKPPAIAELFERQNLPLTLSGFLMAVTALLTWWSSSAFIPVVATGLAASEAALRGLAKPETQGLIENWKAIASNSFNLGGLIGTLLTVPAAKYLGRRTMFALYFLLSGAALLVTFGLELPPEVRLYLYFPIGLTVFGVFGSFTYYLPELFPTRLRATGAGFCYNVGRIVAAGGPFLVGYIASQGANSLQSALSTLFWVGFVPLVGLLFIPLVIETRGQVLAD

SEQ ID NO: 72550 - protein, 396 aa, Brucella melitensis
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 72551 - protein, 392 aa, Neisseria meningitidis serogroup B
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 72552 - protein, 520 aa, Nitrosomonas europaea ATCC 19718
MIFWRVKSLDAILATAEKKSLHRSLGVWQLTLLGVGAIIGTGIFVLTAEAAQKAGPGMMIAFVIAGFVCAVAALCYSELSSMVPVSGSAYTYSYAVLGELIAWMVGWALILEYSVAAGAVAVGWSGYFVGLLNNASLGFEIPYVLANGPFAGGIINLPAVVICLLVVGLLIIGTRESAMFNAILVAVKIIALTAFIALALPATDMNHFDPFLPLGTSGVVAAAASIFFAYVGFDAVSTAAEETKDPQRNLPIALISSLLLCTLFYLLVSAGVIGAVGAQPLVDAAGEGLAPGSREMAAQCKSLAAAGQQPVVCSHEALAHVLREIGWEKIGNLLGLAAFLALPSVILMMLFGQTRIFFVMSRDGLLPEVLSRIHPRFKTPYIVTLVTGVGVMAAAAFLPVGKLANISNSGTLFAFLVVALTVMILRVRDKNRPRPFRTPMIWLVGPLAIGGCLILFLFLPMDAKLVFPVWTGIGLIFYFLYGYRRSHVLLGIDTPSGGENLIEPIRSLADGSDETEVKVK

SEQ ID NO: 72553 - protein, 417 aa, Fulvimarina pelagi HTCC2506
MARLVLKFGGTSVADIDRIRNVARHVKREVDAGHDVAVVVSAMAGKTNELVGWCREASPLHDAREYDAVVASGEQVTAGLLAIVLQAMGVNARSWLGWQIPLKTDDAHGVARIGDIDGSDIIRRFEEKQVAVVAGFQGIAPDNRIATLGRGGSDTSAVALAAALQADRCDIYTDVDGVYTTDPRIAPKARRMNKIAFEEMLEMASLGAKVLQVRSVELAMVHKVRTFVRSSFDDPDAPEMSDFDNPPGTLICDEEEIVEQEVVSGIAYSKDEAQISLRRVADRPGVAAAIFGPLADAGVNVDMIVQNISESGEATDMTFTVPSADLAKAVDVLEKTKAETGYDAIQSEAGLTKVSVIGIGMRSHTGVAATAFKELAKIPVNIRAITTSEIKISILIDSDFTELAVRRLHSVYGLDKV

SEQ ID NO: 72554 - protein, 469 aa, Medicago truncatula
MASTRRVQCLMRRFYRGSRTFGVATQPNASSSSQTIIDKEFQHSAHNYHPLPIVFAHAKGSAVWDPEGNKYIDFLSGYSAVNQGHCHPKILKALKNQAGRLTVSSRAFYNDRFPVFAEYSTALFGYDMVLPINTGAEGVETALKLARKWGYDKKKIPNDEALIVSCCGCFNGRTLGVISMSCDNEATRGFGPLIPGHLKVDFGDAEALEKILKEKGDAIAAFILEPIQGEAGVKIPPDGYLKAVRDLCSKYNVLMIADEIQTGLARTGKMLACEWEEVRPDVVVLGKALGGGIIPVSAVLADKEVMLCIKPGQHGSTFGGNPLASAVAIASLEVIKEERLAERSTKLGGELLGLLEKIQKQYPDHVKEVRGRGLFIGVELNSESLSPVSFFELSEKLKDRGVLAKSTHDTIIRFTPPLCISADEIQQGSKALADVLEIDLPMLKKMKPKDAAPPAGPSACDRCGRVVYG

SEQ ID NO: 72555 - protein, 262 aa, Pseudomonas knackmussii
MPTVKLADGELNYLLEGPAGAPVLVLSNSLGTDLHMWDAQVPAFTQHFQVLRYDTRGHGASLVTEGPYSIEQNGRDVLALLDALDIAKASFCGLSMGGLIGQWLAINAPERIERLVLCNTAAKIGTPEVWNPRIDTVLAGGLQPMRDLRDASISRWFTPDFAAAEPGKVEPIVAMLAQTSPQGYAANCAAVRDADFREQLGAILAPTLVVCGSGDPVTTTEHGRFMQERIAGAELVEFHAAHLSNVQAGDAFSQKVLGFLRG

SEQ ID NO: 72556 - protein, 118 aa, Triticum aestivum
  misc_feature (47)..(47): Xaa can be any naturally occurring amino acid
FTSFGSRATSLLLAKMSTVTRAYLDQRLAAAKRCSREAAMAGAKAAXVATVAAAVPTLASVRMLPWARAHLNPTGQALIISTVAGMAYFIVADKTILSMARKHSFDDAPDHLKNTSFH

SEQ ID NO: 72557 - protein, 117 aa, Zea mays
  misc_feature (88)..(88): Xaa can be any naturally occurring amino acid
  misc_feature (101)..(101): Xaa can be any naturally occurring amino acid
VGGNWKCNGTTDHVEKIATPLNERQVPPSNVVEVVVSPPYVLLTVVTSQLRQELHDGAHNCRVQNGGASTGQVSAEILRNHGAPWVIXLGHSEKRALLGEXNDLVGDKVCYALSHGL

SEQ ID NO: 72558 - protein, 754 aa, Fulvimarina pelagi HTCC2506
MIGSDISGPRVLMRSIRALMAESLDRQTRLDRIVELIAANMVAEVCSLYVLRSDSVLELYATQGLNPGSVHLAQLRLGEGLVGTIAATARPLNLKQAQHHPAFTYLPETGEEIYTSFLGVPILRAGRTLGVLTVQNKAERLYREEESEALETVAMVVAEMIAAGGLEGLSRPGVTLDLSRPVTFNGDALSDGIGLGHIVLHEPRVVVTNLFNEHVEEEVERLNEALAQLRSSIEDMISRRDIPGEGDHKAVLEAYRMFAYDRGWVRRLEEAVRNGLTAEGAVEKVQSDMRARMMHLSDAYIRERLHDFDDLANRLLRQLIGHSSSAIDEIDDAILVARNMGAAQLLDYRRNRIKALVLEEGAATSHVVIVARALGIPVVGQAAGIVSMAENGDVVIVDGEDGSVHLRPMQDVIENYADKIAFRSKRKERFAEMRDRPAVTRDGVQIDLQMNAGLLVDLPQLDEAGAAGIGLFRTELQFMIASTMPRADDQQKLYQAVLDTAAGRPVTFRTLDVGGDKVLPYLAKISEENPALGYRAVRLSLDRPGLLRTQLRALLKAASGRELRFMVPMVSDCYEIHAVRDLVERELAHLKRFGYTPPSNLKFGAMLEVPSLLFQLDQIMPHLDFMSVGSNDLFQFFNAVDRGNPRVAARFSDLSPGFLRALKMIVDAGHRHDVPVTLCGEMAGRSVAALALIAIGFRSISMAPPSIGAVKAMILDLDVAKATAFIEEQLANPDPAADLLPMLVEFANANGVPL

SEQ ID NO: 72559 - protein, 176 aa, Glycine max
MVAHSSSWGRALVAISPYTFSAIGIAVAIGVSVLGAAWGIYITGSSLIGAAIRAPRITSKNLISVIFCEAVAIYGVIVAIILQTKLESVPASNIYAPESLRAGYAIFASGLIVGFANLVCGLCVGIIGSSCALSDAQNSSLFVKILVIEIFGSALGLFGVIVGIIMSAQATWPTKV

SEQ ID NO: 72560 - protein, 439 aa, Vibrio fischeri ES114
MLPLSERLSQYKTTGLTTRAIASGKLVRVVGLTLEATGCRAPIGSSCLVETVNGEIEAEVVGFSGENLFLMPSEQVSGVLPGAKVTPIADGSGIPVGMELLGRVVDGVGNPIDGLGELYTEHTASFTSEPINPLSRKPISEPLDVGLKAINGLLTVGKGQRLGLFAGSGVGKSVTLGMMTRGTTAQVVVVGLIGERGREVKEFIEEILGPEGRQRSVVVAAPADASALMRLKGCQTALTIAEYFRDQGLDVLLLMDSLTRFAQAQREIALSVGEPPATKGYPPSVFAKLPALVERAGNGNENQGSITAFFTVLTEGDDLQDPIADASRAILDGHIVLSREMADAGHYPAIDVEKSVSRVMPQITDEEHMLMSKAVRQVLSTCRKNQDLVSIGAYKPGTDPAIDQAFTLKPRLDEYLQQRMKESVPYDMCKNMLKMLLSG

SEQ ID NO: 72561 - protein, 489 aa, Burkholderia sp. 383
MHTDSSFTFVLFGGTGDLSMRKILPALFEAHRANMLAESGRIVAVARHESDRASYLEWVDTHVKPHAAKAAGKAFDEAAWKSFLDRIEYVHLDLGRAEDYGVLRDAVASLPGIRVFYLATGPSLFVPICKALASVGLNEGSRIVLEKPLGYDLKSSNAINDAVGEIFAEGQIYRIDHYLGKEPVQNLLALRFGNALFEPLWRREWVESIQITIAEELGVEARGDFYDNTGALRDMVQNHLLQLLSIVAMEPPHSMDSDSVRDEKLRVLRALKPVDPRDIGKVAVRGQYHAGVIKGAQVPAYATEPGVKPDSQTETFVALKVEIENWRWAGVPFFLRTGKRLADRVAEIVVNFRPVPHSALGPTALRPGSNRLVIRLQPNETIRLYCLAKQPGEGMNLASVHLDLAFDQFFKEGQMEAYQRLLLDVINGRLALFVRRDEQEAAWRWVEPILNEWARSLKPPKPYAAGTWGPAAASAMLAQHDTCWLEEEN

SEQ ID NO: 72562 - protein, 308 aa, Triticum aestivum
  misc_feature (218)..(218): Xaa can be any naturally occurring amino acid
NKFVQKSRLVPVRNSRDIVDPRVRGRVGKNCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSVVAVFGLGTVGLAVAEGAKSAGASRIIGIDIDAKKFDVAKNFGVTEFVNPKDHDKPIQQVLVDLTDGGVDYSFECIGNVSIMRAALECCHKGXGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 72563 - protein, 546 aa, Oryza sativa Japonica Group
MRAVLEEWIKQRESWKPFWVRGINMVGYSINGLHPVLFSSQADGDDDGIRAAPPPPPAEPAVPPRHRGHLHLFKKPLHRALSGLAATHGPVLLLHFGSRAVLHVTDPAVAEECLTDHDVTFANRPRLPSSCHLSNGYTTLGSSSYGPNWRNLRRIATVEVFSAHRLLRSADVRGGEVPHMARWLYLAAPAAGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMVPALSGIFFIYNFFY

SEQ ID NO: 72564 - protein, 502 aa, Triticum aestivum
NKFVQKSRLVPVRNSRDIVDPRVRHASAHASVSEEVEEVEEEEDPEEREVLDEIDASHDSDSKSEVVPLPQQDGAKDGSDKEKHAELLALPPHGSEVYFGGISSDASSDDLKKLCEPVGEVVEVRIMLSKKDSRGYAFVTFRTNDLALKAIEKLNKATFKGKKLRVSSSQAKNKLFVGNIPHSWSFDDFKKAVEEVGPGVLKVDLIKDPRTDRNRGYGFVEYYNNACAEYSRQKMTAPNFKLDTNAPTVSWADPKNGDSASTGSTSQVKSVYVKNLPKNVTQGQLKKLFERHGEIIKIVLPPSKDGHDNRYGFVHFKDRHMAMKAVKSTEKYELDGQLLDCSLAKPPADKKDDTVSLPTAKGGPLLHAPLGYGMPRPDPYGAPSAYSAPPAYGAPPAYGGQPLLYAPGAPPGAAMVPMLLPDGRLVYVVQQPGAQQHFASPPPQVRQHQHFTSPPPQARQIGRHGGSGGGGGSGGSSRSGSGTKRPRGEDNNSSSRNRQRRY

SEQ ID NO: 72565 - protein, 428 aa, Glycine max
  misc_feature (125)..(125): Xaa can be any naturally occurring amino acid
  misc_feature (346)..(346): Xaa can be any naturally occurring amino acid
MAGAASALFLLDIKGRVLIWRDYRGDVTAVEAERFFTKLIEKEGDPQSQDPVVYDNGVTYLFIQHSNVFLMMATRQNCNAASLLFFLHRIVDVFKHYFEELEEESLRDNFVVVYELLDEIMDFGXPQYTEAKILSEFIKTDAYRMEVTQRPPMAVTNAVSWRSEGINYKKNEVFLDVVESVNILVNSNGQIIRSDVVGALKMRTYLSGMPECKLGLNDRVLLEAQGRTTKGKSIDLEDIKFHQCVRLARFENDRTISFIPPDGSFDLMTYRLSTQVKPLVWVEAQVEKHSKSRIEIMVKARSQFKERSTATNVEIELPVPADATNPNVRTSMGSASYAPEKDALIXKIRSFPGGKEYMLRAEFHLPSIVDEEATPERKAPIRVKFEIPYFTVSGIQVRYLKIIEKSGYQALPWVRYITMAGEYELRLI

SEQ ID NO: 72566 - protein, 276 aa, Zea mays
MDRYQRVEKPRNDTPISQNEIRITTQGRMRNYISYGMSLLEENGHDEISIKAMGRAINKTVMVVELIKRRVGGLHQNTATESVDITDTWEPLEEGLLPLETTRHVSMITVTLSKNPLDTSSPGYQPPIPAEEVKPAFDYDHEESYPTGRGRGRGGGRRGRGRGMSNGPPPPAYGYNEEWEEEGDYYNRGRGRGRLRGRGGRGRGGYYGGGRRGGYGYDYGYAPRGGYYEEQDEYYDEPEEYAPPPGRGRGRGRRGGMPWRGRGGRGPPRGGRGSYY

SEQ ID NO: 72567 - protein, 457 aa, Pseudoalteromonas tunicata D2
MQVALIGLGVMGKNLALNLIEKGISLVAYDKNPDAGEDLLSIAKSDGLAERLHIVSDLTDMIKRLETPRSILLLVPAGELVDRVCQELIEAGVDANDLIVDCGNSNYKDGIARKLKYQNKFEFATMGISGGAEGARHGPAMMASGSEGGWERVELALEKVAANYKGESCFARVGQSASGHFVKMVHNGIEYSLMQLIAEVYQLLRLGCGKSPQEIATIFDAWSETELNSYLLSISSHILKLEGHNNEPLVDLIDNKVGAKGTGLWTAQNALELGIAVPSLVAAVEARHLTNTYSTHAAKEMTYQTRPTLVAQLDLDELKQAFHFASLLCYRQGLALIKGASRTHQWKVDLAKTLQTWRAGCIIRADYLHQVAQGNEFIDALESEVTALRNVTGIAITTGLAFPVLAASQTYYATLSTPSNGHLVQAQRDYFGEHGLLTHAGELCHLTDLADIDAKVR

SEQ ID NO: 72568 - protein, 151 aa, Arabidopsis thaliana
  misc_feature (10)..(10): Xaa can be any naturally occurring amino acid
  misc_feature (82)..(82): Xaa can be any naturally occurring amino acid
  misc_feature (144)..(144): Xaa can be any naturally occurring amino acid
HLIPPLNFSXVDNGIFRSGFPDSANFSFLQTLGLRSIIYLCPEPYPESNLQFLKSNGIRLFQFGIEGNKEPFVNIPDHKIRXALKVLLDEKNHPVLIHCKRGKHRTGCLVGCLRKLQKWCLTSIFDEYQRFAAAKARVSDQRFXEIFDVSS

SEQ ID NO: 72569 - protein, 478 aa, Pseudoalteromonas tunicata D2
MARRTKIVATLGPATDRDNNLEKIIEAGVNVVRLNFSHGVAQDHKDRAAKVREIAAKLGKHIAILADLQGPKIRVSTFQDGKVTLVEGAKFILDAQMAKGEGNINAVGIDYKELPQDVSSGDLLLLNDGLIQLTVDSVQGQQVHCIVTIGGVLSNNKGINRLGGGLTAPAFTEKDEQDLITASEIGVDYIAVSFPRSGDDMRHVRALAEKAGSNAQLLAKIERAEAVCSVAAIDDIVLASDAVMVARGDLGVEIGDAELVGKQKLIISRARSLNRVVITATQMMESMIDNPMPTRAEVMDVANAVIDGTDAVMLSAETAAGDYPVETVKAMARVCVGAESQPETNVSKHRLDSMFADTSETLALSAMYAANHLSSVKAIVALTESGNTAKLMSRISSGLPIYSLSRHASTLGQTALYRGVYPVYFDSTACSKDAMVTEAVKALVAKGVLVAGDQVILTHGDSMETVGATNTMKIVTVQ

SEQ ID NO: 72570 - protein, 184 aa, Streptomyces coelicolor A3(2)
MLTVGDKFPEFDLTACVSLEKGKEFQQINHKTYEGQWKVVFAWPKDFTFVCPTEIAAFGKLNDEFADRDAQILGFSGDSEFVHHAWRKDHPDLTDLPFPMLADSKHELMRDLGIEGEDGFAQRAVFIVDQNNEIQFTMVTAGSVGRNPKEVLRVLDALQTDELCPCNWSKGDETLDPVALLSGE

SEQ ID NO: 72571 - protein, 266 aa, Oryza sativa Japonica Group
MGYAQLVIGPAGSGKSTYCSSLYQHCETVGRTIHMVNLDPAAEHFSYPVSTDIRELISLDDVMEELGMGPNGGLIYCMEHLEDNLDDWLDEQLEGYLDDDYLVFDCPGQIELFTHVPVLRNFVEHLKRKNFNVCAVYLLDSQFVSDVTKYISGCMASLSAMIQLELPHINILSKMDLVSNKKDVEEYLNPEAQVLLSQLNRQMAPNFGKLNKSLAELVDDYSMVNFIPLDLRKESSIQYVLSHIDNCIQYGEDADVKVRDFDPEED

SEQ ID NO: 72572 - protein, 263 aa, Yersinia pseudotuberculosis IP 32953
MAISIKTPEDIQKMRVAGRLAAEVLEIIEPYVKPGVTTGELDRICHDHITNHQQAISACLGYHGFPKSVCISVNEVICHGIPSDEKVLKEGDIVNIDVTVIKDGFHGDTSKMFIVGKPTILGERLCRVTQESLYLAIKMVKPGIRLRTLGKAIQKFVEAENFSVVREYCGHGIGEGFHEEPQVLHYDADDGGVVLQTGMAFTIEPMVNAGDYRIRTMKDGWTVKTKDRSLSAQYEHTIVVTDNGCEIMTLRKDDTIPNIITHE

SEQ ID NO: 72573 - protein, 297 aa, Sulfolobus tokodaii str. 7
MEESDLELLRKAGKIAAKARDYGAKLIKPGAKVYDICETVEKIIIEEGAKPAFPCNLSINSEAAHYSPLIDDEKTIPEGAVVKLDIGAHIDGYITDTAVTVVLDDKYQKLAEAAKDALNAAIANFKPGTDLGEIGKNIEKIIKIHGFKPIRNLGGHLIRRYELHAGVFVPNIYERGLGRIIEGNTYAIEPFATNGEGEVIEGKDITIYSIKTLNAKGLTDEEKRFLAQIYKKANMLPFNERWLRDLGEPNYIRQMLKTLVRRGALRAYPILIEVRKGLVSQFEHTVLVTRDGAEIIT

SEQ ID NO: 72574 - protein, 338 aa, Mannheimia succiniciproducens MBEL55E
MTILVTGGAGYIGSHTIVELLNAGEDVVVLDNLCNSSPKSLERVKQITGKSVKFYEGDVLDRTLLQRIFAENQIKSVIHFAGLKAVGESVQKPAEYYMNNVTGSLVLVQEMKKAGVWNLVFSSTATVYGEPETIPVTENCKVGGTNSPYATSKLMVEQILTDVVKAEPRFSMIILRYFNPVGAHESGLIGEDPNGIPNNLMPYISQVAIGKLPELSIFGNDYDTHDGTGVRDYIHVVDLAIGHLKALTRHEDDAGLHIYNLGTGIGYSVLDMVKAFEKANNMTLPHKFVARRPGDIAAYYSDPSLAAKELSWTAQRGLEQMMKDTWNWQKNNPKGYRD

SEQ ID NO: 72575 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMCSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESAHLVLSVGALLSDFNTGSFSYSYKTKNIVEFHSDYTKIRRPTFPGVQMKFALQKLLTKVADAAKGYKPVPVPSEPEHNEDVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAASNAKN

SEQ ID NO: 72576 - protein, 334 aa, Nitrosomonas europaea ATCC 19718
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 72577 - protein, 326 aa, Nitrosomonas europaea ATCC 19718
MGLLINGKWQDQWYTLQNGEFVRENAQYRHWVTPDGQPGPSGEGGFTAESGRYHLFVSLACPWAHRTLIFRHLKDLQAHIGITIVDPRMLEHGWAFSEISRDNPVQDIRYLHQLYTRAKPDYTGRVTVPVLWDKQRDTIVSNESADIIRMFNSAFDSLTGNDLDFYPEALRNEIGTINEVVYRDFNNGVYKAGFATDQLIYEKAYDRIFNRLDAIDDSLNTRRYLAGNRLTEADWRFFTTLIRFDAVYYSHFKLNKQRIEDYPNLSNYLRALYQISGIAGTVNFEHIKTHYYYSHSTINPTQIIPKGPDIDYTRPHNRVQAFSSPG

SEQ ID NO: 72578 - protein, 176 aa, Fulvimarina pelagi HTCC2506
MKIKDRPEFSSKPKPVTFSADTSVAEAVAEMSKRDIGSVVVVGPDEKVEGLVTERDVMKRLVNQGKDPKTTQLADIMTRELRMARADDDLLDWLRIMSNERFRRLPVIDADNRIVAIMTQGDFVSYTWPDLIYQATQVTKATVSSNYPILLIVAGILLYSLILIAILTAWGSGYSG

SEQ ID NO: 72579 - protein, 313 aa, Streptococcus pyogenes MGAS315
MKIVFPEGNDERVVRAAARLKFEGLLEPIILGQSEEVRNLLTKLGFADQDYTIINPNEYADFDKMKEAFVDIRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIAKGLNPDLALDGELQFDAAFVPETAAIKAPDSAVAGQANTFIFPDLQSGNIGYKIAQRLGMFDAIGPILQGLNKPVNDLSRGSSAEDIYKLAIITAAQAIESQG

SEQ ID NO: 72580 - protein, 108 aa, Brassica napus
MSHSHGNVSSANDPRQPSAAKPYTPRPIAPEDLPVDYSGFIAVILGVSGVMFRYKICSWLALIFCAQSLANMRNLETDLKQISMAMMFAIMGLVTNYLGPNRPAATKK

SEQ ID NO: 72581 - protein, 176 aa, Fulvimarina pelagi HTCC2506
MIDFKAAIRTIPDYPKPGIQFRDITTLLSDPTAFRASVDALVAPYADGKIRHVVGIEARGFILGGALAHQLTAGFIPIRKRGKLPRETVSVTYELEYGEDEMELHRDAILPGERILLTDDLIATGGTAIGGVKLLRDLGAEIVAACFLVDLPDLGGSKKLREMGVDVRCLCEFEGD

SEQ ID NO: 72582 - protein, 183 aa, Vitis vinifera
MVAAAATTAVEAEPRSNSTAPSKSLPFRVGHGFDLHRLEPGYPLIIGGIDIPHDRGCEAHSDGDVLLHCVVDAILGALGLPDIGQIFPDSDPKWKGAPSSVFIKEAVRLMHEAGYEIGNLDATLILQRPKLSPHKEAIRSNLSQLLGADPSVVNLKAKTHEKVDSLGENRSIAAHTVVLLMRK

SEQ ID NO: 72583 - protein, 361 aa, Glycine max
MLKNQPQPDWPEPIVRVQSLSENCIDSIPERYIKPSTDRPSIRSSNFDDANIPIIDLGGLFGADQRVSDSILRQISEACKEWGFFQVTNHGVSPDLMDKARETWRQFFHMPMEVKQQYANSPKTYEGYGSRLGIEKGAILDWSDYYFLHYLPLPLKDYNKWPASPPSCRKVFDEYGRELVKLCGRLMKALSINLGLDEKILQNGFGGEDIGACLRVNFYPKCPRPELTLGLSSHSDPGGMTMLLPDDQVPGLQVRKCDNWITVKPARHAFIVNIGDQIQVLSNAIYKSVEHRVIVNSDKERVSLAFFYNPKSDIPIEPIKELVTPEKPSLYPAMTFDEYRLFIRMRGPRGKSQVESLKSPR

SEQ ID NO: 72584 - protein, 438 aa, Mycobacterium tuberculosis CDC1551
MPRRSPADPAAALAPRRTTLPGGLRVVTEFLPAVHSASVGVWVGVGSRDEGATVAGAAHFLEHLLFKSTPTRSAVDIAQAMDAVGGELNAFTAKEHTCYYAHVLGSDLPLAVDLVADVVLNGRCAADDVEVERDVVLEEIAMRDDDPEDALADMFLAALFGDHPVGRPVIGSAQSVSVMTRAQLQSFHLRRYTPEWMVVAAAGNVDHDGLVALVREHFGSRLVRGRRPVAPRKGTGRVNGSPRLTLVSRDAEQTHVSLGIRTPGRGWEHRWALSVLHTALGGGLSSRLFQEVRETRGLAYSVYSALDLFADSGALSVYAACLPERFADVMRVTADVLESVARDGITEAECGIAKGSLRGGLVLGLEDSSSRMSRLGRSELNYGKHRSIEHTLRQIEQVTVEEVNAVARHLLSRRYGAAVLGPHGSKRSLPQQLRAMVG

SEQ ID NO: 72585 - protein, 566 aa, Sulfolobus tokodaii str. 7
MEEIEELIYKYALQNAYKHGGKAQDKAVVSKIFVERPDLRSRAKEISEIAKKIVEKVNSMSIQDQERELKEKYPDLLEEKKKEEPEKKTLPPIKVEGKFVTRFAPNPDGPIHLGNARAAIISYKYAEMYKGEFILRFDDTDPKVKKPIKEAYDWIRKDLKWLGIKWDKEVKASERLEFYYSMAKELISKGFAYVDTCSEEEFKKMRDASKPCPNRLKSAEDNLYLFEKMLNGEFKEGEAVVRIKTDLSLPDPSQRDWVLLRIIDVKKNPHPITGDKYWIWPTYNFASALDDHDLGITHIFRGKEHEVNAEKQKWIYNYMGWKYPYVEEFGRLRLEGFMMSKSKIRTVLEKGVSIDDPRLPTLAGLRRRGILPETIIETIITVGLKVSDATISFDNLAALNRKKLDPIAKRLMFVQQPKEFIIELSEPIRAKIPYNPSKPSEYREILVNPGDKILLDAKDAEEGAVVRLMELCNVTISGNKLIFHSKTLEDAKKLNAKIIQWVKKDEASNVEVIIPDPNEEKPPISGYGEKEIGNLKINEIVQFIRFGFVRVDNKIDNKVTVIFSHE

SEQ ID NO: 72586 - protein, 126 aa, Sulfolobus tokodaii str. 7
MSKPSYVKFDVPEDLANKVLDAVRKAKESGKIKKGTNETTKAVERGQAKLVVIATDVQPEEIVAHLPLLCEEKKIPYVYVPSKKALGEACGLQVAAASAAIIDPGEAKDLLDEIVKRVEELKGKAS

SEQ ID NO: 72587 - protein, 333 aa, Oryza sativa
MGKPGKLALPSHESTIGKFLTQSGTFKDGDLLVNKDGLRIVSQSEEGEEPLDHNQLSLDDLDAIKVIGKGSSGIVQLVRHKWTGQFFALKVIQLNIQENIRRQIAQELKISLSTQCQYVVACCQCFYVNGVISIVLEYMDSGSLSDFLKTVLKGLMYLHHEKHIIHRDLKPSNILINHMGEVKISDFGVSAIIASSSAQRDTFTGTYNYMAPERISGQKHGYMSDIWSLGLVMLELATGEFPYPPRESFYELLEAVVDHPPPSAPSDQFSEEFCSFVSACIQKNASDRSSAQILLNHPFLSMYDDLNIDLASYFTTDGSPLATFNTSNRYDDR

SEQ ID NO: 72588 - protein, 501 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGSGLRHEPSYKFFSFNAGPRTCLGKNLAMNLMKTVIVEILQNYEIKIVSGQKIEAKPGLVLHMKHGLKVTMTMKCSSLE

SEQ ID NO: 72589 - protein, 388 aa, Prunus armeniaca
YFDGWKAYDRNPFHPTKNPEGVIQMGLAENQLSFDLIEERIKKNPKASICTPEGVEEFKNVAIFQDYHGFPEFRKAVAMFMSKARGGRVTFDPNRVVMSGGATGANELVMFCLADPGDAFLVPSPYYPAFFRDLGWRTGVQIVPVDCHSSNNFKITKEALEAAYEKAQKNNIKVKGLIITNPSNPLGTTLDRDTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLASMLLDEEFVARFLETSSKRLANRHGVFTKGLEEVGINCLKSNAGLFCWMDLRRLLKDQTFDGEMVLWRVIVNEVGLNVSPGSSFKCVEPGWFRVCFA

SEQ ID NO: 72590 - protein, 335 aa, Vitis vinifera
SRFTQQELPACKPILTPGWVISSFIFVGIIFIPIGLASLFASERVVEIVHRYDTDCVPASYRNDMLAYIQSNETNKTCTRTFLVPKQMKSPVYIYYQLDNFYQNHRRYVKSRSDKQLRSRASENDTSSCDPEDVTSNKSAIVPCGLIAWSLFNDTYGFSVNNTLLGVSKKNIAWKSDQQHKFGSDVYPKNFQSGGLIGGAKLNSSIPLSQQVDLIVWMRTAALPTFRKLYGKIEVDLEANTELTVVIENNYNTYSFGGKKKLVLSTTSWIGGKNDFLGIAYITLGGLSLFLAISFLLIYIIKPRCRLGIRLSCHGTETQQDISISTRHFQNGSIY

SEQ ID NO: 72591 - protein, 211 aa, Physcomitrella patens subsp. patens
MDDEWDADDFVPLPPVSAKDEPKTTSQWDDEDVEDELKEEAKPEPVIAPKPKKKFKKNIDDEGDLSDPIAEKLRQQRLVEEADYQNTSELFGDKSRTGHSLEYFIPKSEEDFLDYAELIAQKIRPFEKSFHYMTLLRALLRHSVAAVKASDAKEFASSMTVIANEKLKAEKDATAGKKKTGAKKKQLMVDKPDDDGLGGGSYDPIDDYDFM

SEQ ID NO: 72592 - protein, 491 aa, Oryza sativa
MGSTSRPVDDEVLDAATGVHYSALRLEELNMNGSVSGEDQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIISEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNVPKDIANRHVLLLDPILGTGNSAVQAISLLLKKGVQETNIIFLNLISAPQGVHVVSKRFPRVKIVTSEIDFGLNDDFRVIPGMGEFGDRYFGTDDYQSSTPFFCDEKNRVRLL

SEQ ID NO: 72593 - protein, 245 aa, Idiomarina baltica OS145
MFSLNEHVALVTGASRGIGRKIAEQLAAQGAFVIGTATSDKGAASIAEYLGDKGQGLALNVNETDELADKIKDLEKTHGKIDILVNNAGITRDNLMMRMKEDEWNAVLDTNLTAVFRICKLVIRGMMKRRHGRIINISSVVGTTGNPGQVNYCAAKAGLVGFSKSLAKEVAARGITVNCVAPGFIDTDMTKSLTDDQKQAIYANIPAERLGQPEEVASAVVFLASKGAAYITGETIHVNGGMAMV

SEQ ID NO: 72594 - protein, 358 aa, Campylobacter jejuni subsp. jejuni NCTC 11168
MKTYKVAVLAGDGIGPLVMKEALKILTFIAQKYNFSFEFNEAKIGGASIDAYGVALSDETLKLCEQSDAILFGSVGGPKWDNLPIDQRPERASLLPLRKHFNLFANLRPCKIYESLTHASPLKNEIIQKGVDILCVRELTGGIYFGKQDLGKESAYDTEIYTKKEIERIARIAFESARIRKKKVHLIDKANVLASSILWREVVANVAKDYQDINLEYMYVDNAAMQIVKNPSIFDVMLCSNLFGDILSDELAAINGSLGLLSSASLNDKGFGLYEPAGGSAPDIAHLNIANPIAQILSAALMLKYSFKEEQAAQDIENAISLALAQGKMTKDLNAKSYLNTDEMGDCILEILKENDNG

SEQ ID NO: 72595 - protein, 472 aa, Oryza sativa Indica Group
MGVKLLADGCAGASSSPALSRVATSAAHGEGSPYFAGWKAYDEDPYDAAANPDGVIQMGLAENQVSIDLLEGYLREHPEAAAWGVAGDGGGDSFRDNALFQDYHGLANFRKAMARFMEKIMGGKATFDPDRIVLTAGATAANELLTFILADPRDALLIPTPYYPGFDRDLRWRTGVNVVPVHCDSANGFQVTAAALQAAHDEAAAAGMRVRGVLITNPSNPLGTTARREALEGILGFVARNDIHLVSDEIYSGSVFAAPDLVSVAELVESSSSRARHRGEDDDGDVGVADRVHVVYSLSKDLGLPGFRVGVVYSRNDAVVAAARRMSSFTLVSSQTHEDAGRRAVRRGVRRRLRRRQPGAPPGAAQPRRGGAGPRRRAVPARQRRAVRVDGHAAAPARRRRRRRDLRRRAEAVGQAAARGEAQRLAGLVVPLLGARLVQGVLREHEPGHPGCCAGEDKPLHGRVVQSNNWEI

SEQ ID NO: 72596 - protein, 744 aa, Glycine max
MSMSERKTIDLDQGWDFMQKGILKLKNILEGLPEPQFSSEDYMMLYTTIYNMCTQKPPHDYSQQLYDKYRESFEEYIVSTVLPSLREKHDEFMLRELVKRWANHKIMVRWLSRFFHYLDRYFIARRSLPPLNEVGLTCFRDLVYKELNGKVRDAVISLIDQEREGEQIDRALLKNVLDIFVEIGMGQMDHYENDFEAAMLKDTSAYYSRKASNWILEDSCPDYMLKAEECLKREKDRVAHYLHSSSEPKLLEKVQHELLSVYANQLLEKEHSGCHALLRDDKVEDLSRMFRLFSKIPRGLDPVSSIFKQHVTAEGMALVKLAEDAVSTKKAEKKDIVGLQEQVFVRKVIELHDKYLAYVNDCFQNHTLFHKALKEAFEIFCNKGVAGSSSAELLATFCDNILKKGGSEKLSDEAIEETLEKVVKLLAYISDKDLFAEFYRKKLARRLLFDKSANDDHERSILTKLKQQCGGQFTSKMEGMVTDLTLAKENQTSFEEYLTNNPNADPGIDLTVTVLTTGFWPSYKSFDLNLPAEMVRCVEVFKEFYQTKTKHRKLTWIYSLGTCNISGKFDPKTVELIVTTYQASALLLFNSSDRLSYSEIMTQLNLSDDDVIRLLHSLSCAKYKILNKEPNTKTISSTDYFEFNSKFTDKMRRIKIPLPPVDEKKKVIEDVDKDRRYAIDASIVRIMKSRKVLSYQQLVMECVEQLGRMFKPDVKAIKKRIEDLISRDYLERDKDNANLFRYLA

SEQ ID NO: 72597 - protein, 99 aa, Zea mays
MVKKVETEADHHLDAEKEKKVVARSKPMNIPEGKFKRFDNGYEDGGEMVPPHVIMARRLAEKMTYSMCHGNGRTLKGRDLSRVRNSVLRMTGFIEVMEM

SEQ ID NO: 72598 - protein, 171 aa, Helicobacter pylori
MLDLFYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGRFKGKRHPTLGNRVVVGAGAKVLGAICVGDDVKIGANAVVLSDLPTGSTAVGTKAKTITKDR

SEQ ID NO: 72599 - protein, 579 aa, Shewanella sp. MR-4
MRRAGTFRPLILAIAMALPLLSSPTLHAEEPSIFSQMATAQPVWAKHGMVASQEALASRTGIEILKQGGNAVDAAVAVAFSLAVTLPRAGNIGGGGFMLVHLAKENKTIAIDYREMAPSKAKKDIFLDENGDAVTKLSREHGLAVGVPGTVMGMSLALEKYGTMTMAQVTAPAIKMAQEGISVTPDLAVSLAGLKRRMSQWPSTATIFYKADGSDYQVDDILKQPELAHSLQLIAEKGTKGFYEGETAEKLVKAVQDAGGIMTLADLEHYKAVEREPVRGQYRGYDVVSMPPPSSGGVHIVEMLNVLQQFPIDKFGHNTAQTIHVMAETMKHAYADRSEYLGDPDFYKVPVKQLTNKDYAKKIASQIALNKTTPSTEIKPGNLAPYESDQTTHFSVVDKWGNAVSNTYTLNFSYGSGLVAKGTGILLNNEMDDFSAKPGTPNGYGLVGGDANAVEGNKRPLSSMSPTIVMKDGKPFLVTGSPGGSRIITTTLQIIMNVIDHGLNIAEASNAARVHHQWLPDELRVESSLNRDTISLLEAKGHKVKVQSAMGSTQSIMVTDQGIFGASDPRHSGSEAVGY

SEQ ID NO: 72600 - protein, 125 aa, Triticum aestivum
MAGRLTAMGSRIMGGHGAAARAAASALRNRAGMGLPAGRHIVPDKPLPVNDELVWDNGTPFPEPCVDRLAPHIGKYEALAWLCGGLSFFAALGLAAVVNDKASKMPYTPKVYPFDNLRAELGDRS

SEQ ID NO: 72601 - protein, 385 aa, Magnaporthe grisea 70-15
MLALRRVAAAAPVARQFSAAPRAAATFAFSNQRYYSSQGERVAKFTGKKDASGRYPVSLIEGDGIGPEISEAVKQIFEAAKAPVSWEPVDVTPILKDGRTAIPDAAIESIERNKVALKGPLATPIGKGHVSLNLTLRRTFNLFANLRPCRSVAGFKTPYDNVDTVLIRENTEGEYSGIEHVVVDGVVQSIKLITREASERVLRFAFQHAQEIGRKKVRVVHKATIMKMSDGLFLSVGQQVAKDFPGIEFDAELLDNTCLKMVTDPLPYNDKVLVMPNLYGDILSDMCAGLIGGLGLTPSGNIGDECSIFEAVHGSAPDIAGKGLANPTALLLSSMMMLRHMGLGEYADRIEKATFDTLAEGKALTGDLGGKAKTHEFAGAIISKL

SEQ ID NO: 72602 - protein, 485 aa, Vicia sativa
MITVTMSKHFLSLLSLSFLLYAGACLATSSEFDRLNQCQLHNINALEPDHRVESEAGLTETWNPNHPELRCAGVSLIRRTIDPNGLHLPSFSPSPQLIFIIQGKGVLGLTLPGCPEPYEEPRSSQSRQGSRPQQPDSHQKIRRFRKGDIIAIPSGIPYWTYNNGDEPLVAISLLDTSNIANRLDSTPRVFYLGGNPKAEFPETQEGQQERHSLPVGRRAGQHQQEKESEEQNEGNSVLSGFSSEFLAQTFNTEEDIAKRLRSPRDQRNQIVKVEGGLRIINPEGQQEEKEEEEEEKHRSEQGRNGLEETICSAKIRENIANPARADLYNPRAGRISTANSLTLPILRYLRLSAEYVRLYRNGIYAPHWNIDANSLLYVIRGEGRVRIVNSQGNAVFDNKVRKGQLVVVPQNFVVAEQAGENEGLEYVVFKTNDRAAVSHVQQVFRATPADVLANAFGLRQRQVTELKLSGNDGPLVHRQPQSQSD

SEQ ID NO: 72603 - protein, 405 aa, Hordeum vulgare
HQVLFQGFNWESWKQSGGWYNMMMGKVDDIAAAGVTHVWLPPPSHSVSNEGYMPGRLYDIDASKYGNAAELKSLIGALHGKGVQAIADIVINHRCADYKDSRGIYCIFEGGTSDGRLDWGPHMICRDDTKYSDGTANLDTGADFAAAPDIDHLNDRVQRELKEWLLWLKSDLGFDAWRLDFARGYSPEMAKVYIDGTSPSLAVAEVWDNMATGGDGKPNYDQDAHRQNLVNWVDKVGGAASAGMVFDFTTKGILNAAVEGELWRLIDPQGKAPGVMGWWPAKAVTFVDNHDTGSTQAMWPFPSDKVMQGYAYILTHPGIPCIFYDHFFNWGFKDQIAALVAIRKRNGITATSALKILMHEGDAYVAEIDGKVVVKIGSRYDVGAVIPAGFVTSAHGNDYAVWEKN

SEQ ID NO: 72604 - protein, 164 aa, Brassica napus
TVVPSTFPASEALKMNPDGILFSNGPGDPSAVPYAVETVKELLGKVPVYGICMGHQLLGQALGGKTYKMKFGHHGGNHPVRNNRTGQVEISAQNHNYAVDPASLPGGVEVTHVNLNDGSCAGLSFPAMNVMSLQYHPEASPGPHDSDNAFREFIELMKRSKQSS

SEQ ID NO: 72605 - protein, 414 aa, Bradyrhizobium sp. ORS278
MMHAAVNGSGYDVSRIRADFPILGMQVHGKPLVYLDNAASAQKPQAVLDRMNQVYTSEYANVHRGLHYLANAATEAYEGARAKVATFLNAESPEQIIFTRGATEAVNLVAQTFGRERIGPGDEIVLSIMEHHANIIPWHFLRERQGAVIKWAPVDDDGNFLLDEFEKLLSPRTKMVAMTQMSNVLGTVVPVKEVIRIAHDRGIPVLVDGSQAAVHMEVDVRDIDADFYCITGHKIYGPTGIGALYGKRELLASMPPFNGGGEMIREVSRDWVTYGDPPHRFEAGTPPIVEAAGLGAAIDYVASIGKQRIAAHEHDLVTYATEQLREINSLRIIGNAADKGAIVSFEMQGAHAHDFATVIDRSGVAVRAGTHCAMPLLERFGVSATCRASFAMYNTREEVDVLVRALKKAQEFFS

SEQ ID NO: 72606 - protein, 550 aa, Oryza sativa Japonica Group
MALLLRHSPKLRRAHAILGCERGTVVRHFSSSTCSSLVKEDTVSSSNLHPEYAKKIGGSDFSHDRQSGKELQNFKVSPQEASRASNFMRASKYGMPITANGVHSLFSCGQVVPSRCFSSGADLPPHQEIGMPSLSPTMTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 72607 - protein, 415 aa, Rickettsiella grylli
MNTCDLTKIRADFPILQQKIKGSPLVYLDNAASTQKPYAVIQRLHHFYQYENSNVHRGIHTLSELATHAFEQSRQKVQHFIHAKSSAEIIFVRGTTEAINLVAQTYGLSHLRAGDEIIISHMEHHANIVPWQILCEQTGAQLKIIPINDAGELVLEEYQRLLNAKTKLVSICHVSNTLGTINPIQSIIDWAHANSPETKVLIDGAQAVAHQKIDVHALDCDFYAFSGHKLFAPTGIGVLYGKYELLARMPPYQGGGSMITEVGLKKSHYREPPYKFEAGTPHIAGAVGLGAAIDYLNQLDFNVIHCHEQQLLDYAIQHLQAIQGLRFIGMAKEKAAILNFIVNDSRGRRIHGHDISDVLNAEVGVAVRAGQHCTMPLMQRFDVDSTVRVSMALYNNKEDIDALIRGLHILKQLFK

SEQ ID NO: 72608 - protein, 690 aa, Gibberella zeae PH-1
MASSQTVTVDNLAQVLENDNMVKLAGVDVDGILRGKLVSKKKFLSIAEAGFGFCSVIFGWDMHDRTYVRELKISNAENGYHDLLAIPDLSTFRRIPWEDNVPLFLVDFLDPDSQKPICACPRGLVKTQLAKLKEHGYGAMAGAEYEFYQFKSPDPSSSSPAAYLQDNPPHQLPALTEGMFGYSLTRPVHNQDYYYDVFNTCAKFSCNIEGWHTESGPGVFEAALEFGEIAQMADRAALFKYVVKSVSTKYGITPCFMAKPKQGLPGNSGHMHVSIVDKEGKNLFARETKDENPKWRDIANLSDMGRHFLAGILVGLPDIMPILAPTINSYKRLVENFWAPVTVSWGLEHRAASIRLICPKPSATRFEVRVPGADTNPHLVLSAILGCGWRGVEKKLEIPTPPLAMGQDVGGDADQGERLAKSLKEATARFMAKDSIAREVFGDDFVEHFGGTREHEVRLFDEAVTDCNETRQTEHDTKYPPPLLHDSESFVTLVHSMIEAMKSYQNVCLHCRKYCKRASSVQRTWESAERLTRPKDALIDGVGIVAILAHSHSPKIVLQKQFRPPVNKVVIEVPAGLIDEGETAEECAVRELREETGYVGVVTETSPIMFNDPGFCNTNLKMVHVSIDMTLEENKNPKPNLEPGEFIETFTVELKDLWKECERLEAQGHVIDARVATIAEGILLAQRFKL

SEQ ID NO: 72609 - protein, 375 aa, Saccharomyces cerevisiae
MLRTSTLFTKRVQPSLFSRNILRLQSTAAIPKTQKGVIFYENKGNLHYKDIPVPEPKPNEILINVKYSGVCHTDLHAWHGDWPLPVKLPLVGGHEGAGVVVKLGSNVKGWKVGDLAGIKWLNGSCMTCEFCESGHESNCPDADLSGYTHDGSFQQFATADAIQAAKIQQGTDLAEVAPILCAGVTVYKALKEADLKAGDWVAISGAAGGLGSLAVQYATAMGYRVLGIDAGEEKEKLFKKLGGEVFIDFTKTKNMVSDIQEATKGGPHGVINVSVSEAAISLSTEYVRPCGTVVLVGLPANAYVKSEVFSHVVKSINIKGSYVGNRADTREALDFFSRGLIKSPIKIVGLSELPKVYDLMEKGKILGRYVVDTSK

SEQ ID NO: 72610 - protein, 439 aa, Yersinia pseudotuberculosis IP 32953
MCITSMCITSICITSLLKHATMIKAKKFRGHSQDANNSMKVFNPMDFRREFPALSDKLTYLDSAATALKPRAMIDATQQFYQQDSATVHRSQHQSALSLTVRFENTRQQVADFINSSTAENIIWTRGTTEAINLIAQSYARPRLQPEDEIIVSEAEHHANLIPWLMVAEQTGAKIVKLPIGLDHLPDLQQLPQLLNEKTRILALGQMSNVTGGSPDLAQAIRLAHQYDCVVVVDGAQGIVHYPADVQALDIDFYAFSSHKLYGPTGIGVLYGKTELLEEMPAWQGGGKMLTHASFGGFTPHEVPYRFEAGTPNIAGVIGLSAVLKWLEHIDLEEAEVYSQGLATMAENKLAQLPGFHSYRCQQSSLLAFTFDGVHHSDLVALLAEQGIALRAGQHCAQPLMAALGVNGSLRASFAPYNTPQDVEMLCSALGKALELLRD

SEQ ID NO: 72611 - protein, 443 aa, Streptomyces coelicolor A3(2)
MKFKSDSSHFDVSGPTVAVVGLGYVGLPTALALCDAGATVIGVDSSPERLRDIARGAVDLLPLHHAQLACASAGDRFRLTPDATAVRDADAVVICVPTPVDARRRPDLAALSAACASVVEHAVPGQLIVLTSTSYVGTTRDLLVEPLRARGLTVDEDVYVAFAPERIDPGNERHTPERTPRLVGGAGPRSSRAAADLLAPTASAVRTVPDPETAEMAKLWENTYRAVNIALANELADACHSLGLAPAPVIEAAATKPYGFMPFYPGPGVGGHCIPCDPHYLLWQLGKVRQQAPLVATALAANSRRPARITERALDLLADSAVPAHGARVLLIGVAYKEGVADVRESPALEILAGLAEAGAHVAYCDPLVPSLRVGADALHHLPDPHTRPWDLVVLNTVHPVHDLTWLCADDAPPVLDTRQRGPLTKAAARAATGVPPAAEATA

SEQ ID NO: 72612 - protein, 348 aa, Saccharomyces cerevisiae
MSIPETQKAIIFYESHGKLEHKDIPVPKPKANELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 72613 - protein, 557 aa, Mycobacterium sp. MCS
MTSPEPDAPGTETTFADLQIHPEVLRAVTDVGYETPSAIQAATIPAMLAGSDVVGLAQTGTGKTAAFAIPILSKIDPNSRATQALVLAPTRELALQVAEAFGRYGAHLPVNVLPVYGGSSYGPQMAGLKRGAQVVVGTPGRVIDHLEKGSLDLSHLDYMVLDEADEMLQMGFAEDVERILSDTPEYKQVALFSATMPPGIKKITKKYLHDPVEVTVKSKTQTAENITQRYIQVSYPRKMDALTRLLETEQGDGMIVFVRTKQATEEVAEKLRARGFAAAAINGDIPQAVRERTISQLKDGSIDILVATDVAARGLDVERISHVVNFDIPHDPESYVHRIGRTGRAGRSGTALLFVTPRERHLLNSIERVTRQKLVEIQLPSVEDVNAQRVEKFRDSIGEALNAPGIDLFRRLIEDYERDNNVPLADIAAALAVQSRNGEEFLMTEPPPEKRRERPVRDESGPRKARDRTRSDLATYRIAVGKRHKVMPGAIVGAIANEGGLNRSDFGHIAIKPEYSLVELPADLPKDTLKKLERTRIQGVLINLEPDRGPKARYKGK

SEQ ID NO: 72614 - protein, 525 aa, Oryza sativa Japonica Group
MSRVAVAVLLLLCLQLQLGISGGGGGGHGARRARLIHAKKSSSSSQQQQQQQRSRQAGSKAGWPSTSSTPSNPFGLPMLLPPPPPLKDWPPWLDMPPVQGPSSSPSPSPSPAPSPASSAAVAEHAAPPRRGEEHARPRSIALPPASSSGDAGETSRPEVTDGSATRRGGGGGKTNYVLVAAAGASVLLAASAAAFAACYRSSKVVRSVRPWATGLSGQLQRAFVTGVPALRRAELEAACEDFSNVIGSLPEYTMYKGTLSSGVEIAVVSTTKTSPKDWSKKCEAHFRKKITSLSRVNHKNFVNLLGYCEEEQPFTRMMVFEYAPNGTLFEHLHARDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 72615 - protein, 201 aa, Zea mays
MAGAAALNEGILSSVSEKNVAAHPWHDLEIGPEAPEVFNCVVEIPRGSKVKYELDKISGLIKVDRVLYSSVVYPHNYGFIPRTLCEDSDPMDVLVLMQEQVVPGCFLRARAIGLMPMIDQGEKDDKIIAVCADDPEFRHYKDISDLPPHRLQEIRRFFEDYKKNENKEVAVNDFLPAEDAIKAIEHSMDLYGSYVMESLRR

SEQ ID NO: 72616 - protein, 383 aa, Oceanobacillus iheyensis HTE831
MEHLLNQQVQNIEISGIRKFFNLVSNEKDIVSLTIGQPDFYTPHAIKQASINAVNNNHTTYTANAGVIELRKAIANYYESRYQIPYHPESEIIVTAGASEAIDITLRTILEPGDEVILPAPIYPGYEPLITLARAKPIHMDTTKTNFKITKSQLEETITEKTKCIIIPSPSNPTGAAYTKKELDEIVSVLKDKKLFILSDEIYSEIIFDQPHVSIASYPEMRDQTIVINGLSKSHSMTGFRIGYALAPHWLSKHMLKVHQYNVSCASSISQYAALEAFNSNDDHLQLIKDTYKSRRDLVYNRLTSMGIDVQLPEGAFYMFPRFPMRNENSFEFGLTLVKQAKVALVPGNSFSQYGEGFMRLSYAYHEDVLNKGLDRIEKFLNQ

SEQ ID NO: 72617 - protein, 367 aa, Fulvimarina pelagi HTCC2506
MGFRCGIVGLPNVGKSTLFNALTKTAAAQAANYPFCTIEPNTGDVAVPDSRLKNIAGIAKSANVIPTRITFVDIAGLVRGASKGEGLGNQFLANIREVDAIVHVLRCFEDEDIAHVEGKIDPVADAETVETELMIADLESLERRVVNTRKKATGKDKEALAQLPVMEKALEALNDGKPVRTIVEDLDPEDRRTLRALNLLTSKPVLYVCNVAENDAATGNHHAADVAKMAESQGAGAVVISAAIEAEIAQLDEAETSEFLETMGLTEPGLDRLIRAGYDLLDLITYFTAGPKETRAWTVHNGAKAPQAAGVIHTDFEKGFIRAQTIAYDDYVTLGGEVPAKDAGKARDEGKEYVVADGDVMLFKFNV

SEQ ID NO: 72618 - protein, 214 aa, Zea mays
  misc_feature (159)..(159): Xaa can be any naturally occurring amino acid
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFXLAEGTAIEDLFKPSMSARLLDKAQISIYDPKGDGGPDPAGPSHETVRLGPPDAPA

SEQ ID NO: 72619 - protein, 132 aa, Oryza sativa Japonica Group
AVSVKSQLQQIARPMYSNPPVHGALVVSIILNDPELKSLWLKEVKGMADRIIGMRKALRENLEGLGSPLSWDHITNQIGMFCYSGMTPEQVVRLTNEYHIYMTRNGRISMAGVTTGNVAYLANAIHEVTKTK

SEQ ID NO: 72620 - protein, 478 aa, Fulvimarina pelagi HTCC2506
MRRNRSVKILATLGPASSEERQIAELHKAGADVFRINMSHADHDLMRELVARIRKVEAELGRPIGILADIQGPKLRVGKFKEGSVDLEIGQEFTLDNNEEPGGATRVYLPHPEILEAVEVGHRLLIDDGRLFLECIETDGLMVKTRVVAGTKISDRKGVSLPDTTLKTGALTEKDRSDLDAVLEADVDWVALSFIQRPSDLAEARKIAKGRALLMAKIEKPQAVERLDEIIELSDAIMVARGDLGVELPLEEVPGIQKRITRACRRAGKPVVVATQMLESMISAPVPTRAEVSDVSIAVFEGADAVMLSAESAAGKYPVDAVATMDRIAIQVEKDPLYPGIIFAQRPEPEATGADAVSLAARQMAETLDVAVIVTYTATGTTGLRAARERPRIPLLALSPITRTARRLSLAWGLHCVVTEDAQDLDDMVDKACRIAVEQGYAVAGQKLIVTAGVPLRQPGATNMLRIAYIGSDGLSAV

SEQ ID NO: 72621 - protein, 186 aa, Glycine max
  misc_feature (18)..(18): Xaa can be any naturally occurring amino acid
MSSPSKRRDMDLMKLSSXMMSDYKVETVNDGMQEFFVEFHGPKDSPYQGGVWKVRVDLPDAYPYKSPSIGFVNKIFHPNVDEMSGSVCLDVISQTWSPMFDLVNVFEVFLPQLLLYPNASDPLNGDAAALMIRDHATYEQRVKEYCEKYAKPEDVGAVQEESSSDDEPSEDDYASSDDAIVGQPDP

SEQ ID NO: 72622 - protein, 364 aa, Betula pendula
MALHDDSRKSLIPTFLYSSSSSSLLKKTRPFDLDTLRTTSPHGSSSSSKNFVVPAPKERIEMYSPAFYAAATVGGILACGPTHTLVTPLDVLKCNMQIDPAKYRSISSGFGILLKEQGVRGFFRGWAPTLLGYSAQGAFKYGFYEYFKKYYSDIAGPEYAAKYKTLIYLAGSASAELIADVALCPMEAVKVRVQTQPGFARGLSDGLPKFVKSEGALGLYKGIVPLWGRQIPYTMMKFASFETIVEMLYKHAIPTPKDQCSNTLQLGVSFAGGYVAGVFCAIVSHPADNLVSFLNNAKGATVGDAVKKMGLLGLCTRGLPLRIFMVGTLTGVQWGIYDAFKVSVGLPTTGGVTPAPAATTLAKV

SEQ ID NO: 72623 - protein, 436 aa, Vibrio vulnificus YJ016
MSTETKKMSVVQLTILTFINMAGSGIIMLPSKLAQVGTISVLSWLITAAGSLALAYVFAKCGRFSKRDGGMNGYASYAFGKSGAFMAGWTYGLSLLIANIAIAITCVGYGSAFFEVTLSPVETCLYTIAILWICTFANFGGAKITGQIGSFTVWGVILPVCSLGIVGWFWFNPTMYVEAWNPHHLPFGEAVSASIAMTLWAFLGLESACANSDAVDNPEKNVPIAVLGGTLIAAVVYIVSTNICSGIVANADLAASTAPFSTVWTVMLGSTAGKMVAGMAVLACAGSLLGWQFTIASVFKSSSDAGFFPKLFSEVDKRGTPIKGMVAITVIQSVLSLMTISPTLNEQFEALVNLAVVTNVIPYILCMGAIFIMQQVAHVPEREMKTTNIIALVGSLYSFYALYGSGYEAMMWGSIVTFLGWSAYGLIAAKHEPLAN

SEQ ID NO: 72624 - protein, 125 aa, Salvia columbariae
DLKPENVLVRDDGHIMLSDFDLSLRCAVSPTLVKTSSLDNDAQRKNSGYCAQPACIEPSCIQPSCVVPTSCFSPRIFSSKSKKDKKPKNKNEIDNQVRPLPELMAEPSNARSMSFVGTHEYFAPE

SEQ ID NO: 72625 - protein, 525 aa, Cicer arietinum
MRLVEIAVTLVLIALFIHFRPTPTAKSKALRHLPNPPSPKPRLPFVGHLHLLDHPLLHQSLIRLGERYGPLYSLYFGSMPTIVASTPDLFKLFLQTHEAVSFNTRFQTSAIRRLTYDNSVAMVPFAPYWKFIRKLIMNDLLNATTVNKLRPLRSQEIRKVLNVMAKSAQTQEPLNVTEELLKWTNSTISRMMLGEAEEIRDIARDVLKIFGEYSLTDFIWPLKKLKVGKYEKKIEEIFNRFDPVIEKVIKKRQDVRRRRKERNGELEEGEQSVVFLDTLLDFAEDETMEIKITKEQIKGLVVDFFSAGTDSTAVATDWCLSELINNPRVMKKAREEVDSVVGKDRLVDESDIQNLPYIRAVVKETFRMHPPLPVVKRKCTEECEINGYVIPEGALVLFNVWAVGRDPKYWDRPLEFRPERFLENAGEGDAGSIDLRGQHFQLLPFGSGRRMCPGVNLATAGMATLLSSVLQCFELQVAGPNGQILKGADAKVSMDERPGLTVPRAHNLVCVPLARPGAAAKLLSS

SEQ ID NO: 72626 - protein, 118 aa, Saccharomyces cerevisiae
ASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 72627 - protein, 211 aa, Pseudomonas fluorescens Pf-5
MFRNSYIQQNSDIQAAGGLVPMVVEQSARGERAYDIYSRLLKERVIFLVGPVEDYMANLICAQLLFLEAENPDKDIHLYINSPGGSVTAGMSIYDTMQFIKPNVSTTCIGQACSMGAFLLTAGAPGKRFCLPNSRVMIHQPLGGFQGQASDIEIHAKEILFIRERLNTLMAKHSGRTLEEIERDTNRDNFMSAEAAREYGLIDEVINQRPA

SEQ ID NO: 72628 - protein, 1027 aa, Arabidopsis thaliana
MSERAKLQKKKKVTEDLLDSLLLLPPWRNFAISQSHQSIIESSSQRLPEKMRIDENEGVSASSKHLVFAYYVTGHGFGHATRVVEVPSPSLTLFSLCIGLISDPCVLFSSFIVVRHLIAAGHDVHVVTGAPDFVFTSEIQSPRLKIRKVLLDCGAVQADALTVDRLASLEKYVETAVVPRAEILETEVEWLHSIKADFVVSDVVPVACRAAADAGIRSVCVTNFSWDFIYAEYVMAAGYHHRSIVWQIAEDYSHCEFLIRLPGYCPMPAFRDVIDVPLVVRRLHKSRKEVRKELGIAEDVNVVILNFGGQPSGWNLKETSLPTGWLCLVCGASETLELPPNFIKLAKDAYTPDIIAASDCMLGKIGYGTVSEALSYKVPFVFVRRDYFNEEPFLRNMLEFYQCGVEMIRRDLLMGQWTPYLERAVSLKPCYEGGINGGEIAAHILQETAIGRHCASDKLSGARRLRDAIILGYQLQRVPGRDIAIPEWYSRAENELGQSAGSSPTVQANENNSLVESCIDDFDILQGDVQGLSDTCTFLKSLAMLDAIHDSEKSTEKKTVRERKAAGGLFNWEEEIFVARAPGRLDVMGGIADYSGSLVLQMPIREACHVAVQRNLPGKHRLWKHAQARQQAKGQVPTPVLQIDPAQKWAAYVAGTILVLMIELGVRFEDSISLLVSSAVPEGKGVSSSAAVEVASMSAIAAAHGLSIDPRDLAILCQKVENHIVGAPCGVMDQMTSSCGEANKLLAMICQPAEVVGLVEIPNHVRFWGIDSGIRHSVGGADYRSVRVGAYMGRKMIKSMASSILSPSASSANGGNPEELEDEGIDLLEAEASLDYLCNLSPHRYEARYADKLPDIMLGQTFIEEYADHDDPVTVIDQKRSYSVKAPARHPIYENFRVKTFKALLTSATSDEQLTALGGLLYQCHYSYSACGLGSDGTNRLVQLVQGMQHNKSNSEDGTLYGAKITGGGSGGTVCVVGRNSLRSSQQILEIQQRYKAATGYLPLIFEGSSPGAGKFGYLRIRRRISL

SEQ ID NO: 72629 - protein, 571 aa, Oryza sativa Japonica Group
MRIPRRKGGAGPLVGAPSRRAQVAAVFALALLLGVSVLYDSAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKDRRRTPASSRTASTGAYLGCQTHGTSSFTVTSSRALKGGRLSRLRINLRDNSEEFVYLESIRSFSEEEVAAEAINYFLGLGIYAVDSPRV

SEQ ID NO: 72630 - protein, 362 aa, Streptomyces coelicolor A3(2)
MSLTIGIVGLPNVGKSTLFNALTKNDVLAANYPFATIEPNVGVVGVPDPRLTKLAEIFSSEKILPATVDFVDIAGIVRGASEGEGLGNKFLANIRESDAICQVIRAFKDENVVHVDGKVSPKDDIETINTELILADLQTIEKVLPRLQKESRIKKDVAPKVKAVEEAKEILEKGDTLFSQGILQGSERAELLHDLHLLTTKPFLYVFNVDEDELTDDDFKSEQRALVAPAEAIFLNAKLEADLAELDEDEALELLQSVGQDEPGLATLAHVGFRTLGLQTYLTAGPKESRAWTIKKGATAPEAAGVIHTDFQKGFIKAEVISFDDLVETGSVTEARAKGKARMEGKEYVMRDGDVVEFRFNV

SEQ ID NO: 72631 - protein, 391 aa, Mycobacterium sp. MCS
MAETVVGSSQVVISDDEIFAAHEGGKLAVQLNEPLDTQRALSIAYTPGVAQVSRAIAKDPALAARYTWANRLVAVVSDGSAVLGLGDIGAAASLPVMEGKSALFKTFGGLDSIPIVLDTKDPDEIVETLVRLRPTFGAVNLEDISAPRCFEIERRVIEALDCPVMHDDQHGTAIVVLAALMGAARVLGRDAATLRVVISGAGAAGVACANILLAAGISDVTVLDSKGIVHSGRDDLNSFKAELAERTNPAGRTGGVAEALDGADMFLGLSAGVVAEELIATMAPGGIVFALSNPDPEIHPDLARKYAAVVATGRSDFPNQINNVLAFPGVFRGALDAGARRITERMKVAAAEAIFSVVGDDLAVDHIVPSALDPRVAPAVAAAVGAASQVG

SEQ ID NO: 72632 - protein, 439 aa, Shewanella sp. ANA-3
MSKSANKIGVVQLTIITIVNMMGSGIIMLPTQLAQVGTISILSWLVTAAGSTALAYAFAKCGMFSKKSGGMGGYAEYAFGRSGNFMANYTYAVSLLIANVAIAISAVGYAAVLLEVNLSPMAICLATIGVLWLATVANFGGARITGRVSSVTVWGIILPVIGVSLIGWFWFDIDLYKGAWNPHDMPFFKALGGSIAMTLWAFLGLESACANSETVDNPEKNVPIAVMGGTLGAALIYIVSTNVIAGIVPNADLANSNAPFGLAFAQMFNPVVGKIVMACAIISCTGSLLGWQFTIAQVFKASADEGFFPKVFSKVSKADAPIWGMTIIVSIQTLLSLMTISPSLSKQFEALVNLAVVTNIVPYILSMAALGVMQKQLKVPANKARVANVIAVIGALYSFYALYSSGETAVMLGAIATFFGWTIYGVISNKTPTAEIKAA

SEQ ID NO: 72633 - protein, 454 aa, Mannheimia succiniciproducens MBEL55E
MTITTPVKAVLASNQYFLDRQNAMESNVRSYPRKLPFAYAKAQGCWVTDVEGNEYLDFLAGAGTLALGHNHPVLIQSIKDVLDSGLPLHTLDLTTPLKDAFTEELLSFFPKDQYILQFTGPSGADANEAAIKLAKTYTGRGNVIAFSGGFHGMTHGALSLTGNLGAKNAVQNLMPGVQFMPYPHEYRCPFGIGGEAGAKAVERYFENFIEDVESGVVKPAAVILEAIQGEGGVVPAPVSFLQKVREVTQKHGILMIVDEVQAGFCRSGKMFAFEHAGIEPDIVVMSKAVGGSLPLAVLAIKKEFDAWQPAGHTGTFRGNQLAMATGYASLKIMREENLAQNAQQRGEYLTQALRELSKEFPCIGNVRGRGLMMGIDIVDERKPQDAAGAYPQDGELAATIQKFCFKNKLLLERGGRNGNVVRVLCAININQAECEEFIKRFKQSVTDAIKAVRG

SEQ ID NO: 72634 - protein, 430 aa, Oryza sativa Japonica Group
MAMSRAAAAAAGTPVARRRLMGAVAARSMASWFGHVEPAAKDPILGVTEAFLADPSPDKVNVGVGAYRDDSGKPVVLECVREAGRRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 72635 - protein, 206 aa, Triticum aestivum
ARGQNPRKFGPSPGRSIHRSPVPSPPPVPMDSAPPAAGAGYPESTDSSPRSRGGDSWDEPFPSSAAAAAAGGGGGRLRLMCSFGGRIVPRPTDKSLCYLGGETRIVAVDRNASLADVHGRLSRSLLAGQPFTLKYQLPNEDLDSLISVSTDEDLDNLVDEYDRVAATSSSGGASSRTSRIRLFLFPAKPESSSSLGSLLDDSSKSE

SEQ ID NO: 72636 - protein, 414 aa, Gluconobacter oxydans 621H
MGGPHGQAGEQSHKLDVPAVPAHSSPMRIAALLLAAGRGRRFDASSQSGENSSKQFRMLRGKPVIRRAAEALLPHVDVLLPVGDDPLLADSLEGLDILPPVSGGAERHDSVRNGLEALAKLPEPPDLVLVHDGARPCVPAEVVQNVINALKTHEGVIPAVAVIDTIKKAKDGIIVDTVPRDGLWRAQTPQGFRFGTLLELHRTHRDARTDDAALLEQAGHPVAIVEGSEDNIKLTVAEDLMRLEGVIDRNLLPRVGLGYDVHAFEEGRKLILCGIEVPHTKGLAGHSDADVGIHTLCDAIYGALAEGDIGRHFPPSDNKWKDMDSARFLVHAGERIRERGGFLVNADVTLICERPKIGPHAEAMRNRLADLLKVSVSRISVKATTSERLGFTGREEGIAATATVSIMVPDNGEA

SEQ ID NO: 72637 - protein, 236 aa, Zea mays
  misc_feature (143)..(143): Xaa can be any naturally occurring amino acid
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTADFHLFKAGVEPKWEDPECANGGKWTVPXNRKPTFETMWLETLMALVGEQFDETDDICGIVASVRPRGDKLALWTRTASNEAVQVNIGKKWKDVIDYNDKITYTFHDDSRRDKPSRGGRYTV

SEQ ID NO: 72638 - protein, 123 aa, Salvia columbariae
PEKPENVLVRDDGHIMLSDFDLSLRCAVSPTLVKTSSITSDPQNKNSTYCAQPACIEPACIQPSCVLPTMCFSPRLFSSKSKKDRKPKNDIGNQVSPLPDLIAEPTNARSMSFVGTHEYFAPE

SEQ ID NO: 72639 - protein, 119 aa, Salvia columbariae
DLKPENVLVRDDGHIMLSDFDLSLRCSVSPTLVKFPSLEPDTLRANTTECIAPSCVQPSCMAPTTCFGPRFFSGKSKKKDHKPKNDIGNQVRPLPELMAEPTDARSMSFVGTHEYLAPE

SEQ ID NO: 72640 - protein, 118 aa, Salvia columbariae
DLKPENVLVRDDGHIMLSDFDLSLRCAVSPTLIRNSALNSDRGSGFCVQPACIEPTSACIQPTCFLPRLFPQKSKKKSGKSRTEAGMLSGGTLPELVAEPTAARSMSFVGTHEYLAPE

SEQ ID NO: 72641 - protein, 212 aa, Burkholderia glumae
MNQSDDHSGVSIRTRIKVPIRPRSSATAFETEMVTFNGLCDSAEHIALVFGKIGEAPLVRLHSECLTGDVFGSARCDCGEQLDESIALFGERGGILLYLRQEGRGIGLYNKLDAYRLQISQGLDTFAANRALNFPDDLRDFRVAAQMLKALGVGEVSLVTNNPDKTAQLTRHGIKVRQVKSTGVFANSVNFGYLHAKATQHRHAIKLNGEMQ

SEQ ID NO: 72642 - protein, 207 aa, Brassica napus
  misc_feature (167)..(167): Xaa can be any naturally occurring amino acid
  misc_feature (179)..(179): Xaa can be any naturally occurring amino acid
  misc_feature (197)..(197): Xaa can be any naturally occurring amino acid
MFEHTLLSLLLLPSLLSLLLFLILLKRRSRHRFNLPPGKSGWPFIGETIGYLKPYTATTLGDFMQQHISKHGKIYRSNLFGEPTIVSADAGLNRFILQNEGRLFECSYPRSIGGILGKWSMLVLVGDMHRDMRSISLNFLSHARLKTILLKDVERHTLFVLDSWQHXSVFSAQDEAKKXTFNLMAKHIMSMDPGEEXTEQLRRVVTS

SEQ ID NO: 72643 - protein, 231 aa, Zea mays
  misc_feature (151)..(151): Xaa can be any naturally occurring amino acid
LDPAAEHFDYSVRMDIRELISLDDVMEEIGLGPNGGLFYRMEHLEDSLDDWFDEQLENYLDDDYLVFDCPGQIELFTHVPVLRHFVEHLKRKNFNVCPVYLLDSQFVSDVTKYISGCMASLSAMIQLELPHINILSKMDLVSNKKDVEELXYLDPNAQVLLSQLNRQMAPRFGKLNKCLAELVDDYSMVNFIPLDLRKESSIQYVLSSIDTCIQYGEDADVKVRDFEEDED

SEQ ID NO: 72644 - protein, 256 aa, Fulvimarina pelagi HTCC2506
MTEPRLNADELERYARHIVLPEIGGTGQQKLKAARVLVIGAGGIGSPVALYLAAAGVGTIVCCDDDTVSLSNLQRQVLHGTEDVGRPKLDSAADAVRRVNPHAAFEAHPIRLTAENGADLVASCDLAIDGSDNFATRYAMADLCEDAEIPLVTAAVQRFSGSLTVLTPYREGPDGILLPRYRDLFPEAPAAGTVPSCAEAGILGTTTGVLGTLAASEAIKVICGTGEPLVGRFLMVDLLAMRFETIRYRRLRPKAE

SEQ ID NO: 72645 - protein, 535 aa, Shewanella sp. MR-4
MTQLSSRINARSDEFKAKSDDMAALVADLKTKLAKIELGGGPVALERHLARGKLLPRQRVEKLLDAGSPFLELSQFAAFEVYDEEVPAAGIIAGIGRVSGVECMIIANDATVKGGTYYPITVKKHLRAQEIASRCHLPCIYLVDSGGANLPRQDEVFPDRDHFGRIFYNQAQMSAKGIPQIAVVMGLCTAGGAYVPAMADESIIVKEQGTIFLAGPPLVKAATGEEVSAEELGGADVHTKISGVADHLAQNDEHALELARRAVLRLNHQKQINSLLSPVKPPKFDINELYGIVGTDLKKPFDVKEVIARIVDDSDFDEFKANYGATLVCGFARIHGYPVGIVANNGILFSESAQKGAHFIELCCQRKIPLLFLQNITGFMVGKKYEHEGIAKHGAKMVTAVSCANVPKFTVIIGGSYGAGNYGMCGRAFEPTMMWMWPNARISVMGGEQAAGVLATVRRDGLARKGEEWSAEDEKAFKAPIIAQYDKEGHPYHASARLWDDGIIDPAQTRDVVGLALSAALNAPIEDTRFGVFRM

SEQ ID NO: 72646 - protein, 109 aa, Salvia columbariae
DLKPENVLVREDGHIMLSDFDLALRCVVSPTLITTSALHSHPSKQRARFCAQPSSACIQPSCFLPRIFHQRSKKRSGKTPSGTLPELVAEPTAARSMSFVGTHEYLAPE

SEQ ID NO: 72647 - protein, 118 aa, Salvia columbariae
DLKPENVLVREEGHIMLSDFDLSLRCSVSPTLVKSSSTHDASTADAAANGSILNDENAVRGCAQPSSFFPRLLPKKNRKSKSDFGLGNNMNGLPELMAEPTNVRSMSFVGTHEYLAPE

SEQ ID NO: 72648 - protein, 379 aa, Glycine max
MSSTAGQVIKCKAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 72649 - protein, 431 aa, uncultured bacterium
MLLKKRWLIFISFLLAFTLLIPTAASASEKHYKPNIALEPIENSEGNEHPIILVHGLGGFGRDELGGIIKMWGGIHDIEKKLREKGYKVYTAAVGPVSSNRDRAIELYYQIKGGTVDYGEAHAKKYGHDRYGRTYPGFYPEWGEINPKTGKPNKVHLIGHSMGGQTIRTLAQLLYEGDPEEHKTGGNDISPLLSGEKQPWLHSVLSISSPHDGSTATYLVNDVIPIIQELVIGAAIFAGNIDQNLYDFKLDHWGIKKRPGESFHSYVQRVRNSPGWKTKDTANWDLKPEGAYELNRWVKAQPDVYYFSVSNTQSRRSLLTGYYVPDLFMNPFLHPTAYYIGSKTFRKSNFVLDKTWWENDGLVSVKAMKGPNIGSNDVIVEYNGTPRKGVWNHLGTMRQFDHLDIIGWGVRDVTSWYEDVARFLYSLPDDY

SEQ ID NO: 72650 - protein, 589 aa, Nostoc sp. PCC 7120
MQLRDSVRRTKIVATIGPATSSPEMLKAIIEAGATTLRLNFSHGSHADHQRSIRLIRQTAFELNQPVAILQDLQGPKIRLGKFENGSIVLAKGDRFTLTNRPVVGSQEISCVTYDYLADEVPVGAKILLDDGRVEMVVEDINRDKGDLNCRVTVAGKLSNNKGVNFPGVYLSIKAMTDKDREDLMFGLDQGVDWVALSFVRNPQDIIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSYPVEAVATMARIAERIEQEEAMASKLRQMRDNRRSIPNAISQAVGQIAEQLGAAAIMTLTQTGATARNVSKFRPQTPILAVTPHVNVARQLQMVWGVKPLLVLELPSTGQTFQAAINVAQEHSLLFEGDLVVMTAGTLQGVSGSTDLIKVEVVTAVLGQGIGLGQGLVSGCARVAHTGMDVGNFNAGDILVAPRTGADFVEAIRKAGGIITEDESLTSHAAVIGLRLGVPVIVGVKKATQVIRDGAILTLDLQRGLVYSGAVGTP

SEQ ID NO: 72651 - protein, 491 aa, Debaryomyces hansenii CBS767
MPVPPIAEDALDLIGNTPLIKLNRIPQSFGIKAKVYAKVELFNAGGSIKDRISKNMVLEAEKQGRIKPGYTLIEPTSGNTGIGLALVGAVRGYRTIITLPEKMSNEKVSVLKALGAEIIRTPTEAAWDAPESHIGVARKLEKEIPNSVILDQYSNEANPNAHYYGTGYEIWEQTNGKVTHLIAGAGTGGTITGISKYLKEKNSNIKIIGADPKGSILAVPESLNDTSEGYLVEGIGYDFIPDVLKRDRVDSWIKTDDSESFKLARRIIREEGILVGGSSGSALQAALEVAKDLTEDDTVVVVFPDSIRSYLTKFADDEWMTTNGFPIEENESASHKSDEVLNTTTIKDLVSGKAPVVTVTLSDTVGKTFDLLQTNGFDQLPVLNNSGKLVGLITLSKILKSLSTKKVQITNSISSIIIDFRKLADFEKSFTITKKSGFTKRSYEPITMDTSLALLNKFFETNSNAIVTDADYKPVQIVTKVDLISYLTKIL

SEQ ID NO: 72652 - protein, 748 aa, Yersinia pseudotuberculosis IP 32953
MLMRLREVVEKVAMATGLTEALELLVNETCLAMDTEVCSIYLADNDRRCYYLMATRGLKKPRGRTITLAFDEGIVGLVGRLAEPINLADAQSHPSFKYVPLVKEERYRAFLGVPIIYRRQLLGVLVVQQREHRQFDESEESFMVTLATQLAGILSQSQLNAIFGQYRQTRIRALAAAPGVAVAEGWQDISQPSLDLVYEASTLDSTLERERLTQALEEAAAEFRRFSKRFAASSQKESAAIFDLYSHLLNDARLKRELFAQIDAGAVAEWAVKQVVEAFAAQFASLQDTYMRERASDLRALGQRLLFHLDDSTSGASQWPERFILVADELTATLLAEVPQDRLAGVVVRDGAANSHAAILVRAMGIPTVMGADIQPALLSQRLLIVDGYRGEVLVDPEPVLVKEYQRLVTEEIELSKLAEDDVEQPAALKSGERIQVMLNAGLSPEHEQLLGGRVDGVGLYRTEIPFMLQSGFPSEEEQVAQYQGMLQLYPQKPVTLRTLDIGADKQLPYMPISEENPCLGWRGIRITLDQPEIFLIQVRAMLRANAGTGNLGILLPMITSIEEVDEAKRLIDRAGREVEEMLGYVLPQPRLGVMIEVPSMIFMLPYLTSRVDFISVGTNDLTQYLLAVDRNNTRVASLYDSLHPAMLQVLRQILMQATESGLQVSLCGEMAGDPMGALLLVGLGYRNLSMNGRSVARIKYLLRNIELADAQALAARVLTAQMTTDVRHLTAAFMERRGLGGLIRGGK

SEQ ID NO: 72653 - protein, 248 aa, Rickettsiella grylli
MNELLTTDFGYQTIPVTEKNNRVAEVFQSVAEKYDVMNDLMSLGLHRLWKKFAMQLAQIRKGECVLDVAGGTGDLIRTFAQQVGPKGKAILLDINATMLNKGRDRLLNAGLTEVITIQADGEYLPFTEASFDCLSIAFGLRNVTHKERALRSMYHVLKPGGRLLVLEFSKPLLGFLEVLYNRYSFNVLPQLGKWIVNDEASYRYLVESIRRHPDQETLQSIILAAGFDECEYYNLSGGIVALHRAWKF

SEQ ID NO: 72654 - protein, 434 aa, Zea mays
MYMPPPPPTGGAGEQPRLYQVWRGSNEFFLQGRFIFGPDVRSVFLTMILIIAPVVVFCLFVARHLINDFPDSWGISVMVVVVVFTIYDLTLLLCTSGRDPGIIPRNSHPPEPESIDGINDTGVQTPQQFRLPRTKEVIVNGISVRVKYCDTCMLYRPPRCSHCSICNNCVERFDHHCPWVGQCIGLRNYRFFYMFVFSTTLLCLYVFAFCWVYVIKIRAAEQSSVWKALLKTPASVALIIYCFLCVWFVGGLSVFHLYLMSTNQTTYENFRYRYDRRDNPYNKGVLNNFLEIFCTAIPPSKNNFRARVTAGQGLQQTRSQSRGFMSPSMGKPIGDLEMDRKPVAPWDEPRTAADIRDLEAGLGVMFDEKEGRVAHASPDLSRDLPAEFVEGRSGMHSRQSSWVQRGDAIEASAVQMANARTTEASNNVAWSGTH

SEQ ID NO: 72655 - protein, 152 aa, Saccharomyces cerevisiae
MWFPQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWISPLLGAFLAWSVWQLLQILDYTTYVNAEKAAGQKKED

SEQ ID NO: 72656 - protein, 562 aa, Oryza sativa Japonica Group
MELFYELLLTAAASLLVAFLLARLLASAATASDPRRRAPDHAAVIAEEEAVVVEEERIIEVDEVEVKSARARECVVSEGWVEVGRASSAEGKLECLPEEEEAPAKAARELVLDAVLEEREEEGQVGEERCDLAAAVAEVVGVKPHELGVEAAPGEVSDVTLEEGKVQDVGVEQHDLVAEAAPREALDTGLEKQGVPIIEAVEIKRQDDLGAEVAPSDVPEVEFEQQGVRIIEAIDVNQHHRVALAAPAEVVDAGLEERVQAIEAGSSGLTSETVPEEVLDELSEKQEEQVIEEKEHQLAAATAPVAIPGVALAETEELKEEQSSEKAVNVHEEVQSKDEAKCKLHLVDQQEGSASKVELVGRNTDNVEISHGSSSGDKMIAELTEEELTLQGVPADETQTDMEFGEWEGIERTEIEKRFGVAAAFASSDAGMAALSKLDSDVQLQLQGLLKVAIDGPCYDSTQPLTLRPSSRAKWAAWQKLGNMYPETAMERYMNLLSEAIPGWMGDNISGTKEHEAGDDAVGSVLTMTSNTINQHDSQGNEDNTGMYEGHLTSSPNPEKEF

SEQ ID NO: 72657 - protein, 624 aa, Frankia sp. EAN1pec
MRAGGNARPAKDSRLRAPDAGPMERMLADIHEAFRTDRSGKVASFIPELATADPALFGLAVTTMDGLRYRAGDSDVPFTIQSVSKPFVYALALRDRGTDGVLARVGVEPTGDAFNAITLEPETGRPLNPMVNAGALLTSSLVGGGDAAERFDRVLTGLSAFAGRQLTVNERVFASERDTGDRNRAIGYLMRGAGALRGPVDEICEVYFRQCAVEVTAADLAVMAGTLARGGVNPLTGERVLNEEHVNHVLTVMATCGMYDRAGTWLFRVGLPAKSGVAGGVCAVLPGQLGIGVFSPPLDEVGNSVRGVRACERLASRFALHLLAPQGEPPHPVRGTHRGDALSSKRMRGARERAVLAVRGSAIVIHELQGDLVFASAERVVRTVRQHLDDVRWVVLDLRRVAAVREPALELLRVLLDELASRDVNVLFADPRGLPGVDRLMRGDWSTQRVPDLETALEWAEEALLMREDLATLPPTAHVPLGAQELLTDLGKEGTRVIGAMCERRTYERGATVFDEGDPADALYFVTRGLANAQAPNADGTRWFRLSSVPAGSAFGELALVDGGRRSTRIVVAETMTCEVLSVAAFDTLVREHPDVYNALVRAIARSLSAQLRRATREIQSLEE

SEQ ID NO: 72658 - protein, 359 aa, Oryza sativa Japonica Group
MEHDGTAALGWAARDASGHLSPFSFTRRVQEEDDVTIKVLYCGICHTDLHTIKNEWGNAMYPVVPGHEIVGVVAGVGAGVTRFKAGDTVGVGYFVDSCRACDSCGKGDENYCPTMVITSNGTDYGGATTQGGFSDVMVVRQDYVLRVPASLPPDGAAPLLCAGVTVYSPMVEYGLNAPGKHLGVVGLGGLGHLGVKFGKAFGMKVTVISSSPAKREEALERLGADAFLSSRDGEGMAAAAATMDGIIDTVSAGHPLVPLLSLLKPKGQMVVVGAPAAPLQLPAIAIIDGGKRVAGSGGGSVAECQAMLDFAGEHGIAADVEVVAMGDVNAALGRLERNDVRYRFVIDVAGTLHAAAAPS

SEQ ID NO: 72659 - protein, 381 aa, Mycobacterium sp. MCS
MSQNPDERQTAIRAALAKVIDPELRRPITELGMVKNVTVDPGDGSVHVEVYLTTAACPKRSEITEQVQRAVADVPGTGAVRVSLDVMNDEQRAELRKQLRGDSREPVIPFAQPGSLTRVYAVASGKGGVGKSSVTVNLAAAMAARGLSVGVLDADIYGHSVPRMMGTTDRPTQVDSMILPPIAHEVKVISIAMFTQGNTPVVWRGPMLHRALQQFLADVFWGDLDVLLLDLPPGTGDVAISVAQLIPGAEILVVTTPQLAAAEVAERAGAIALQTRQRIVGVVENMSGLLMPDGSTMQLFGEGGGRQVAERLTRAVGADVPLLGQVPLDPALVAAGDSGVPLVLSAPDSPAGKELRGIADALSARKRGLAGMSLGLDPAGR

SEQ ID NO: 72660 - protein, 341 aa, Synechococcus sp. RS9916
MTLRVAINGFGRIGRNVMRGWISRGADTGIEIVGVNATSDPKTSAHLLTYDSILGKLDPSVKIETTDDSMIVNGKQVKFFSDRNPLNCPWKDWGVDLVLESTGVFNTDEKASMHIQAGAKKVILTAPGKGPKVGTFVVGVNEDQYRHEDWDILSNASCTTNCLAPLVKVIDQSIGINRGLMTTIHSYTGDQRILDNNHRDLRRARAAAVNMVPTSTGAAQAVALVYPAVKGKFTGIAMRVPTPNVSAVDLVFESSRASSVDEIKSIIKGAADGAMSKIIKYGDLPLVSSDYAGTNQSTIFDADLTLSMGDNFFKIVAWYDNEWGYSQRVVDLAEVVARNWK

SEQ ID NO: 72661 - protein, 229 aa, Physcomitrella patens subsp. patens
MSFNLFGKKKTPAELLRENKRALDKSIREIERERQNLQNQEKKLIVEIKKTAKQGQMGAVKVMAKDLIRTRHQITKFYGLKSQLQGISLRIQTLKSTQAMAEAMKGVTKAMGQMNRQMNLPALQKIMMEFERQNEKMEMTTEVMGDAIDDALEGDEEEEETEELVSQVLDEIGIDLDSQLMTAPAHATEPQVQATPSKVAQPQGAGGSASDDGGIDSDLQARLDNLRKM

SEQ ID NO: 72662 - protein, 237 aa, Brassica napus
  misc_feature (204)..(204): Xaa can be any naturally occurring amino acid
MANNGPSWDGLLKWSLSHSDGASPSRPLSEEDRQWFMEAMQGHTIDSISRMKQISQIMKMPEQLLESQGVTTDDLEGMLDELQEHVESIDLANDLHSIGGLVPLLSYLKNSNAKIRAKAADVLTTVVQNNPRSQQLVMEANGFEPLLTNFITDPDIRVRTKALGAISSLIRHNQQGITAFRLANGYAGLRDALVSDTVRFQRKXLNLIHYLLQKATQTVKSLRDLGFLRVMIHLASN

SEQ ID NO: 72663 - protein, 180 aa, Frankia sp. EAN1pec
MDLEFDVTIEIPKGQRNKYEMDHHTGRIRLDRMLFTSTHYPSDYGFIEGTLGRDGDPLDALVLLEEPTFPGCLVRCRTIGMFRMTDEKGPDDKVLCVPVADVRQEHLRDIRHLPEFDRLEIQHFFEVYKDLEPGKSVEGASWVDRGAAEREILDSITRLKDSEGVEHGADEDGAAHARTA

SEQ ID NO: 72664 - protein, 224 aa, Solanum chmielewskii
FLMQKELDYLVGAVSNPQKPFAAIVGGSKVSSKIGVIESLLEKVDVLLLGGGMIFTFYKAQGYAVGSSLVEEDKLELATSLMEKAKTKGVSLLLPTNVVIADKFAADANSKIVPASEIPDGWMGLDIGPDAIKSFGSALDTTKTIIWNGPMGVFEFDKFAAGTEAIAKKLAELSGKGVTTIIGGGDSVAAVEKVGLAEKMSHISTGGGASLELLEGKQLPGVLA

SEQ ID NO: 72665 - protein, 427 aa, Oceanobacillus iheyensis HTE831
MAFNFKLPDIGEGIHEGEIVKWFVKEGDEVKEDDVLCEVQNDKSVVEIPSQVDGKVTKIHVAEGDVAVVGDTLISFEAEGYDDEEGDSADDSSSDSKEEKSTDSKEEEKEASKEESSEQSDDTRVIAMPSVRKFARDNDVNIKDVNGTGKNGRILKEDVESYLSGDQPSSEVAEDKAEASSEDKQETKAAPQGQYPETREKMTAIRKSIAKSMVNSKSKAPHVTLMDEIDVTELVAHRKKFKAVAAEQDIKLTYLPYVVKALVSASKKFPILNSYIDENTDEIVEKHYYNIGIAADTDRGLLVPVVKDSDKKSIFQISQEINELAGKARDGKLKPDEMKGASNTISNIGSAGGQWFTPVLNYPEAVILGIGRIADKPVVRDGEIVVAPVLSVSLSFDHRIVDGATAQLALNQIKRLLNDPQLIMMEA

SEQ ID NO: 72666 - protein, 353 aa, Cochliobolus heterostrophus
MGCGMSTEEKEGKQRNEEIENQLKRDKLMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGPDYAAACDYILNRFVSLNQHETKQIYTHFTCATDTMQIRFVMAAVNDIIIQENLRLCGLI

SEQ ID NO: 72667 - protein, 419 aa, uncultured bacterium
SFLLAFTPFVPTATASASEKNYQPNINLEPIQNSEGNEYPIILVHGLGGFGRDELGGIIKMWGGIHDIEKKLREKGYKVYTAAVGPVSSNRDRAIELYYQIKGGTVDYGEAHAKKTGHSRYGRTYPGFYPEWGEINPKTGKPNKVHLIGHSMGGQTIRTLAQLLYEGDPEEQKISGNDISPLLSGEKQPWLHSVLSISSPHDGSTATYLVNDVIPIIQELVIGAAIFAGNIDQNLYDFKLDHWGIKKQPGESFHSYVQRVRNSPGWKTKDTANWDLKPEGAYELNRWVKAQPDVYYFSVSNTQSRRSLLTGHYVPDLFMNPFLHPTSYYIGSKTFRKSNFVLDKTWWENDGLVSVKAMKGPNIGSNDVIVEYDGTPRKGVWNHLGTMRQFDHLDIIGWGVRDVTGWYEDVARFLYSLPE

SEQ ID NO: 72668 - protein, 280 aa, Magnaporthe grisea 70-15
MFSTRPPPPSLDSASPETQPLRSSLRLATSRPNDYAPPGSGTQQPLQACSYEPSLDLGAITLSNFILPSLKSRPIPSVMSPLNVMLRIDWANRHRDQNVHQRRNHDLTNATTTDAGDESLQRYKQSLGLGQGKDLSDPNDPRVCIIYSLTMESPGRDPVKIDLRTPGSEKTLKDHPFKIKEGAKFTMVADFKVQHEILSGLHYVQVVKRKGIKVSKDSEMIGSYAPNTDKQPIYTKKFQEEEAPTGMLARGHYNAISSFVDDDKKKHLEFEWSFDIAKDW

SEQ ID NO: 72669 - protein, 603 aa, Xylella fastidiosa Temecula1
MSLFPRCFLLLCVFFSHVSAEQTEVALLREGVARVPPGAVIASSHYLATDAGLQILKQGGNAFDAAVAVSSTLSVVEPISSGLGGGGFFLLHDAKTGRDVMLDAREYAPASVNLGTFLNKDGQLDHDRSINGPWSAGIPGLPAALVELAEHYGKLPLRQTLAPAIRIASAGFPVYRRMVEGYQSRREVMERYPGTREVYLRGGKPMDEGDIFKQPELARTLSLLANKGFDGFYRGETAKRLLAGVNQAGGRWTAEDLAGYRVKSRVPITFDYRGWKITTAPPPSSGGIALAEMLQILEGWDLARLDDVHRVHLVVEAMRRAYRDRTFFLGDPDFVSIPQRVLTSQDYARGLRAGINPEKATPSVLLSGHPTPLEDEETTHFSIIDAEGNRVGATQTVNLLYGSGLIPKGTGVLLNNEMDDFALQPGVPNVFGVMGYEANAPKPGKRMLSSMTPTFLESADKVAVIGTPGGSRIITMVLLGILGYDAGLDAQQVAALPRYHHQWLPDVIETEAATFPAEVIKGLETMGHTIKQPSDTVAGGRGSSHVWGNVQTVEWDRRSNVLIGGHDPRHVVGKAAVWLTDKAVVLPPMDHLPTPCLQDCHAQ

SEQ ID NO: 72670 - protein, 337 aa, Burkholderia sp. 383
MSIARRTTLSKFLIEQQRETNNLPADLRLLIEVVARACKAISYNVSKGALGEALGTAGSENVQGEVQKKLDILSNEILLDANEWGGNLAAMASEEMETFFPIPANYPRGEYLLVFDPLDGSSNIDVNVSIGTIFSVLRCPDGKQATEESFLQPGTQQVAAGYAVYGPQTVFVLTTGNGVNCFTLDREVGSWVLTQSNMQIPADTREYAINASNARHWYDPVKRYVDELNAGKDGPRGDNFNMRWIASMVSDVHRILNRGGVFMYPADKRTPDRPGKLRLMYEANPMSFIVEQAGGAATTGTQRIMEVQPTGLHQRVPVFLGSKNEVDRVTGYHQEKQ

SEQ ID NO: 72671 - protein, 509 aa, Nostoc sp. PCC 7120
MVSLLENPLRVGLQQQGMPEPQIIVIFGASGDLTWRKLVPALYKLRRERRIPPETTIVGVARREWSHEYFREQMQKGMEEAHSSVELGELWQDFSQGLFYCPGDIDNPESYQKLKNLLSELDEKRGTRGNRMFYLSVAPNFFPEAIKQLGGAGMLDDPYKHRLVIEKPFGRDLASAQSLNAVVQKYCKEHQVYRIDHYLGKETVQNLLVFRFANAIFEPLWNRQFVDHVQITVAETVGVEDRAGYYEKAGALRDMLQNHLMQLYCLTAMEAPNSMDADSIRTEKVKVLQATRLADVHNLSRSAIRGQYSAGWMKGQQVPGYRTEPGVDPNSSTPTYVGMKFLVDNWRWQGVPFYLRTGKRMPKKVSEISIHFRDVPSRMFQSAAQQRNANILAMRIQPNEGISLRFDVKMPGAEFRTRSVDMDFSYGSFGIEATSDAYDRLFLDCMMGDQTLFTRADEVEAAWQVVTPALSVWDSPADPATIPQYEAGTWEPAEAEFLINQDGRRWRRL

SEQ ID NO: 72672 - protein, 349 aa, Nostoc sp. PCC 7120
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 72673 - protein, 329 aa, Debaryomyces hansenii CBS767
MAPSQVEDISKTELETPEHCPGPESEQAGKEDACNGCPNQSICSSQLPQGPDPDLPLINKRLSQIDHKILVLSGKGGVGKSTFTSMLSWALAADEDIEVGAMDLDICGPSLPRMLGAEGESIHQSNSGWSPVYVADNLGLMSISFMLPDADSAVIWRGAKKNGLIKQFLKDVNWGEHLDYLVVDTPPGTSDEHLSVTTYMKEVGIDGALIVTTPQEVALLDVRKEIDFCRKANIKILGLVENMSGFVCPNCKGESQIFRPTTGGGKKLCEDLKLPYLGAVPLDPRIGKACDAGESFFDSYADSPASSAILDVVDALRDQIEISLEKLNI

SEQ ID NO: 72674 - protein, 543 aa, Oryza sativa
  misc_feature (99)..(99): Xaa can be any naturally occurring amino acid
SPISSSSSLHSLPVPLLPPPISSSSSSGSAPSPLLPTSQTVGPRRPGGAEAASRGGLAAANLGGEAAGCPLLFILILSLLELGVSATVHLLFGLYVFSXTAVAADISQAAAASGCLLLRRPAAPGLVNVAAAGEEEERRGAAPVVLDGSPPPIVLVHGIFGFGKGRLGGLSYFAGAEKKDDRVLVPDLGSLTSIHDRARELFYYLKGGQVDYGEEHSKVFGHTRFGRTYDTGHYPVWDEQNPVHFVGHSAGVQVVRVLHQMLADKAFPGHDTSEDWVLSLTSLSGALNGTTRTYYDGMLAEDGRSMKSICLLQLCRIGVIVYDWLDIPWLKNYYNFGFDHFEMSWRKVGLSGLIDLLLGHTGPFASGDWILPDLTIQGSLTLNSTLRTFPNTFYFSYATKRTRKLFGITVPSSVLGIHPMLFLRVFQMCMWRHPQNAPLPYKGYRDEDWEDNDGALNTISMTHPRIPTEHPNRLVVDDSDCHPLQPGIWYYKIIEADHILFIVNRERAGVQFDLLYDGIFQRCRKHAFRRSPPTVPNESSQSQ

SEQ ID NO: 72675 - protein, 282 aa, Picea sitchensis
MTKEEGKELEQQGFAPKDYTDPPPAALIDANEFKLWSLYRALIAEFIATLLFLYITIATVIGHSRTSADCGSVGVLGIAWSFGGMIFVLVYCTAGISGGHINPAVTFGLFLARKVSLPRAILYMIAQCLGAICGAGLVEAFQKSFYDRYGGGANFVHPGYTKGVGLAAEIIGTFVLVYTVFSATDPKRSARDSHVPVLAPLPIGFAVFMVHLATIPITGTGINPARSFGAAVIYGHKQSWDDHWIFWVGPFVGAALAAAYHQYILRAAAVKALGSYRSNVDV

SEQ ID NO: 72676 - protein, 225 aa, Shewanella sp. ANA-3
MRPFLIAPSILSADFARLGDDVKAVLDAGADVVHFDVMDNHYVPNLTIGPMVCKALRDYGITADIDVHLMVKPVDRIVPDFAKAGASIITFHPEASEHIDRTLQLIKESGCKAGLVFNPATPLHYLDHVMDKLDVILLMSVNPGFGGQSFIPSTLDKLRQVRERIDASGFDIRLEVDGGVKVDNIAEIAAAGADMFVAGSAIFGKPDYKAVVDEMHAELAKVEAK

SEQ ID NO: 72677 - protein, 311 aa, Synechococcus sp. RS9916
MLNQLVKRCRPLPADATLLVLGAGFSGSRIASLARALGTRVITTNRLTDDSDPETALCFDSQLGRLPSPEQLRGVTHLVSTIAPERDGQDPVLRCLGTQLLDMPLQWVGYLSTTGVYGDRQGQWVSEMDPAAPTQERSKRRLGCEQAWLSTGLPVQILRLPGIYGPGRSPFQAIRRGEIRPIDNPGHVFSRVHVEDIAGACLHLIDRAASGLRPTLVNVCDDLPAEPAQVQQHAAELLGLSLPQSRPYADAVDSMSAMARSFWAEHRRVSNRLLCEELGYQLLHPDFRNGIRDCWEQENLNPQGGPAARAA

SEQ ID NO: 72678 - protein, 326 aa, Zea mays
  misc_feature (199)..(199): Xaa can be any naturally occurring amino acid
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREXQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 72679 - protein, 468 aa, Oceanobacillus iheyensis HTE831
MVVGDFPVEVDTLVVGAGPGGYVAAIRAAQLGQKVTIVDKGALGGVCLNVGCIPSKALIEAGHKYENAHGSEDLGIKTDKVEVDFSKVQDWKGSVVNKLTSGVESLLKGNKVDIVKGEAYFVDANTAKIAGESSSQTYKFKDCIIATGSSPIEIPSFKFSDRVLDSTGALSLKEIPKKMVVIGSGYVGTELGTAYANFGTEITFLEGAKDILGGFEKQMTQLVKKGLKKKGATIITEAMAKGVEETKDGVKVSYEVNGKEETIEADYVLVTVGRRPNTDELGLEQMGVKMTDRGHIEIDKQCKTSVDNIYAIGDIVEGPALAHKASYEGKIAAEAISGEKSEIDYVGIPAVAFTEPELATVGLSEQDAKDAGYDVKVGKFPFGANGRALSLNNTEGFLKLITRKDDGLVIGGQIAGPNASDMISEIGLAIEAGMTAEDISLTIHAHPTLGEITMEAAEVALGTPIHTM

SEQ ID NO: 72680 - protein, 285 aa, Brassica napus
MAERGGERGAERGGDRGGFGRGFGGGRGDRGGRGGPRGRGGRRGGRPTEEEKWTPVTKLGRLVQAGKIQKLEQIYLHSLPVKEYQIIDLLVGPTLKDEVMKIMPVQKQTRAGQRTRFKAFVVVGDTNGHVGLGVKCSKEVATAIRGGIILAKLSVIPVRRGYWGNKIGKPHTVPCKVTGKCGSVTVRMVPAPRGAGIVAARVPKKVLQFAGIDDVFTSSRGSTKTLGNFVKATFDCLQKTYGFLTPEFWKETSFKKSPYQEYTDLLAEKGTKKLITEVEDQQASS

SEQ ID NO: 72681 - protein, 786 aa, Frankia sp. EAN1pec
MSPIHTLQAEDPPIDLSGGAVGLVAGVAIVAALALLVAAYLVREVLAANAGTPKMIEVGRAVQEGAAAYLRRQFRTLAGFVIVIPFVLLLLPADDTGARVGRSVFFVVGAVFSALVGFVGMSLATRANTRTAAAAIESGERAAMRIAFRTGGVVGMFTVGLGLLGAAVVVLAFRDTAPQVLEGFGFGAALLAMFMRVGGGIFTKAADVGADLVGKVEQGIPEDDPRNAATIADNVGDNVGDCAGMAADLFESYAVTLVAALILGVKAFGENGLVYPLLIPAVGVLTAIIGIFAVSPRDGDRTGMTAINRGFFISAVVSAIGVVIVSMVYLPGSFAEFPGLEGSTQSGDPRVIAISAVLIGIVLAAAIQLLTGYFTETNRRPVLGVAEASTTGPATNILAGIGVGLESAVYSALLIGAAVFGAYLLGSGSVTIALFAVALAGTGLLTTVGVIVSMDTFGPVSDNAQGIAEMSAGPEGIDERAGAILTSLDAVGNTTKAITKGIAIATAVLAATALFGSFTDTVTTALADAGASTEAARGTVGGLNIAYPDALVGLIIGAAVVFLFSGLAINAVGRAAGRVVMEVRNQFRTKPGIMEGTEKPDYGAVVDICTRDSLRELVTPGTLAVMAPIAVGFGLGYPPLGAFLGGAIAAGVLMAVFLANSGGAWDNAKKLVEDGNYGGKGSDVHAATVIGDTVGDPFKDTAGPSINPLLKVMNLVSLLIAPLVVKFSVGEDENTAARIGIALAAVVVIVAVVATSRRRGSSVGDGPPTPSAPPTRTPPSGSEVKV

SEQ ID NO: 72682 - protein, 404 aa, Mycobacterium sp. MCS
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSMNLIYDEDPDYIVVFGADHVYRMDPEQMVQFHIESGAGATVAGIRVPRAEATAFGVIDADESGRIRSFVEKPADPPGTPDNPDEAFVSMGNYIFTTKVLIDAIRADADDDDSDHDMGGDIIPRLVSDGMAAVYDFSNNEVPGATERDHGYWRDVGTLDAFYDAHMDLVSVHPIFNLYNKRWPIRGESENLAPAKFVNGGSAQESVVGAGSIISAASVRNSVLSSNVYIDDGAIVEGSVIMPGTRIGRGAVVRHAILDKNVVVGPGEMVGVDLEKDRERFSVSAGGVVAVGKGIWI

SEQ ID NO: 72683 - protein, 313 aa, Thiomicrospira crunogena XCL-2
MSVEHPIVTVTGSSGAGTSFVKRAVEKIFDRENLNVAIVEGDSYHKYNRAEMKEKVAASKANGGPVLTHFSEKANEFGELEALFKEYKENGTGKQRYYIHSDEEAAEHNARLGTNFSSGEFTPWEPIPEGTDVLFYEGLHGMVKRMDHGPKEGMHNVAQYVDLGIGVAPSINIEWMQKIYRDTSERPYSVEQVRDVILERMPDYIETIVPQFHRTHINFHRVPLIDTSDPFSTMSPDAPMGPAPEDSLIICHVRHQDIDLEAVKAKIPGAFLQNEETLVCGGEHMVEAMDLMMTPIIQNLIAKKRDAMAKLNG

SEQ ID NO: 72684 - protein, 282 aa, Fulvimarina pelagi HTCC2506
MTTYLEAEANPQRNTGVIRLYGPDGFEGMRCASRITAECLDALADIVKPGVTTQAIDDFVWDFGAERNVAPATLHYRGYTKSVCTSINHVVCHGIPNNKPLKEGDIVNIDVTYVVDGWHGDSSRMYPVGQVKRASERLCEVTYRALLKGIEAVKPGGHIGDIGAAIQEYAQSERCSVVRDFCGHGVGRLFHDAPNILHYGSRGEGPEMKPGMIFTIEPMINIGRPHVKILADGWTAVTRDRTLSAQYEHSLGVTEEGCEVFTFSPKGLDTPGITVPPLVEAA

SEQ ID NO: 72685 - protein, 339 aa, Prochlorococcus marinus str. MIT 9515
MSLSNTSTNNNGRNSVPSERLWLRSELMGTQVITTDTGRRLGVVGEVVVDIDRREVVALGLRDNPLTRFLPGLPKWMPLESIKQVGDVILVDSLDSLSDGFSPERYGKVINCQVITESGQLLGRVLGFSFDIETGDLISLVTGAVGVPILGEGVLSTWEILVDEIVSSGTDRIIVYEGAEEKLKQLSSGLLDKLGVGGSSWDERESNRYSANLVPVENQLLSGSESEEQNNLIEEFKEEDIEEEEYEEELEYVEIETAKEKINNKKQLYLDNDSSEQLGNQIKKENMKEFVVQRQSISNRASKRPIQRSQEPLDIEPVEDKKIVIDNDQSESFEIDDPW

SEQ ID NO: 72686 - protein, 541 aa, Nitrosomonas europaea ATCC 19718
MNTNEFNQWIDKVSGEASAYVPDIESLTQMGNALFNTPPLSRSTEPPALTVPGAEVSHSRPATGSSYPSTIPLPCEAELKALFTPNQYRAPAHISLSDSDHSGHPPWESSFYFLDEGIAPERHDRAAQIPAAHPPFDIHAIRRDFPILQEHVNGHSLVWLDNAATTQKPQAVIDRLTYFYTHENSNIHRAAHELAARATDAYEESRNKVRQFLNAASTDEIIFLRGTTEAINLVAQSWGRQHISAGDEIIITWLEHHANIVPWQMLCNETGARLRVVPVDEDGQVLLEEYQKLLNSHTRLVAFSQVSNALGTITPARQMVEMAHRVGARVLVDGAQSVSHMRVDVQQLDCDWFVFSGHKVFGPTGIGVLYGKTELLNDTQPWQGGGNMIQDVTFEKTAYHGAPARFEAGTGNIADAVGLGAAIDYVERIGLENISRYEHELMTYATGCLKSIAGLRLIGTAPDKAGVLSFTLKDFSTEEVGTALNREGIAVRAGHHCAQPILRRFGVESTVRPSLAFYNTYTDIDRLAAAIDRIRGKKNAF

SEQ ID NO: 72687 - protein, 268 aa, Oceanobacillus iheyensis HTE831
MEIHHRDTVYQDAKKWVYEAGKIIKEQMNNPLNIETKSNANDLVTILDKQTEKFFVEKIKDKYPDHQIIGEEGYGDQPKELDGTIWVIDPIDGTMNFVHQKKFFAISVGILHNGVGEIGLIYDVMNDTLYHVKKGEGAFRDSQQLPLLSRNKQLNEAIVGMNYFWLCENRLVDYQVMQGFIRTVRGARTYGSAALELAYIADGTLDGYLSMRLSPWDVAAGIILLQEVGGIVSNIDGNEWDPLKKSSILASNPALHKTILDIIKKGRK

SEQ ID NO: 72688 - protein, 312 aa, Nitrosomonas europaea ATCC 19718
MTASEKTVLPELSYLRTTISNVVIELRNLRETSLEHRQRLNNPPKLPSRKTLADIIDKLSAALFPNRLGQPDLTGESIDYFVGYTLDTALRDLSAEVIRELHFASGLEAVSHTVRERAVEITHVFAGQLPAIRHILDSDIRAAYEGDPAAHNIDEVLVCYPGITAIIHYRLAHELHKLGVPLIARMISEIAHSLTGIEIHPGARIGDSFFIDHGTGVVIGETAIIGRKVRLYQAVTLGAKHFPVDEQGALIKGNQRHPVVEDDVVIYAGATILGRITIGHGSTIGGNVWLTHDIPPGSHITQAQMRHEKVPG

SEQ ID NO: 72689 - protein, 452 aa, Gluconobacter oxydans 621H
MDDYDRLLERLSNLTCDWVVGSVKDVIGLCLTVIGLEGFITIGDRVAVKALDGRVVQSEVVGFQGDVARLMSFGPLDGIGPGCEARIPLNRHDGGLGVNESWLGRVLDPLGQPIDGKGPLFPSFERQPVQCPPPNAASRARLGERIDLGVRALDTFTTCRRGQRLGLFAGSGVGKSTLLSMLARGADCDVAVISLVGERGREVREFIEDDLGPEGLARSVLVIATSDSPPLMRREAALSAMAIAEYFRNQGKSVLLLMDSVTRFCMALREIGLSAGEPPATRGYPPSVFAELPRLLERAGPGYADQGMITALFTVLVEGDDQNEPVADAVRGILDGHIILDRKIGEQGRYPAIDVLRSLSRAVPGCNSPEENALTQRARAAMATYQRMADMIRLGAYKPGTDREVDEAIALMPKLNEFLSQGRNERTTRAEAFEQLAQIMQMPLKNLPPNES

SEQ ID NO: 72690 - protein, 462 aa, Streptococcus suis 89/1591
MSLFRKKQAVGRHSQMRRHLGLVDLIFLGIGSMVGTGIFTVTGLAAAQYAGPALIISIVIAAISVGLTALFYAEFASRIPTNGGAYGYLYSVFGEFPAWIAGWLTIMEFLTAVSSVASGWGAYLKGLLANFGIAMPTALNGTFNPAAGTYVDLLPVLVLIFVVGVVLLNSKAALRFNSALVVLKFSALALFILVGLFFIKPENWSNFSPFGFGAIYGGQAGIMAGASLMFFAFLGFESISLAIDEVKKPEKNVPKGIVLSLSIVTILYIVVTLVLTGMVHYTKLNVADAVAFALREVGLDWAASYISIVAILTLITVCISMTYALSRMVYSISRDGLLPKSLSRLTQTSKVPKNATILVGIFAAICAGIFPLASIASFLNICTLAYLIMLALGIIRLRQVEGLPKDGQFKTPLVPLLPILSIIICLSFMFQYSLDTWLAFGVSVVIGILIYFCYGYRHSEAK

SEQ ID NO: 72691 - protein, 237 aa, Magnaporthe grisea 70-15
MASSSTPPTPLLYSCIAHNSTILTECTTSASSQTSSLASLVLPKITHTSPQKLTYTHGAHHIHYIAEAPSDHGPHAASAGGLTFLVIADSSVGRSVPFGYLFEIRRRFLEEYPPGSTDFADQPNYGAASFNGELRRLMVEIGSTRQGRDDAVQNAQREIDDVRGIMTRNIEGLLERGERIDLLVDKTDRLGGSAREFRVRSRGLKRQMWWKNVKLMGLLGLVMFLILLTIIIAVKNS

SEQ ID NO: 72692 - protein, 336 aa, Xylella fastidiosa Temecula1
MALKHFLNTQDWTCSELNALLTQARAFKHNKLGNALKGKSIALVFFNPSMRTRSSFELGAFQLGGHAIVLQPGKDAWPIEFDTGTVMEAETEEHICEVARVLGHYVDLIGVRAFPKFLDWTYDRQDIVLNSFAKYSPVPVINMETITHPCQELAHIMALQEHFGTTDLRGKKYVLTWTYHPKPLNTAVANSALTIATRLGMDVTLLCPTPDYVLDERYIDWARQNIADTGSTFQVSHDIDNAYRGADVIYAKSWGALPFFGNWAMEKPIRDQYRHFIVDEAKMALTNNAVFSHCLPLRRNVKATDAVMDGSNCIAIHEAGNRLHVQKAIMAALASQ

SEQ ID NO: 72693 - protein, 465 aa, marine gamma proteobacterium HTCC2143
MSSGQIVQIIGAVIDVEFPRDSVPQVYDALTVTEKALTLEVQQQLGDGVVRTIAMGSSEGVSRGLVVESTGAPISVPVGIETLGRIMDVLGNPIDECGPIGEKERASIHRKAPAYDELSASEDLLETGIKVIDLICPFAKGGKVGLFGGAGVGKTVNMMELINNIALEHSGLSVFAGVGERTREGNDFYYEMQESGVVNIEEPSKSKVAMVYGQMNEPPGNRLRVALTGLTMAEKFRDEGKDVLLFVDNIYRYTLAGTEVSALLGRMPSAVGYQPTLAQEMGELQERITSTKTGSITSIQAVYVPADDLTDPSPATTFAHLDSTVVLSRDIAAKGIYPAVDPLDSTSRQLDPLIIGTEHYDTARGVQSVLQRYKELKDIIAILGMDELSEEDKQTVNRARKIERFLSQPFHVAEVFTGSPGKYVSLKDTIAGFTGILAGEYDHIPEQAFLMCGGIDDVLENAKKL

SEQ ID NO: 72694 - protein, 502 aa, Arabidopsis thaliana
MEAIMNVDFQNCLILILLCLLSFLCYSFFFKKPKDGFNLPPSPPSLPIIGHLHHLLSLFMHRSLQKLSSKYGPLLYLHVFNVPILLVSSPSIAYEIFRTQDVNVSSRDFPTNEGSLLFGSFGFGTAPSSGLKHSRGHKKSVQRSYYLNLLDKAVKKESVEIAEEAMKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLAYISVGTAIGVMVQCFDWEIKGDKINMDEAPGKITLTMAHPLNCTLVPRTLIPVTSTVQIPSS

SEQ ID NO: 72695 - protein, 475 aa, Vibrio vulnificus YJ016
MNSLFRQQCYLLGEWRSAPQTMTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYTEFCEKLVEKVSALNVGNGFDQGVHLGPLINDAAVAKVVQHVEDAQSKGAHIECGQLPTAGSRLVQPLVLSGVTDEMLVAQEETFGPMAPLFVFDSEEEVLARANNTDFGLAAYFYTQSLSRAWRVSEALEAGIVGVNEGLISTTVAPFGGVKESGLGREGSFLGMDDYMESKYILMGL

SEQ ID NO: 72696 - protein, 438 aa, Xylella fastidiosa Temecula1
MHANLQTRQIIIRLLSSMASAKEISQYLKRFSQLDAKRFAVVKVGGAVLRDDVDALTSSLSFLQEVGLTPIVLHGAGPQLDEELTAVGIQKKTVNGFRVTLPETMAIVRKVFHATNLQLIEALQRNGARATSITGGVFEAHYLDQETYGLVGGISAVNIAPIEASLRAASIPVIASLGETPSGQILNINADVAANELVHVLQPYKIIFLTGTGGLLDADGKIINSINLSTEYEQLIQQPWVYGGMKLKIEQIKHLLDRLPLESSVSITRPADLAKELFTHKGSGTLIRRGERVIRATTWKDLDLPRLQHLIQSSFRRTLIPHYFETTPLLRAYVSENYRAAVILTKLGNVPYLDKFAVLDDAQGEGLGRAVWSIMREETPQLFWRSRHNNQANAFYYAESDGYYKQDHWKIFWNGLHHFQQIQQCVAHCTQHPPTLID

SEQ ID NO: 72697 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPHGNGQRACIGQQFALHEATLVLGMMLKHFDFEDHTNYELDIKETLTLKPEGFVVKAKSKKIPL

SEQ ID NO: 72698 - protein, 450 aa, Zea mays
MRRRAEVAVVGAGAAGLVAARELLREGHTVSVFEKSGRVGGTWAYSPRADADPLGSDPGAPGAVHSSLYASLRTNLPRELMGFSGFPLAGRAFAGDPRTFPGHREVLAYLDAFAADSGVAPHVRLRAQVLRVRPLCPGRGQGEKWAVAWRGEDGDVAEEAFDAVVVCNGHCSVPLVPKIRGINKWRGKQMHSHNYRTPEPFQDQLVITPHQFQTGKLSLQSVVVVGLGASGIDIAREISHVAKEVHISARYSEGRLGKIELYHNAWMHSEIECIQDDGQVRFAEGSSVAADTILYCTGYRYHFPFLDLDGFTVDDNRVGPLYKHVFPPKHAPNLCFVGLPYKSIIFQALELESKWVAAVLSGRAELPVEEDMTADVEEEYQRMEDAGKPKRHTHTLWPRWVEYLNWVADQVGEAHLEPRKCEMYEKALKCVWSLDEGYRDRWEEESIGSG

SEQ ID NO: 72699 - protein, 365 aa, Aspergillus oryzae
MSAEVSSHDYQIPSHCKAGVVVNEGPNFEVKVEMVPVPEPGPDDILIRLNITGICSSDLHMMQGDLGTPPMSTFGVRSPGHEGAGVVVKVGANVKNFKLGDRAGIKPLLDTCGTCDLCWGDKETYCPTAIHAGLMAPGTYQQYIVSPARYASPIPDGIPDEIAAPIMCSASTIYRSLTESGLNPGNWAVFPGGGGGVGIQGVQLAKAMGMRPVVVDAGESKRALALEMGAEVFVDFIETSDPAAAVIKATDGVGAHGVFVTAPAAYRTALSYVGNRIGAVVMCIGLGPTGAMTIGGDPNAFIFKNLTVKGTLVGSRKDTAAALDFARRGKLQQICEVYPIDRLPEAVEKLRKGQATGRMAVDFNK

SEQ ID NO: 72700 - protein, 247 aa, Candida membranifaciens
ARARIPITNGPEIFLHLYENNIDNKEHLAIVFGEDIRSRSLFKQRPHESQQDRMTRGAYIGKLFPGRLQADHDAHQNLSLQFDDDGELIYHPTTSYTDATLVRIHSECYTGETAWSARCDCGEQFDEAGRLMGEIGHGCMVYLRQEGRGIGLGEKLKAYNLQDLGADTVQANLLLRHPADGRSFSLATAILKDLNLVEIKLLTNNPDKILAVEGKNQEIKVMERIPMVPLSWRSNQGIKSKEIEGSL

SEQ ID NO: 72701 - protein, 129 aa, Rickettsiella grylli
MSAEGKTKDDILNTISNMSVMEIVDLIKRMEEKFEVSAAAATVAAAPAPGAAAAVAEEKTEFNVELKEVGANKISVIKAVREVTGLGLKEAKDLVESAPKAVIKEGLSKADAEALVAKLKEAGATAEMK

SEQ ID NO: 72702 - protein, 473 aa, Gluconobacter oxydans 621H
MSQKIVPVILSGGSGSRLWPVSRSSYPKQFWPLLSKHTLIQETALRGARAGLADPIVICNAEHRFIVAEQLRDVGVKNARIVLEPVGRNSAPAIAAAAFLVAETDPDAVLWIMAADAAITDEAALYSALEHAVAAAAQGRIVTFGMKPTRVETGYGYIESGAPLSSLEGVYEVSRFVEKPDAVTAEAFFRDGRYLWNSGMFVTQAGVFLSEIQTFEPAIHEHVGQAVRARRSDLDFDRLDDASFRQAPDISVDYAVAERTKRAAVVPGTFGWSDIGSWDALWELTSKDEAGNATFGDVFLDDARNCYVRSDGIVATVAGVEDLIVVVTQDAVMVSHRDRAQDVKHMVSRLKKAGRKEAVAHNRMYRPWGFYESLIQADRFQVKRIVVEPGQKLSLQKHFHRAEHWVVVGGTALVTRDADQIMVRENESIYLPLGCVHRLENPGRIPLTLIEVQSGPYLGEDDIVRIEDVYSRN

SEQ ID NO: 72703 - protein, 236 aa, Triticum aestivum
  misc_feature (211)..(211): Xaa can be any naturally occurring amino acid
  misc_feature (230)..(230): Xaa can be any naturally occurring amino acid
FCLVQKVGQTVIVGKRPLKGHGSVIIQLGVPIIEGPLEDENQRETTRVEPVPGLLHDLFDRFFRQGIVPSKPDYCVVDFYYEEEYSHPQQPPSWYGRPLCTLCLTECDMVFGRVIFGERGDNRGPLKLSLSTGSLVVLQGRSADVAKRAIPATRKQRILLTFGKSVARKVAPSESASRPTAPLTPPSMPWGPPSRPANVRPHSPSPQHFGXYTPTSSVFPAPTTGTHHIXPPSDGM

SEQ ID NO: 72704 - protein, 484 aa, Gluconobacter oxydans 621H
MTPALYRRQWAQNPLREVLAGMVGTFALIPEVVAFSYIAGVSPAVSLFASFVISVSIAIFGGRPGMISGAAGSVALVAAPLVHAHGVQAMLLATLVAGAFQVVFGLLRLQAVMRFVPAEVRTGFVNALAIMIFSAQVPQMLGVTWHTYALIALGLVIIYLLPRLSDAIPSPLICIVILTAITMLHPMPVHTISDLGDLPTGLPSLTFPHIALNWATWSVVLPYALAMAAVGLLESMMTASVVDDITDTHGDQRMECTGLGISNILVGAFGGIAGCGMIGQTVGNLRYGGRGRLSTFTAGAFLLALMVLLHRWVGQVPMAALVAIMIMVSASTFSWSSLRDLTRHPRLSSLTMLVTVAVVVMTHNLAAGVAVGVMLSGVFFAWHAAKLLRVTEERSGETLTYRASGQVFFASADSLSDAIDYHTDAKTVVLDLTHARFWDITSVQVLEKIIGKLQSHGHTVEVTGLHHDQHGIIASQSNESLLAL

SEQ ID NO: 72705 - protein, 253 aa, Nostoc sp. PCC 7120
MLSILRADFRIIFERDPAARNLLEVLFCYPGLQALLFHRVANWLYRLGLPFIPRLISHIARFLTGIEIHPGATIGQGVFIDHGMGVVIGETAIVGDYALIYQGVTLGGTGKESGKRHPTLGENVVVGAGAKVLGNLQIGNNVRIGAGSVVLRDVPANCTVVGIPGRIVYRSGGRVDPLEHNNLPDSEAQAIRALVDRIESLEQQIQALQNNQSAAKIPALVAASSQEAERSHDSQWCNLRDKAIQEFLDGAGI

SEQ ID NO: 72706 - protein, 134 aa, Polaromonas sp. JS666
MGNKLYVGNLPYTVRDEDLQQSFGAFGSITSAKVMMERDTGRSKGFGFVEMGSDAEAQAAIAGMNGQSLGGRSITVNEARPMEARPPRTGGFGGGGGYGGGGDRSGGGGYGGGGGGRSGGGGYGGGSGGGRGGY

SEQ ID NO: 72707 - protein, 365 aa, Oryza sativa
  misc_feature (159)..(159): Xaa can be any naturally occurring amino acid
  misc_feature (195)..(195): Xaa can be any naturally occurring amino acid
MVSDQEIASCVESVLRSSGGPPGSLARRRAVAAEPKLGVDLAHYATFIRDQMDLFFGPRLQPPLVAKAQAAAAAAPNPPPLVAAPAPAMPQVQVQAQLQQMQQQLAVLQPQLIFQAMPQLPAGVPGGAAGAVSPQPPVPAMAFYPPPPLAFRVTSGLAXGVATGGTVSFQQPAPGTGGTASPTAAVQAAGDNKEXTIVGETVMSRTQIVKQLWQYIRQNNLQDPDDKRKIICNDELRVVFGTDTTDMFKMNKLLAKHITPLDPKDQIREAKKFKPSNVATQPMPLINQPSVVISDALAKFIGMEGTVPQDDALRYLWDYIKANQLEDAITGSILCDSKLQELFGCESIPSSGLSELLAHHFIKET

SEQ ID NO: 72708 - protein, 731 aa, Oryza sativa Indica Group
MAAAAAAAAPRHHHHHVVVGSSRSAPVSVSVCVRRWCRGRVVVGVAAGGDDRGRLRVVGGGEGEEDGGGGGILGFFCAGVVLNQFGLIRNLTDVKLLSEWGILFLLFEMGLELSLSRLKALARYAFGMGLPQVLLSTLAFTAFELPPNGAIGTKILQFLFDSRPDLVNIRSVDEAIVIGAALSLSSSAFVLQLLAEKGELPTRFGSATLGILLLQDIAVVPLLVILPVLESQNVVEQSVWPMLLAESLKALGGLGLLSLGGKYLIRRIFEFVAESRSSEAFVALCLLTVSGTSLLTQWLGFSDTLGAFLAGAILAETNFRTQIEADIRPFRGTSIDMELLIREWPNVLSLLGGLIAIKTLIITAIGPRVGLTLQESVRIGLLLSQGGEFGFVVFSLANRLGVLPLELNKLLIIVVVLSMALTPLLNEIGRRAAGIIDEKSETKEKPAEMVNYDATEPIVILGFGEMGKVLAKFLSAPLSFGLDKDAEGWPYVAFDLNPAVVKSARKSGFPVLYGDGSRPLVLQSAGVSSPKAVMVMYTGKEKTIEAVNRLRQAFPGVPMYARAQDMSHLLDLKKAGATEVVLENAETSLQLGSMLLRGLGVMSDDVSFFSKLVRDSMELQAQEALNNIENREIDIMKPLEIRISDLVERNGNGSRMIAQEDSLRLSSRPNIPLIEATLEDRIPETTGENDQTGYDFNNIDSEDGVKYCLLEASDDESEASNSSKEMIDQSV

SEQ ID NO: 72709 - protein, 383 aa, Synechococcus sp. RS9916
MQDKLTLMIPGPTPVPETVLKAMGRHPIGHRSGEFQDVVKRTTEQLRWLHQTSSDVLVITGSGTAAMEAGIINTLSRGDKVLCGDNGKFGERWVKVAKAYGLEVEVIKAEWGQPLDPEAFRAALEADTAKSIRAVILTHSETSTGVINDLESISRHVKAHGTALTIADCVTSLGATNVPMDGWGLDVVASGSQKGYMMPPGLSFVAMSSRAWEAYERSDLPKFYLDLGPYRKTAAKNSNPFTPAVNLYFALEAALEMMQAEGLEAIFSRHARHRAAAQAGMKAMGLPLYAAEGYGSPAITAVAPEGIDAEQLRKAVKDRFDILLAGGQDHLKGQVFRIGHLGFVCDRDVLTAVAAIESTLQSLGLHKTSMGAGVAATAAALAS

SEQ ID NO: 72710 - protein, 528 aa, Synechococcus sp. RS9916
MSQTQPDGQRKPAIVILDFGSQYSELIARRVRETEVFSLVLGYSTSAAELREMAPAGIILSGGPSSVYSEGAPLCDPEIWNLGIPVLGVCYGMQLMVQQLGGVVEAATGKAEYGKAPLEVDDPTDLLTNVDSGSTMWMSHGDSVKALPEGFVRLAHTANTPEAAVADHNRRLYGVQFHPEVVHSTCGMALIRNFVYHVCGCEPDWTTDAFIEEAVALVRDQVGDKRVLLALSGGVDSSTLAFLLKKAIGDQLTCMFIDQGFMRKGEPEFLMDFFDRKFNIHVEYINARQRFLAKLNGITDPEEKRKIIGTEFIRVFEEESKRLGPFDYLAQGTLYPDVIESAGTNVDPKTGERVAVKIKSHHNVGGLPKDLQFKLVEPLRKLFKDEVRKVGRNLGLPEEIVRRHPFPGPGLAIRILGEVTDEKLDCLRDADLIVREEIKEAGLYHDIWQAFAVLLPVRSVGVMGDKRTYAWPIVLRCVSSEDGMTADWSRLPADLLETISNRIVNEVKGVNRVVLDITSKPPGTIEWE

SEQ ID NO: 72711 - protein, 128 aa, Glycine max
MLKFLSRVKIEFNALDPRTASCMEFLAQCNSRKAKESNPACEVEVKRVREERAPQITVTFVNGVEEVFDATATPAQSIRNLILEKGQHLETEQMFREAGEPWPVVIPDEELSQIAPPTKPRKAEDKKQ

SEQ ID NO: 72712 - protein, 301 aa, Shewanella sp. ANA-3
MKHLLSIKELTQQQLLDLITLAKTIKANPAEYRHALDGKSVVMLFEKPSLRTRVSFDIGINKLGGHCLYLDQQNGALGKRESVADFASNLSCWADAIVARTFSHKTIEQLAEFGTVPVINALSDLYHPCQALADFLTLAEHFENISDVKLAYVGDGNNVTNSLMYCAAILGATMTVICPAGHFPDGYVVAEVQELASRYGGKVVLTSDIGAIEGHDAIYTDTWISMGDPTPLAEIKDKFAPYQVNKGLMAKAGAHFFMHCLPAHRGVEVTDEVMDGEGSLILQQAENRMHAQNAVLITLFS

SEQ ID NO: 72713 - protein, 221 aa, Glycine max
MGQKSLIYAFVSRGTVILAEYTEFSGNFNSIAFQCLQKLPATNNKFTYNCDAHTFNYLVDNGYTYCVVADESIGRQLPMAFLERVKDEFVAKYGGGKAATAPVNSLNKEFGPKLREHMQYCVDHPEEISKLAKVKAQVSEVKGVMMENIEKVLDRGDKIELLVDKTENLHNQAQDFRTSGTRIRRKMWLQNMKIKLIVLGILIALILIIVLSVCRGFNCGK

SEQ ID NO: 72714 - protein, 260 aa, Shewanella sp. ANA-3
MSTNNSVLVLKVGGALLQCEMGMARLMDTAAAMIANGQQVLMVHGGGCLVDEQLAANGMETVKLEGLRVTPPEQMPIIAGALAGTSNKILQGAATKAGIVSIGMSLADGNTVSAKIKDERLGLVGEVSPKDATYLKFILSQGWMPICSSIAMMDDGQMLNVNADQAATVLAKLVGGKLVLLSDVSGVLDGKGQLIPSLNGKQIADLVKQGVIEKGMKVKVEAALEVAQWMGQAVQVASWRDASQLVALAKGEAVGTQIQP

SEQ ID NO: 72715 - protein, 308 aa, Anabaena variabilis ATCC 29413
MRKFIIDTDTASDDAVALIMAHHWPDVEIVAVTIVNGNVPVEQGVKNALYTIEVCSASTPVYVGCAKPMLRESRYADWFHGKDGMGNMYYPEAKSKPELAHATDAIIEIIKQYPGEITLVTLGPLTNIATALLKAPDIAQLVQRCVIMGGAANTVGNVTPAAEYNIWVDPEAAKIVFHSGMPMEMVGWELSRHDAALTFAEVETVMNFGTDRARLAMECNKTALDVAMKRQGAVGLTLADPVAIAVALDPDIVTRQGKYFVDVEITSELTRGATVVDELGVLNKKPNMNVIWAINVMRWKEILYFCLH

SEQ ID NO: 72716 - protein, 592 aa, Oryza sativa Indica Group
  misc_feature (270)..(270): Xaa can be any naturally occurring amino acid
MALLQFGGTLAPKLGEKPQVLPRSPALTRVIYADPRFLVSKSGSRGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGEIDIVQNIGRQAAAAVAGGVGEKARWWWLCRRRGVAATGWAVVHGRISGWLMAVATLFAGDGPGGGGLHEGRRMMILDNFETSGRRAGESGKSPIFKQIKLLFXTGFDEAELRSYTSVIHATSIRQLKYAILERILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 72717 - protein, 184 aa, Triticum aestivum
  misc_feature (166)..(166): Xaa can be any naturally occurring amino acid
TVDYAVVERPAMEKWMEGGLDFIILKDLSIDGIRTIGSVLGQSIALDYYIRQVDGMVAEFTDINRGMEKTGTFTMERKKLFQLVGKANSNLADVILKLGLFERSDIAWKNANYAQIWEFLRDEYELTQRFGNLDFKLKFVEHNIRFLQEILQNRKSDFLEWLIIIXLISVEILISVYNIVQEQM

SEQ ID NO: 72718 - protein, 291 aa, Mycobacterium sp. MCS
MDESAATPEVVVVTGASSGIGEETALRYAGRGARLVLAARTEDALQRVADACRAAGAEAVLVQATDIADAAEVEELFGVAEGHFGRIDIVVQSAAITAFGRFEDVPAGVFDSIVRTNLIGSANVARSALAHFHKRGRGHLVLIGSLLGTAAAPYQSAYVASKFALNGLVRTLRQENRHLSGIKIHGVYPGPVDTPVYGTASNYFGRAPRVPPTAVKPSSVVSAIVRATDRGRSSERQVGVFNRPVIAMYRLAPPVYDVLMGVFLRTFGFTSESTEPTHGNAFARDRHPKAD

SEQ ID NO: 72719 - protein, 425 aa, Prochlorococcus marinus str. MIT 9515
METIKNFPQIVKKNFNLVDKKDFPLLENNFKSKNKIIYLDHAATTQKPSQVLEKIEEYYKKFNANVHRGAHQLSAKATEEFENSRSLVAKYINANSTQEIIFTRNATEAINLVARSWGEFTLKENDEIILSVMEHHSNIVPWQMVAAKNQCKLKFVGIDQDGKLDINDFKSKLTNKTKLVSLLHISNTLGCCNPIKEITKLAKVKGSLVLLDACQSLAHQKLDIDELGIDFLAGSGHKLCGPTGIGFLWAKKEILEEIPPFFGGGEMIQDVFEDTSTWAELPHKFEAGTPAIAEAIGLAEAIKYINNIGLDRISEYEKQITKYLFEQLSQIKDLVIIGPPPKIDPNRASLATFYIKGIHSNDIAEILDSKGICIRSGHHCCQPLHRHIGVNSTARVSMNFTTTKDDINAFIEKLKETISFLRLNS

SEQ ID NO: 72720 - protein, 957 aa, Gluconobacter oxydans 621H
MADTISNTGLNEVGSVLRDLEKYGQSPWLDFIQRSFTEDGSLSKLVEEDGLRGVTSNPAIFEKAIGHGTEYDPQIRKLLEGEGLSPGELYEHLAIDDIRSACAVLDPVFEKTKGLDGYVSLEVSPYLAFDAHGTITEARRLWKAVGRPNLMIKIPGTVEGTGAIREAIADGINVNVTLLFSLDAYKAVLEAYISGLEARVARGEEISRISSVASFFVSRIDAKIDAEIDRRVAAGDPEAEALKAIRGKVAIANAKMAYQYYLEVRNSPRWKALAEKGANPQRLLWASTGTKDKAYSDVLYVEELIGPETVNTIPPATFDAYRDHGKSRASLTENVDQARHVMAEAERLGLGLDGITAKLVKDGCAAFSVSFDTLLTAVATKREAVLGDRLLRVSADLPPDLRDDVAAAEKDWSHSGGLRRIWKKDPSVWTNGPEAGWLNWLTVVQDRLWHIEELEVLARDVRSRGFKDILLLGMGGSSLGPEVLAETFGKREGWPKLHVLDSTDPQQVTAFEKAIDPKNTLFIVASKSGGTLEPNILFAHFWQVAGQALGKKPGDSFIAITDPGSHMQKVAEENGFWRIFYGDPKIGGRYSVLSNFGLVPAAASGIDVRKLLTVTRLMVESCDGSAPPSANPGAVLGLILGHAAHCFNRDKVTILASEGIASLGAWLEQLIAESTGKKGLGLIPIDEEELGTPDVYGTDRVFVDLLLGDDVPDSRLGALRAAGAPVVTIRLADKAQIGQAFFLFEFATAVAGAVLGIDPFDQPDVEFSKLETRKLTSAYAETGSLPPETPFAKDGPLSFYADAKNTEASGNKGDAVSILKALFDRVKPGDYVGLLAYIRRDQQTRDWAQSVRMELRDALKVATAAEFGPRFLHSTGQAYKGGPDSGVFLQVTATDAADVPVPGHGFSFSVVKAAQARGDFEVLAARGRRALRVHIDGPLEDGLKALETAIHKALAGA

SEQ ID NO: 72721 - protein, 434 aa, Bacillus subtilis
MVGLYASFCIAIIISIFGGRPGMISAATGSMAVVMVSLVADHGLQYLFAATILTGIIQVILGISKIARLMKFIPRSVMIGFVNALAILIFSAQLPQFEGASWSMYAMLAGSLVIIYVLPRFTTAVPSPLVAIIVMTIIAVTFHVDVRTVGDMGNISSSLPHFLIPDVPFTFETLQIIFPYSIALAFVGLLESLLTAQIIDEMTDTDSDKNKESRGQGIANIVTGFFGGMAGCAMIGQSVINTKAGGRGRLSAFVAGAFLMFLIAVLSHVVVKIPMAALVAVMVMVSVGTFDWSSLKGLKKAPLTDSIVMVVTVVTVVVTDDLSKGVFVGVLLSAVFFVAKISKLKIVSHAEDQKLRTYQVKGQIFFASVTDLTNAFIYQEDIERVVIDLTEAHVWDDSGAAALDKIVAKFKEQGIEAELKGLNKASKSLMKQMA

SEQ ID NO: 72722 - protein, 318 aa, Neisseria meningitidis Z2491
MMGFLIGLSRNLTRFTALVILLASAVAFIGPTSFAWVKGDVQVLVLGIIMLGMGMTLGREDYRILAQRPLDVFIGAAVQYTVMPLLAIGIAKLFDLSLGLTLGLVLVGTCPGGVSSNIMSFLAKGDVAFSVGMTTVSTVLAPAVTPLWMTCLVGQTVDMDGWGMFRFMLLVTLLPVVLGSAANILLHGKHWFENVRAVMPGVAVLAFACIVGGVASVHGHRFAESALVMVLAIAVHNIAGYVSGYYAAALFGMDTAKKRTLAIEVGVQNAGLATGLSAKFFPGNAESAVAAAVACVWHSVSGTVLGNLFALWDKRRDA

SEQ ID NO: 72723 - protein, 256 aa, Triticum aestivum
  misc_feature (208)..(208): Xaa can be any naturally occurring amino acid
  misc_feature (214)..(214): Xaa can be any naturally occurring amino acid
  misc_feature (247)..(247): Xaa can be any naturally occurring amino acid
MSDNSIQRALLSDNPDANVLQRKPSQGAKRFRRCRSAPRSETDEKPQENGSSLPAKELFSVVRPSFRLVGFLLFLYLLAGVVVFYLVMDQLSGKRTNRVLDALYFCIVTMTSVGYGDLVPNTDTTKLLACVFVFTGMAIIALFVSKSADYLVEKQEVLFFKALHMNMKCGEAKMLRQIETNKTEYKFYTAALLLVTGIVVGTVFLWKXVEKLSXLVDSFLFVSGAKSLTLGLWGIKASRSQWGRTFXVFWDNYEPP

SEQ ID NO: 72724 - protein, 140 aa, Triticum aestivum
  misc_feature (98)..(98): Xaa can be any naturally occurring amino acid
  misc_feature (111)..(111): Xaa can be any naturally occurring amino acid
  misc_feature (124)..(124): Xaa can be any naturally occurring amino acid
MPPNRKRRAAAMDPAAGGAGQQRQNKASAGKKVKKGGGSGGRWPAVKPKKDLQINRLKGTHLLTIPDFFTSAEAKAFIDIAESMGFTHQGSLGPLKGXAYRDNERISVTDXLLAQAIWESGITXFTDINVSGKVQQDESI

SEQ ID NO: 72725 - protein, 214 aa, Burkholderia mallei ATCC 23344
MNDGRISPTMSASVRTRVNVPIRPRTAQQRFDAEMVTFQGLCDSAEHLALVFGPLADAPLVRVHSECLTGDVFGSARCDCGEQLDESVAMFGREGGILLYLRQEGRGIGLYNKLDAYRLQISQGLDTFAANRALNFPDDLRDFRVAAQMLQALGVTEISLVTNNPDKVSQIEKHGIRIRRVLQTGVFVNTTNHGYLRAKIDHHRHAINLSQELQ

SEQ ID NO: 72726 - protein, 319 aa, Rickettsiella grylli
MSEMMLFTGNANRPLAEKVANHLDKELGQATVSHFSDGEIMVEILVNVRGQDVFIIQPTCPPVNSNLMELIIMADALRRASAKRITAVVPYFGYGRQDRRIRSSRVPITARVVADMMTAVGISRLLTVDLHADQIQGFFDIPVDNVYATPEILKDMEGQKIFKGHEQLIIVSPDVGGVVRARAIAKRFNDADIAIIDKRRTGPNRTEVMHIIGEVNDRNCLLVDDIVDTGGTLCLAAQALKENGANLITAYCTHPVLSGNAIADIRHSYINELVVTDTIPLSDDALHCEKIRQLSLSDMLAKTICRINSEESVSSMFVD

SEQ ID NO: 72727 - protein, 365 aa, Vibrio vulnificus YJ016
MRNKMKHAHETRSFLLGLLTVATFLFKGNDLLSHDLMSPLGILSVLILFAVTMVMIFAVVRHADALAHKLGEPYGTLILTLSVVLLEVAMISSVMLTGSENPVMARDTMFAVVMGVMNGLVGITLLIGGLRYHSQAYNVQGLKAYIAAIIPVVTICLILPNFTSQDSFGGMSTVMIFTLIVTSLLLYGVFLFIQTKSHTDYFINDVSETEHEHHETRSIGYHALFLVANLALVIGLAKSIAIPIDQSISTLGAPSALGGLIVAMIILSPEGVGAIKAALNNQLQRAMNLFYGSVLATISLTVPAVLLIAVFLGETVILGLGPADMVLLVATILVSMMTFSSGRTHPLNGATHLVLFIAYVVLMFD

SEQ ID NO: 72728 - protein, 472 aa, Xylella fastidiosa Temecula1
MSCCIANAIRWDVSLLIHRSMSSSMSSVQPTSPVSDSPSLGEMHASVAVSRRGHWGFRLLAFLGPGYMVSVGYMDPGNWATGLAGGSRFGYMLLSVILLSNVMAIVLQALAARLGIASDMDLAQACRARYSRGTNLALWAVCELAIIACDLAEVIGTAIALNLLLGVPIILGAVITAVDVVLVLLLMHRGFRALEAFVIALLLVIFGCFVVQIVLAAPPLQEVLGGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTVTATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSD

SEQ ID NO: 72729 - protein, 780 aa, Oryza sativa Japonica Group
MAAAAAAAAPRHHHHHVVVGSSRSAPVSVSVCVRRWCGGASSSALLRVGMIGGASASSAEGRGRRRWWRRGRRALRVRAAAGMDIASAVEVINDLGFDTLTFLGVTVLVVPAFRVVKASPILGFFCAGVVLNQFGLIRNLTDVKLLSEWGILFLLFEMGLELSLSRLKALARYAFGMGLPQVLLSTLAFTAFELPPNGAIGTKILQFLFDSRPDLVNIRSVDEAIVIGAALSLSSSAFVLQLLAEKGELPTRFGSATLGILLLQDIAVVPLLVILPVLESQNVVEQSVWPMLLAESLKALGGLGLLSLGGKYLIRRIFEFVAESRSSEAFVALCLLTVSGTSLLTQWLGFSDTLGAFLAGAILAETNFRTQIEADIRPFRGTSIDMELLIREWPNVLSLLGGLIAIKTLIITAIGPRVGLTLQESVRIGLLLSQGGEFGFVVFSLANRLGVLPLELNKLLIIVVVLSMALTPLLNEIGRRAAGIIDEKSETKEKPAEMVNYDATEPIVILGFGEMGKVLAKFLSAPLSFGLDKDAEGWPYVAFDLNPAVVKSARKSGFPVLYGDGSRPLVLQSAGVSSPKAVMVMYTGKEKTIEAVNRLRQAFPGVPMYARAQDMSHLLDLKKAGATEVVLENAETSLQLGSMLLRGLGVMSDDVSFFSKLVRDSMELQAQEALNNIENREIDIMKPLEIRISDLVERNGNGSRMIAQEDSLRLSSRPNIPLIEATLEDRIPETTGENDQTGYDFNNIDSEDGVKYCLLEASDDESEASNSSKEMIDQSV

SEQ ID NO: 72730 - protein, 309 aa, Anabaena variabilis ATCC 29413
MVAADNLQKMSEEAKFNLVAYLKERQKLCEAALDEAIPVIYPEKIYESMRYSLLAGGKRLRPILCLATSEMMGGTIEIAMPTACAVEMIHTMSLIHDDLPAMDNDDYRRGMLTNHKVYGDDIAILAGDGLLAYAFEFVAIRTPESVPRDRVLQVVARLGRALGAAGLVGGQVVDLDSEGKSDISLETLNFIHNHKTAALLEACVVCGGILAGASSEDVQRLSRYSQNIGLAFQIIDDILDITSTQEQLGKTAGKDLLAKKVTYPSLWGIEQSRVKAQQLIEAACAELEPFGEDAQPLKAIAHFITSRNH

SEQ ID NO: 72731 - protein, 357 aa, Chlamydomonas reinhardtii
MAAANQKPGPAGRPEPLIGHPRYEKIKDLNSGTFGFVQLARDKLTGETWAVKFIERGDKITKYVEREIINHRCLVHPHIVQFREVFLTPTHLCIVMEFAPGGDMFEYVVRKNGLREDEARWFFQQLIVGLDYCHRMGVVNRDIKLENTLLDSSPRPLVKICDFGYSKHEKFQSAPGSRVGTPAYLAPEVILTTKGKTYDGKIADIWSCGVMLYVMLVGAYPFERPEDKHDNQKLQKMIQRILHVDYHIPPHVRASEDCKDLLAKILVADPHKRITVDGIYNHKWYLKGLPPGVREMNDRVQPPPEGLQSVEEIKRLIEEARHVGVGAPGYVNPVETDEYIDDAMDNMYDEGSLDYND

SEQ ID NO: 72732 - protein, 404 aa, Thiomicrospira crunogena XCL-2
MTHPDLIASILLTFGGLFLIGLTADLLGRHTPLPRVTLLIFTGFLIGPSTLNWLPTFAYDWFPILTDIALAMIGFLLGQNLTREKLTTMGRPIIGISISVMVMTATLMFFGLWLLGVPIEMALILAGIAPATAPAPVIDVTREIDAKGPFTDTLLGVVAIDDAWGMLLFSFLLVVATIVGGNGHSLDALNNGLWEVFGALLLGGLLGFPMAFLNSHLYPGKSSQAEVLGLVLLCAGLAEMLEVSYILSAMMMGTVVANFSMHHRHRPFDELEMFEWPLLILFFLLAGASLDLSALYTVGYMGAGYVIFRILGRIFGSYIGAKWAKCDQKQYAWMGFAMLPHAGVPIGMALLAIQQFPHLKAPILAVILSATIVFELAGPIATRWLLIKSGESSSQTKLDFDSKP

SEQ ID NO: 72733 - protein, 447 aa, Zea mays
LGNKIPEFNELVHQNRWREALDRLLETNNFPEFTGRVCPAPCEGSCVLGIIENPVSIKSIECAIIDKGFEEGWMIPRPPLQRTGRKVAIVGSGPSGLAAADQLNKMGHFVTVFERADRIGGLMMYGVPNMKTDKIGVVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYEVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 72734 - protein, 231 aa, Gluconobacter oxydans 621H
MSGTDMNVHKRTAAREAADMVKSGMVVGLGTGSTAAYMIERLGERVAEGLEIFGIPTSDDSEDKALKAGIPLTDFSAHRRIDIAIDGADEVQRGSLNLIKGLGGALLREKIVAQAAKRFVVIVDGTKPVDLLGERAPVPVEVISFGWECTAERLAACGARGVKPRTDRAGSLFVTDTGNMILDCHFGPIEKPEELAEKIDRIVGVVEHGMFLNMASEVLVATPDGVEHWEP

SEQ ID NO: 72735 - protein, 452 aa, Anabaena variabilis ATCC 29413
MSRHTDYSSLEQIQTTGAAAPKPLLTLSDAVALIVGIVIGAGIFQTPALVASQAGSDIAVLLLWLAGGLVSIVGALCYAELATTYPNVGGVYYYLKRAFGQKIAFLFAWARLTVIQTGSIALLAFVFGDYASEILRLGTFSSSVYATVVIVLLTILNIVGLQQGKWTQNLLTVAKVLGLLLVVVFGLGATANSVAPIESTPPGSWGLAMVFVLLSYGGWNEAAYISAEIQNRQRNIVRSLVWSIGIITAIYLLINLAYLRGLGLANMADSSAVAADLMRTIWGTPGALFISVLIAICTLGAINATIFTGARTNYALGQDFTLFGFMGSWRQLPSTPGTALLVQGAIALALVLLGTFTRKGFETMVDYTAPVFWFFFLLSGISLLILRRKEPHILRPFRVPFYPVTPLLFCAVCGYLLYSSVVYTNVGAVVGVLVVIAGIPILFWNRYRQGKA

SEQ ID NO: 72736 - protein, 248 aa, Rickettsia typhi
KMPEKIIKFAVDPATGLQDFHMRGIAYGLGFKDSQAKQMKEIVKSVYNAFIETDATQIEINPLIINSYKNLLALDAKITFDDNGLFKHPNITAMRDHDEEDPLETRAANAGLSYVKMDGNIGCMVNGAGLAMATMDIIKLYGASPANFLDVGGGADRERVKEALKIILSDKEVKGILVNIFGGIMRCDIIAEGIIAAARDIGITVPLVVRLAGTNVEKGKEILSNSNLKIIPAHDLADAANKIVEAIR

SEQ ID NO: 72737 - protein, 480 aa, Gluconobacter oxydans 621H
MTEKNNLFINGSWVAPKGGEWIKVENPATKAVVAEVAKGGQADVDAAVSAAKSAFIGWSRRTATERADYIHALKDLVKRDKEKLAAIITSEMGKPLKEARIEVDFAIGLLRFSAENVLRLQGEIIPGSSPEEKILIDRVPLGVIGAITAWNFPLALCARKIGPAVAAGNTIVVKPHELTPLACLHLAKLVEEAKIPHGVINVVTGDGKDVGVPLVAHKDIKLITMTGSTPAGKKIMAAASETLKEVRLELGGKAPFMVMEDADIDRAADAAVTARFNNAGQVCTCNERTYIHEAVYDRFVQKVREKIEALKVGLPTDPSTDMGPKVSEDELNKVHEMVEHAVRQGARLAIGGKRLTGGVYDKGYFYAPTLLTDVTQDMDIVHNEVFGPVMSLIRVKDFDQAIAWANDCRYGLSAYLFTNDLSRILRMTRDLEFGEVYVNRPGGEAPQGFHHGYKESGLGGEDGQHGMEAYVQTKTIYLNA

SEQ ID NO: 72738 - protein, 300 aa, Anabaena variabilis ATCC 29413
MWDYTDKVLELFYDPKNQGVIEDNGEPGVKVATGEVGSIACGDALRLHIKVEVESDKIVDSRFQTFGCTSAIASSSALTEMIKGLTLDEALKVSNKDIADYLGGLPEAKMHCSVMGQEALEAAIYNYRGIPLATHDDEDEGALVCTCFGVSENKVRRIVIENDLTSAEQVTNYIKAGGGCGSCLAKIDDIIKDVKENKAATNLNNKGGSKPTNIPNSGQKRPLTNVQKIALIQKVLDEEVRPVLIADGGDVELYDVDGDIVKVVLQGACGSCSSSTATLKIAIESRLRDRINPSLVVEAV

SEQ ID NO: 72739 - protein, 454 aa, Shewanella sp. MR-4
MRNLLDLDFDFDSAHIWHPYTSMTRALPVFGVHSAQGCELELVDGRKLIDGTSSWWACVHGYGHPAILTAMERQLQQLSHVMFGGITHEPAITLCKKLLAMTCEPLTKVFLCDSGSIAVEVAIKMALQYWQGQDLPLVQKAQKQRILTVKKGYHGDTFAAMSVCDPEGGMHTMFGEAVTKQCFVDAPQTPFGEPLSQDDLAPMQRILREQHQEIAAVIIEPIMQGAGGMRFYSSDYLRGLRALCDEYNVLLILDEIATGFGRTGKLFAYEHADITPDILCLGKALTGGYISLAATLCTDNVAQGISQSPAGVFMHGPTFMGNPLACAAACASLDLINQQEWPAQVAAIEQQMQRELADANDIPSVKEVRVLGAVGVLEMHQAVNTAALQQQFVDLGVWVRPFANLIYIMPPYVITPAQLTQLTRAMKQVAATITPPQAAQTEALANESITISHG

SEQ ID NO: 72740 - protein, 658 aa, Neisseria meningitidis Z2491
MNEFSLAPIVIVLLVSVITVILCRKFNIPSMLGYLLVGFLAGPGMLSLIPKSHATDYLGEIGIVFLMFSIGLEFSLPKLRAMRRLVFGLGGLQVGVTMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSLEWEQAATAAVLLSMIIAPFLLGGSDALVGRLVKSSWDMKSLDLHSMLVETMSKSDHVLIVGFGRGGQTVGRVLAQEDIPYFALDLDIARVQVARSAGEPVSFGDAKRREVLEAAGLGRAKMVVVTLNNMHETQHVLDNVLSMYPNMPVYVRATNDDYVKTFTDIGAEEAVSDTKETGLVLAGYAMLGNGASYRHVYQTMANIRHSRYAALEGLFVGSDDEAGFGETGETVRHAFPLAAEAYAVGKTVGTLPMAAYGIKLLFVRRRTGRIENPDASFTLEGGDVLVVAGKKEEIISFENWSLQGI

SEQ ID NO: 72741 - protein, 513 aa, Pseudomonas tolaasii
MNPSTLPAPPLAEVYDVAVIGGGINGVGIAADAAGRGLSVFLCEKDDLASHTSSASSKLIHGGLRYLEHYEFRLVREALAEREVLLAKAPHIVKQMRFVLPHRPHLRPAWMIRAGLFLYDHLGKREKLAGSKSLKFGANSPLKSEITKGFEYSDCWVDDARLVVLNAMAAREKGAHIHTQTRCISAHRSNGLWEMNMERADGSLFSIRARALVNAAGPWVAKFIRDDLKLDSPYGIRLIQGSHLIVPRLYEGAHAHILQNEDQRIVFTIPYLNHLTIIGTTDREYTGDPAKVAITEGETDYMLKVVNAHFKKQLSRDDIVHTYSGVRPLCNDESDNPSAITRDYTLALSGGNGEAPILSVFGGKLTTYRKLAESAMAQLAPFFTQMRPSWTAKASLPGGENMTTPERAGRRHPRQIRLGTERDAPRRWATTYGSRTWRLLEGVQALADLGDHLGGGLYTREVDYLCAEEWATQPQDILWRRTKLGLFTTAEEQDNVQRYLSKVGQTRAKIEAA

SEQ ID NO: 72742 - protein, 248 aa, Rickettsia rickettsii
KTPEKIIKFSVDPATGLQDFHMRGIAYELGFKDNQAKQMKEIVKSVYNAFIETDAAQIEINPLIVNSDGNLLALDAKITFDDNGLLRHPNITAMRDHDEEDPLETRAANAGLSYVKMDGNIGCMVNGAGLAMATMDIIKLYGASPANFLDVGGGADRERVKEALKIILSDKAVQGILVNIFGGIMRCDIIAEGIIAAAKDIGIKVPLVVRLAGTNVEKGKEILSNSGLEIIPAHDLADAANKIVEAIR

SEQ ID NO: 72743 - protein, 161 aa, Agrobacterium tumefaciens str. C58
MTIKIGEKLPSATFKEKTADGPVETTTDALFGGKKVVLFAVPGAFTPTCSLNHLPGYLENRDAILAKGVDDIAVVSVNDWHVMGAWAQSSGGQGKIHFLADWDASFTKALGLDADLSGGGLGVRSKRYSMLVEDGVVKSLNVEENPGQATVSAAAAMIEQL

SEQ ID NO: 72744 - protein, 358 aa, Arabidopsis thaliana
MLQTVAVPLIGNACHVFMNGFNRVQVYGLEKLHDALLNRPKNKPLVTVSNHVASVDDPFVIASLLPPKFLLDARNLRWTLCATDRCFKNPVTSAFSRSVKVLPISRGEGIYQQGMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 72745 - protein, 633 aa, Nostoc sp. PCC 7120
MTIQEQLHQWHELAQQLRIDSIRATTGATSGHPTSSMSPADLMAVLLTNYLHYDFDNPHHPNNDRFILSKGHAAPLLYAMYKAAGVITDEELMSLRQMGSRLEGHPTPVLPWVDVATGSLGQGLPIGVGLGLAGKYLDQLPYNVWVLLGDSETAEGSVWEAFDHAAHYTLDNLIAIIDVNRLGQRGQTELGWNTQAYANRAKAFGWQAIEIDGHDLTEIDQAFSAAVSINDRPTVIIARTKKGKGVASLEDLGGWHGKALKPDAAKQAIAELGGERQITIQVAKPEPEQPALANPQPFQLPTYEQGAEVATRRAYGDALKALGAAQPDVVALDAEVSNSTYTEDFAEAYPERYFEMYIAEQQMVAAAVGLQVRQYKPFASTFAAFLSRAYDFVRMAAVSRANIKLVGSHAGVSIGQDGPSQMALEDLAAFRAVWNSTVLYPCDANQTAKLVEQMSDLQGIVYLRTTRENTPVIYGTEEDFPIGGSKVIRSSDQDQATIIGAGITLHEAIKAGDHLKNEGIIVRIIDAYSVKPIDVKTLHQAANDTEGNLVVVEDHWHEGGLGAAVLDAFAGVGNLSSYDGPPLQLIKLAVHNMPGSGTPEELLHAAKIDADAIVEAVKLQVRHPIGARISIHP

SEQ ID NO: 72746 - protein, 452 aa, Sulfolobus tokodaii str. 7
MHYDVIIIGGGVGGLAAAIRSAELGKKVAIIEKNEIGGECINRACIPSKTLIDTAKIVNKILKSPWIATSAKINYNLMNKFKDDIIEGIKDNLYQVINKHKIDLLSGKGEVKNEGEVIVNGKVYTYENLVIATGSEPLSLADFPLNGKNVVDPWTAMNMTNLPENIIIVGGGVAGVELATLFRALNKNVTIIELMPRLLPVPGIDIEIANEVKKRLEEKGVRIYVNTKSRIIKSDDKVIFQAQTPSSNEEISGDLAVITIGRKPVTDGIDLKAIKVETDQRGYIKVDNRARTSNSKVYAVGDVAGAPLSATKAWRQGIVAGDNIGNRNSQMPKYIPTSIFADLEIGVVGSTLEELKKNGINGREVKVNMKEIPRAWTLNETEGFLKIVIGEDNRILGANMIGENATEVINTITLAMELSLKIDDLYKVQFSHPTVSEIITEVVQRAIVGEIY

SEQ ID NO: 72747 - protein, 455 aa, Streptomyces globisporus
MAVLAATSPLGGEPLTVFLLQVGLLLACAYGLGRLGTRIGLPPLVGELTAGVLLGPTLLGQISPGLSGRLFPEDISQAHLLDAFCQFGVLLLVAIAGAQFDPRILRKRGGLAARVSLAGLLIPLGLGIATGYLVPASLLADSGERGVFALFLGVAMCVTALPVIAKTLADLNLTHRNVGQLLIAAAVFDDAVGWLLLALVTALASGAAGGPVVLTTMAWTTVFVAAACAVGGPIGRRLSRTGDSRVPVSAVTVGVAVVVLYGALTAAAGMEALFGAFVAGATLLRHIAPVRLAPLRTLVMAVFAPVFLGSVGLRMDLTALAEPSVLLTGLGVLLVATFGKFAGAYVAARSGGMSRYEGLALGAGMNSRGMIEVVIALVGLRIGVLDTVTFTIIVLVALITSVTAPPILRWASSRIVLEEDETERGDRLAGWNTEPALSGGPAPKSAREEKTPDTS

SEQ ID NO: 72748 - protein, 578 aa, Vibrio sp. Ex25
MTFSTDNNKQVVLGEELGPLSDNERLKRESNLLRGTIEQDLQDRITGGFTADNFQLIRFHGMYQQDDRDIRNERTKQKLEPLHNVMLRARMPGGIITPTQWLAIDKFATEHSLYGSIRLTTRQTFQFHGVLKPNIKLMHQTLNSIGIDSIATAGDVNRNVLCTTNPVESELHQEAYEWAKKISEHLLPKTRAYAEIWLDGEKVESTEEDEPILGKNYLPRKFKTTVVIPPQNDVDVHANDLNFVAIADNGKLVGFNVLVGGGLAMTHGDTSTYPRRADDLGFIPLEKTLDVAAAVVTTQRDWGNRSNRKNAKTKYTLDRVGTDVFKAEVEKRAGIQFEASRPYEFTERGDRIGWVEGIDGKYHLALFIENGRLLDFPGKPLKTGVAEIAKIHKGDFRMTANQNLIVAGVPKSEKAKIEKIAREHGLMDDNISEQRKNSMACVAFPTCPLAMAEAERFLPQFVTDVEGILEKHNLPENDNIILRVTGCPNGCGRAMLAEIGLVGKAPGRYNLHLGGNRAGTRVPKMYKENITDKQILEEIDLLVARWSKEREEGEAFGDFTIRAGIIQEVLVSKRDFHA

SEQ ID NO: 72749 - protein, 711 aa, Solanum chacoense
MRLLLLLPILIGILLYCANYAIADTDPNDASALRVLYSSLNSPGQLTKWNANGGNPCGESWTGITCSGNRVTEIKISGLGLSGSLGYQLASLTSVTNFDISNNNLGNQLPYQLPPNVQRLNLAANGFNGALPYSVSQMTSLRYLNVSHNQIQGQVTVAFDSLSSLDTLDFSFNAMTGDLPQSFKALTSMNKMYLQNNQFTGTIDILANLPLDDLNVENNRFTGWVPNHLKGITKSNGNSWNSGSAPPPPPGTPPASRPHHKSGGNNSATDGASSGDGGGKSGIGGGAIAGIVISVLVVGAIVAFFVIKKRLKRSSTDIEKHDNQPFAPLAPPQEVHELKTNEASSAPIVKVFEAPAVVNLRPPPIERHKSFDEVDIAAKPIVPPKKVNTAKIDARQYSIADLQMATDSFNVDNLIGEGSFGRVYRAQFDDGKVLAVKKINSSALQNPEDFLDIVSEISRLHHPNVTELVGYCSEHGQHLLVYEFHKNGSLHDFLHLSDEESKPLTWNSRVKIALGTARALEYLHEVCSPSLVHKNIKSANIVLDAELNPHLSDCGLASLIADADQALNHNTGSGYGAPEVAMSGLCTIKSDVYSFGVVMLELLTGRKPFDSARTRSEQSLVRWATPQLHDIDALAKMVDPALEGLYPVKSLSRFADVIALCVQPEPEFRPPMSEVVEALVRLVQRANMSKRTFGADQGTSRGETDGPDYEP

SEQ ID NO: 72750 - protein, 77 aa, Rhodobacter sphaeroides 2.4.1
MSDIADRVKKIVVEHLGVEEEKVTENASFIDDLGADSLDTVELVMAFEEEFGIEIPDDAAETIQTFGDAVKFISEAA

SEQ ID NO: 72751 - protein, 355 aa, Streptomyces globisporus
MKALVLSGGSGTRLRPISYAMPKQLVPIAGKPVLEYVLDNIRNLDIKEVAIVVGDWAQEIIEAMGDGSRFGLRLTYIRQEQPLGIAHCVKLARDFLDEDDFVLYLGDIMLDGDLSAQAGHFLHTRPAARIVVRQVPDPRAFGVIELDGEGRVLRLVEKPREPRSDLAAVGVYFFTADVHRAVDAISPSRRGELEITDAIQWLLEQGLPVEAGRYTDYWKDTGRVEDVVECNRRMLGRLALQVSGEVDPESELVGAVVVEEGARVTRSRVVGPAVIGAGTVVEDSQIGPYASIGRRCTVRASRLSDSIVLDDASILAVSGLHGSLIGRGARIAPGARGEARHRLVVGDHVQIEIAA

SEQ ID NO: 72752 - protein, 459 aa, Polaromonas sp. JS666
MQTFDFDLFVIGGGSGGVRAARMSAQRGARVALAEVAAMGGTCVNVGCIPKKLYSYAAHYGDSFEESHGFGWVGEAPTFDWDLLKANRAREISRLNGVYVQLLTSAEVTIIEGWARLLDAHTVEVDGRRFTAKNVLVSTGGTPTVPAITGREHVVTSDQMFDLSPFPKRLLVVGGGYIACEFASIFNGLGSQVTQVHRRDKLLTGFDDDVRRFIAGEMSKTGINLQLGTHISAITKTDDGLQVEVKDSQDKPASFLVDSVLYATGRVPNASGIGLETVGVAVNRVGAIQVNAQYQTSVPSIYALGDVTARLQLTPVALGEAMVVVDHLFGPTDGKKPRGMSYDFVPTAVFTHPNIGTVGYSEADAREQFGAIRVYRTDFKALKHTLSGSTERTLMKLLVEDATDRVVGLHMVGPDAGEIVQGFAVAMKAGATKAVFDSTIGIHPTAAEEFVTMREPVKA

SEQ ID NO: 72753 - protein, 501 aa, Oryza sativa Japonica Group
MELLLLCTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSADLADFGDARAESSVGDLRDLISEFTIVVGVPNVSDFFPAVAPLDPQRLRRRVARVFERLQAVFDGHIERRLRDRAAGEPPKNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVYLMLASLLHRFEWRLLPEVEKNGVDMAEKFGMILELATPLRAVAIPV

SEQ ID NO: 72754 - protein, 459 aa, Arabidopsis thaliana
MAQQEASPSPGAEVVGRAFVEQYYHILHQSPGLVHRFYQDSSFLTRPDVTGAVTTVTTMQAINDKILSLKYEDYTAEIETADAQESHERGVIVLVTGRLTGNDNVRKKFSQSFFLAPQDKGYFVLNDVFRFLEEKEVTAQARSVPINGTTRDVQAPIEPERVVVSHEPEVEPEPVASIEEEDLDNVAEVYDPSDKDEGVVVDVEPIEPPTQISHNEILSVPQGDAPKHSYASILKQMKSSPAPTTHVARNKPRPAPVNQKLTAPPAEPAARPEASAHENVPNSSHVDVEDDGHSIYVRNLPFDSTPTQLEEVFKNFGAIKHEGIQVRSNKQGFCFGFVEFETSSGKQSALEASPVTIGDRQAVVEEKKTNSRGGGNNGGSRGRYFSGRGSFRNESFKGGRGGGGRGGYGRGGGEFSGRPKSSNPRNGGEGYQRVPQNGGGGRGGRGEGGRGGARGGGSS

SEQ ID NO: 72755 - protein, 448 aa, Xanthomonas oryzae pv. oryzae KACC10331
MCRMPHATCAVLRRRRSGEVARAPNTHEFEPTHAWLCATAPSHVVTATSHCAAGNQPRAMLSSADSRFPIPAMRAAPDILSRVSRVIGCRHSVKECRRVSSLYFRSPRSCHRNYMSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVITIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGTLPWPLSFSYGRAMQQAALKLWAKDMTVNFAKAQQVIYERAKENGLAALGKWKG

SEQ ID NO: 72756 - protein, 350 aa, Arabidopsis thaliana
MDTGFADSNNDSSPGEGSKRGNSGIEGPVPMDVELAAAKSKRLSEPFFLKNVLLEKSGDTSDLTALALSVHAVMLESGFVLLDHGSDKFSFSKKLLSVSLRYTLPELITRKDTNTVESVTVRFQNIGPRLVVYGTLGGSCKRVHMTSLDKSRFLPVIDLVVDTLKFEKQGSSSYYREVFMLWRMVKDELVIPLLIGLCDKAGLESPPCLMLLPTELKLKILELLPGVSIGYMACVCTEMRYLASDNDLWEHKCLEEGKGCLWKLYTGDVDWKRKFASFWRRKRLDLLARRNPPIKKSNPRFPTLFPDRRDRREPFDRFGPSDFYRFGLRDPRDRFGPRDPRDPHFYGFRY

SEQ ID NO: 72757 - protein, 330 aa, Mycobacterium sp. MCS
MDEVAPVIREALAAASGAPGYPTTAGTPELRASAKAALERRCGITGLADDAVLPVIGSKELIAWLPTLLGAGSDDLVVVPELAYPTYDVGARLAGAQVIRADSLTQLGPQRPALIFLNSPSNPTGRVLGVDHLRKVVGWARDRGVLVASDECYLGLAWDAEPVSVLHPSVCDGDHTGLLAVHSLSKTSSLAGYRAGFVAGDPAVIAELLAVRKHAGMMVPTPVQAAMVAALDDDAHEREQRERYARRREVLLPALKAAGYTVDHSEAGLYLWATRGEPCRQTVDRLARLGILAAPGEFYGPRGAQHVRLALTATDERIAAAAERLSANQG

SEQ ID NO: 72758 - protein, 679 aa, Synechococcus sp. RS9916
MSQAYQPLHHKYRPQRFDQLVGQNAIAATLGHALRSNRIAPAYLFSGPRGTGKTSSARILARSLNCLSSDGPTPEPCGSCELCTTIAAGTALDVIEIDAASNTGVDNIRDLIERSRFAPVQARWKVYVVDECHMLSTAAFNALLKTLEEPPPRVVFVLATTDPQRVLPTILSRCQRFDFRRIPLDALEAHLTWIAEQEAIPIQPEAVHVVAQRAQGGLRDAESLLDQLSLLPAPIEADAVWDLLGAVPEQDLIALAEALASGDPLQLVESSRSLLDRGRDPGAVLQGLAGILRDLVLMAAAPDRPELTSVSPQFRDQLPELAKRIGRQRLLQWQARLRGSEQQLRLSVQPRLWLEVLLMGLLAEAEPSAAAAPAMQQAARQTPSPAISTAQAAASAPPAPAMPQVAAAAPEPPPAPAPSVATTPVAAPTPAAQPATPAVSLPPTGSAAQTGSAPSPTEDATAPAAPDTAPSTSTNLPELWQQILGSLELPSTRMLLSQQAQLVRMDAHRAVVQVAGNWMGMVQSRATLLEQAIARACGGNRQLVLESHAGAITPATPAPGAAPPSTPPSPPSPTIAAAAAPAPVAPPTSSPSPTPASSPPTAPSAAAVAPPAQPAASTPPSAAPAPQLPQTPAPAAAAPSPETNAPEAPPRPMSSPMDDKVKRFAEFFNGQVVDVDLEA

SEQ ID NO: 72759 - protein, 343 aa, Neisseria meningitidis Z2491
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKVHLESGAKKVLISAPGGDDVDATVVYGVNDSILTADMTVVSNASCTTNCLSPVAKVLSESVGIVKGAMTTIHALTNDQTVTDVRHKDLRRARSGVENMIPTKTGAAKAVGLVLPELKDKLDGLAIRVPTVNVSLVDLNFQAARDTTIEEINALMKAASEAGALKGVLGYNTLPLVSMDFNHTTEASHFDATLTKVVDGNMIKVFAWYDNEWGFSCQMLNTARRMFGLEVRPLK

SEQ ID NO: 72760 - protein, 309 aa, Shewanella sp. ANA-3
MVNINRFFPLFALLGAGTAYLMPAWFSGLKTSIVPLLVVIMLSMGLTLDVRDFAYAFKQKRAVITGLILQFTLMPLSALAISLLLGFNRELTIGMVLVGSVAGGTASNVICYLAKGDVALSITMTALSTLAGVVLTPLIIELLIGEMVAIPLMDMLVSLVKIVLIPVTVGVVLNHFFKPQVAKLAPALPIISIVAIVLAISIIVALNAGQFSQVGPVILLAVFLHNGLGLALGYTCCRLLGFNHTVCKTISIEVGLQNSGLATALCIKFFSPLSAVPSAIFSIWHNLSGAMLAGYWASLEQKKQSDGLE

SEQ ID NO: 72761 - protein, 250 aa, Oryza sativa Japonica Group
MKFNIANPTTGCQKKLEIDDDQKLRAFFDKRISQEVSGDALGEEFKGYVFKIMGGCDKQGFPMKQGVLTAGRVRLLLHRGTPCFRGYGRRDGERRRKSVRGCIVSQDLSVINLVIVKKGENDLPGLTDTEKPRMRGPKRASKIRKLFNLSKDDDVRKYVNTYRRTFTTKNGKKVSKAPKIQRLVTPLTLQRKRARIADKKKRIAKKKSEAAEYQKLLAQRLKEQRERRSESLAKRRSKLSSAAKAAATTA

SEQ ID NO: 72762 - protein, 538 aa, Streptomyces avermitilis MA-4680
MTSQPTLQSVPALGTHPASGSNPSRAETREQLSKATYDLLVIGGGILGISTAWHAAQSGLRVALVDAGDFAGATSSASSKLLHGGLRYLQTGAVKLVAENHFERRAVSRQVAPHLANPLTFYLPVYKGGPHGAAKLGAGVFAYSALSAFGDGVGHLLGPSKAAQDVPELRTENLKAVAVYGDDQMNDSRMALMTVRAAVESGAVVLNHAEVTGLRFTRGRVTGAELKDRTNGEEFGVNARLVLNATGPWVDHLRRMENPDAAPSIRLSKGAHLVLKRTSPWKAALATPIDKYRITFALPWEDMLLLGTTDEEYEGEPGDVAVNEKDIAQILDEAAFSIRDQQLSRDLITYSFAGLRVLPGGPGDTSKAKRETVVTEGRGGMLSVAGGKWTTFRHIGRTVMKKLESLPGHPLGEDFEPINELPKKLPLPGVANPRAVAHRLLVDGPAPGPRMAADTAKHLATHYGSLAFDIARLANDNPELGERVHQDAPEIWAQVVYARDNEWAETADDVLRRRTTLTIRGLATDEVRGKVQDLLDKK

SEQ ID NO: 72763 - protein, 328 aa, Trichosporonoides megachiliensis
MSYNKNIPLNDGNSIPALGYGTWQAEPGQVGEGVKLAVKAGYRHLDLAKVYQNQTEIGQALKELFDEGVVKREDLFITSKLWNNRHAPEHVEPALDETLKELGLSYLDLYLIHWPVAFKFTTPDELLPADPTNKDLAYVDDSVKLSDTWKAVVALKKTGKTKSVGVSNFSTRLVDLVEEASGERPAVNQIEAHPLLQQDELVAHHKSKNIVITAYSPLGNNVAGKPPLTENPGIVDAAKRLNHTPAAVLIAWGIQRGYSVLVKSVTPSRIKSNFEQITLSDEEFQRVTNLIKEYGESRNNVPFNYKPSWSIDVFGTQDEAKATHKINA

SEQ ID NO: 72764 - protein, 540 aa, Prochlorococcus marinus str. MIT 9515
MIRFDNVSKIYSTDTVLKNINWEIKRGEKIGLVGSNGAGKSTQFKILIGEVDQTSGVVLKEGSPKISHLKQELDCNLSRTVREELESSFKDIQLVSNKLLEIENEMKLLESRKDTAKLNHLVHQLSKYQEKFEVLGGYQMQAEVEKILPKLGFSQEDADKLVGNFSGGWQMKVALGKIILQKPDLLLLDEPTNHLDLDTIFWLEEYLISLKIAIILISHDRYFLDKLCKKIIFIERGISETYNGNYSFFVEQKSLNEESQNKAFALQQKEIATQRKYIERFRASATRSTQAKSREKQLKKITKIDAPISRLKTPSFSFPECPRSGKSVLQIKNLSHSFEDKILLFDVNLKVSAGEKIAILGPNGCGKSTLLKLIMKKIEPEIGEVNLGKHNIITSYYEQNQAEALAIEKQVIDLIYSKAPDWTQQKVRTFLGSFGFHNNAVFKYVQQLSGGEKARLALALMIMNPSNFLLLDEPTNHLDLQSKENLELAINNYKGTVFVISHDRYFISRVANRIIEIKESKLLSFNGNYEYFLEKKRIKK

SEQ ID NO: 72765 - protein, 249 aa, Rickettsia montanensis
KTPEKIIKFSVDPATGLQDFHMRGIAYELGFKDNQAKQMKEIVKSVYNAFIETDAAQIEINPLIVNSDGNLLALDAKITFDDNGLFQHPNITAMRDHDEEDPLETRAANAGLSYVKMDGNIGCMVNGAGLAMATMDIIKLYGASPANFLDVGGGADRERVKEALKIILSDKEVQGILVNIFGGIMRCDIIAEGIIAAAKDIGIKVPLVVRLAGTNVEKGEEILSNSGLEIIPAHDLADAANKIVAAIRR

SEQ ID NO: 72766 - protein, 328 aa, Trichosporonoides megachiliensis
MSYNKNIPLNDGNSIPALGYGTWQAEPGQVGEGVKLAVKAGYRHLDLAKVYQNQTEIGQALKELFDEGVVKREDLFITSKLWNNRHAPEHVEPALDETLKELGLSYLDLYLIHWPVAFKFTTPDELLPADPTNKDLAYIDDSVKLSDTWKAVVALKKTGKTKSVGVSNFSTRLVDLVEEASGERPAVNQIEAHPLLQQDELVAHHKSKNIVITAYSPLGNNVAGKPPLTENPGIVDAAKRLNHTPAAVLIAWGIQRGYSVLVKSVTPSRIKSNFEQITLSDEEFQRVTNLIKEYGESRNNVPFNYKPSWSIDVFGTQYEAKATHKINA

SEQ ID NO: 72767 - protein, 1633 aa, Staphylococcus epidermidis ATCC 12228
MKKRRQGPINKRVDFLSNKVNKYSIRKFTVGTASILVGATLMFGAADNEAKAAEDNQLESASKEEQKGSRDNESSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSISTDSSVNDKQDYTRSAVASLGVDSNETEAITNAVRDNLDLKAASREQINEAIIAEALKKDFSNPDYGVDTPLALNTSQSKNSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGKFIPGEVKVYEVTDTNAMVDSFNPDLNSSNVKDVTSQFTPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISNVKVTLKNKNGDTIGTTTTDSNGKYEFTGLENGDYTIEFETPEGYTPTKQNSGSDEGKDSNGTKTTVTVKDADNKTIDSGFYKPIYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDSDSDSDSDSDSDSDSDSDSDSDSDSDADSDSDADSDSDSDSDSDSDSDSDSDSDSDSDSDSDSDADSDSDADSDSDADSDSDADSDSDSDSDSDADSDSDSDSDSDADSDSDSDSDSDADSDSDSDSDSDADSDSDSDSDSDADSDSDSDSDSDSDSDSDSDSDSDSDSDSDSDSDSDSDSDSDSDADSDSDSDSDSDADSDSDADSDSDSDSDSDSDSDSDADSDSDSDSDSDSDSDSDADSDSDSDSDSDAESDSDSDSDSDSDSDSDSDSDSDSDSDSDSDSDSDADSDSDSDSDSDSDSDSDSDSDSDSDSDSDADSDSYSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 72768 - protein, 164 aa, Triticum aestivum
  misc_feature (151)..(151): Xaa can be any naturally occurring amino acid
MTSSASSSPSRKVLSKIACLRLQKELGEWQASPPGGFTYKVSDNLQRWVIEVSGAEGTLYAGETYRLQVDFPEQYPMEAPQVIFMHPAPMHPHIYSNGHICLDILYDSWSPAMTVSSVCISILSMLSSSPAKERPSDNDRYVRNCRNGRSXPKETRWWFHDDKV

SEQ ID NO: 72769 - protein, 330 aa, Trichosporonoides megachiliensis
MSYKQYIPLNDGNKIPALGFGTWQAEPGQVGASVKNAVKAGYRHLDLAKVYQNQSEIGVALQELFDQGIVKREDLFITSKVWNNRHAPEHVEPALDETLKELGLSYLDLYLIHWPVAFKFTTPQELFPTEPDNKELAAIDDSIKLVDTWKAVVALKKTGKTKSVGVSNFTTDLVDLVEKASGERPAVNQIEAHPLLQQDELVAHHKSKNIVITAYSPLGNNVSGKPPLTQNPGIEATAKRLNHTPAAVLLAWGIQRGYSVLVKSVTPSRIESNYDQITLSPEEFQKVTDLIKEYGESRNNIPLNYKPSWPISVFGTSDEAKATHKINTNL

SEQ ID NO: 72770 - protein, 262 aa, Oryza sativa Japonica Group
MPASVAHSCFRSPATLSLLAAFMSYDPHAACPRNATLQQHRLLSKACEPLPRRRCLSGGPRAALPASNMGVDGRRWVRPRHDYEFLLDDVLRLGATRIRIGLDVAGGAANFAARMRDRGVTVVTTVLDNAGKPMNEFVAARGLFPLLLSPAHRFPFYDGVFDLVHVGTNALDEGGAPSMGNSGTEEALEFFMFDVDRVLRVGGLLWIDSYLCQSEERRQLVVNLIKRFGYKKLKWMVGEKAGTGSAKTALYLSALLQKPARD

SEQ ID NO: 72771 - protein, 324 aa, marine gamma proteobacterium HTCC2143
MNKAIVIHQYGDSSVLQWQEFALPPLKQGDVLVRNTVAGFNMIDTYMRKGLYPVKFPAVMGVEGAGVVEEVGAGVTGLAIGDRVVYLGGGTGSYSEHSVVAAPRLVVIPEDISDEIAAASYLKGLTVWALLNGSYKVMPGDNVLIYAAAGGVGSLMCQWAKKIGAHVIGIVGSNEKVALAKSYGCDDVINRSTQDILPTVKTLTRGEGVQVVYDSLGADTFETSLDCLAPLGTMVSFGNATGAVPPFSILTLAAKGSLKLVRPQVHAYIAKRADLEHASATLFNMISTGDLSVEITQRFPVSQAAKAHDTVESQQTTGATVLIV

SEQ ID NO: 72772 - protein, 518 aa, Vitis vinifera
MLFLCRMVNHIAPQLKERPFISGSESPESTLSITVVGASGDLAKKKIFPALFALFYEDWLPENFAVFGYARTKMTDEELRDMISKTLTCRIDKSANCGDKMDQFLKRCFYHSGQYSSEEHFAELDKKLKEKEGGKLPNRLFYLSIPPNIFVDVVRCASLRASSASGWTRVIVEKPFGRDSQSSGELTRSLKKYLNEDQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMRPLQLEDVIVGQYKGHSKGGQSYPAYTDDPTVPKGSITPTFAAAALFINNARWDGVPFLMKAGKALHTRRAEIRVQFRHVPGNLYKRNFGTDLDKATNELVLRVQPDEAIYLKINNKVPGLGMKLDRSDLNLLYRARYPRGIPDAYERLLLDAIEGERRLFIRSDELDAAWALFTPLLKESEEKKIIPELYPYGSRGPVGAHYLAAKHNVRWGDLSGEEL

SEQ ID NO: 72773 - protein, 315 aa, Vibrio sp. Ex25
MLDWTDRHCRYFHRLMTKETLLYTEMVTTGAIIHGKGDFLAYNEEEHPLALQLGGSNPEDLAKCAKLAQERGYDEVNLNVGCPSDRVQNGRFGACLMAEPQLVADCVAAMKGVVDIPVTVKTRIGIDDQDSYEFLTDFVSIVSEKGGCEQFTIHARKAWLSGLSPKENREIPPLDYPRAYQLKQDFSHLTIAINGGVKSLEEAKAHLQHLDGVMIGREAYQSPYLLASVDQELFGSNAPVKKRSEIVEEMYPYIEAQLAKGAYLGHITRHMLGLFQSMPGARQWRRHISENAHKPGSGLEVLQDALAKIPKELNV

SEQ ID NO: 72774 - protein, 126 aa, Crocosphaera watsonii WH 8501
MNSSQKINIDQAEAKFNSLSLEERSKLSSETLSNIEGNIKEKSVISPDDESAMYIVVTLLVGTAHDKPLFEDIRTPDDLKEALNSLGSMPSDYLLKFELMWSPQTENDSLTYDEFISEYSNMIDLI

SEQ ID NO: 72775 - protein, 500 aa, Oryza sativa Japonica Group
MELLLLYAPCVILLVSSLYLLRLFSDARRNLPPGPRPLPLVGNLLELGAKPHRSLARLAERHGPLMTLRLGAVTTIVASSPDAARDILQRHDAAFSTRPVPDIVRACGHDRFAMPWLPPSSPQWRALRKVCSAELFAPRRLDAQQRLRREKARRLVSHVARMAREGAAVDVRRVVFTTLLNMLSCTLFSADLADLDEGRAGSAGELADTVAEFAGTVGVPNVVDYFPAVAAFDPQRLRRWLSRVFTRLFAEFDEQIERRMRERDAGEPPKNDFLDVLLDYRTTEDGRQFDRQTLRSRFTDLFSAGSDTSAVTVEWAMAQLLQSPSSMMKAREELTRVIGSKPEIDESDIDSLEYLQAVVKETFRLHPPAPLLLSHRAETDTEIGGYTVPKGATVMVNIWAIGRDSKVWFEPDKFIPERFLQKEVDFRGRDFELIPFGSGRRICPGLPLAVRMVHLMLASLLHRFEWRLLPEVERNGVNMEEKFGIVMTLATPLQAIATPI

SEQ ID NO: 72776 - protein, 308 aa, Gibberella zeae PH-1
MSDYKTYSFNPAQDIPSLDGKVILITGANTGLGKATALELAKHNPAHIYITARNSTKGNTALEEVKGVASEGTQVSLLELDLSSFDSIKAAAKDFLDREVRLDVLLLNAGVMGAPPVLTKDGYEMHIGTNHLGHALLLKLLTPVLDKTPNARVVHLFSAGFRHVGPNGIEFDTLKSATSPTPLPLRYAQSKLACLLYAREAAKRYNFTNIAINPGEVQTELFSRKAGDEMMKHLQENVAPKMAGPISEGVKNHLWAATSTEIKNGEFYEPVGKTGGLEGAGLDEEMANKLWDWTEEQLEGLRVSEIDR

SEQ ID NO: 72777 - protein, 550 aa, Vibrio sp. Ex25
MLKNINPTQTQAWKALTAHFESAQDMDLKELFAQDAARFDKYSARFGSDILVDYSKNLINEETLKHLFALANETELKSAIEAMFSGEAINQTEGRAVLHTALRNRANTPVMVDGEDVMPAVNAVLEKMKSFTERVIGGEWKGYTGKAITDIVNIGIGGSDLGPYMVTEALAPYKNHLNLHFVSNVDGTHIVETLKKVNPETTLFLIASKTFTTQETMTNAHTARDWFLESAGDQAHVAKHFAALSTNATAVSEFGIDTANMFEFWDWVGGRYSLWSAIGLSIALAVGYDNFVELLEGAHEMDKHFVSTDLESNIPVILALIGIWYNNFHGAESEAILPYDQYMHRFAAYFQQGNMESNGKYVDRQGNAVTYQTGPIIWGEPGTNGQHAFYQLIHQGTKLIPCDFIAPAISHNPASDHHQKLMSNFFAQTEALAFGKSEETVKEELVKAGKNTEEVAAIAPFKVFEGNRPTNSILVKQITPRTLGNLIAMYEHKIFVQGVIWNIFSFDQWGVELGKQLANQILPELADESQISSHDSSTNGLINAFKAFKA

SEQ ID NO: 72778 - protein, 172 aa, Nostoc sp. PCC 7120
MTLPNWITFSRLLGVPFLLYGLYDSTSKARWVCLAIFLVAALTDWLDGYLARKLNQVSDLGKFLDPLVDKFLVLAPLLVLVELGKIPAWGVFLILARELAIAGWRVNQTTITGANIWGKLKTVSQILAIALLIAPLSSDWQQVSLIAFWLSVALTLISGGIYLWPQKLSQAS

SEQ ID NO: 72779 - protein, 181 aa, Cicer arietinum
MASSMISSSAVTTVKRASSVPSGAVAPFVGLKSMAGFPVRKVNNDITSIASNGGRVHCMQVWPPIGKKKFETLSYLPPLTEEQLLKEVEYLLRKGWVPCLEFELEKGFVYREHNNSPGYYDGRYWTMWKLPLFGCTEAVQVLKELQEVVKAYPNAFVRIIGFDNVRQVQCISFIAHTPKEF

SEQ ID NO: 72780 - protein, 200 aa, Medicago truncatula
MGSKGVGSIFIIFLNLLLVSTLVASHTPRRPPPPPCLSTPPPVDTPSTPPHVVTPSTPPPSTPPPSTPPSTPPSPSPPIITPSAPPPSTPPPTTPPSTPPSIPRTPPSTPPPIPVTPPQNCNLLNLNICAKVLNNVVVLNPRNNRCCTLISGLVDLDAAVCVCAALKANIIGISVNINADLKIILNSCGVNTPAGFTCRR

SEQ ID NO: 72781 - protein, 376 aa, Vitis vinifera
  misc_feature (213)..(213): Xaa can be any naturally occurring amino acid
MPFSAETRSKRRVSCPEVNWFNDQAPFSHVVFKMQLQSLSPENDIVPRKSLTITTDPFSLLSDQLLLHILSKLPYSHHTTTSLVCKRWMHLHGRLVQSVKLVDWDFLESGRLIRRFPNLTDIDLVRACVRLPNNSAIWLSHKFLSIQLDSRFLSGGFVSGDDLLPPDVIDEGLRIVAEGCPNLRKLVLIGASEKGLSSVATECLTLQELELHXCTDLSLRGISGCQNLQILKLIGSVRELYNSVISDIGLTILAQGCRRLVKLELCGRLKSLSLEGCSLLTVEGLDSVVHSWKELQRLRVVSCNNIKDSEVTPALATLFSVLKELKWRPDSRSLLSSSLGETGMGKKGVSLDCVEHRFGSGDDHWPSQIKLIMQHQ

SEQ ID NO: 72782 - protein, 664 aa, Oryza sativa Japonica Group
  misc_feature (13)..(13): Xaa can be any naturally occurring amino acid
MAAAVQLLVVAAXAAMAAACCAGMAADILTVEVTWDLEYVLWAPDCQQRVMIGINGRFPGPNITARAGDVISVTMNNKMQTEGVVIHWHGIRQCHRLELATGFLATPKTGKHEEDFIFEQEKLKFGTPWADGTASISQCAVNPGETFVYKFVADKPGTYFYHGHFGMQRAAGLYGSLIVLDSPEQPEPFRHQYDDGGELPMMLLSDWWHQNVYAQAAGLDGKDRHFEWIGEPQTILINGRGQFECTLGPARKSFEKLLNENVETCVDDQKMCSDQEKCLRRSECGPYCPRSQCAPVVFNVEQGKTYRLRIASTTSLSLLNVKIQGHKMTVVEADGNHVEPFVVDDIDIYSGESYSVLLKADQKPASYWISVGVRGRHPKTVPALAILSYGNGNAAPPPLQLPAGEPPVTPAWNDTQRSKAFTYSIRARKDTNRPPPAAADRQIVLLNTQNLMDGRYRWSINNVSLTLPATPYLGAFHHGLQDSAFDAFGEPPAAFPEDYDVMRPPAKNATTASDRVFRLRHGGVVDVVLQNANMLREEVSETHPWHLHGHDFWVLGYGDGRYDPAAHAAGLNAADPPLRNTAVVFPHGWTALRFVANNTGAWAFHCHIEPHLHMGMGVVFVEGEDRMHELDVPKDAMACGLVARTAATPLTPATPLPPSPAPAP

SEQ ID NO: 72783 - protein, 256 aa, Saccharomyces cerevisiae YJM789
MFKSVPKLGRSPIFYLNSQRLIHIKTLTTPNENALKFLSTDGEMLQTRGSKSIVIKNTDENLINHSKLAQQIFLQCPGVESLMIGDDFLTINKDRMVHWNSIKPEIIDLLTKQLACGEDVISKEFHAVQEEEGEGGYKINMPKFELSEEDEEVSELIEELIDTRIRPAILEDGGDIDYRGWDPKTGTVYLRLQGACTSCSSSEVTLKYGIESMLKHYVDEVKEVIQIMDPEQEIALKEFDKLEKKLESSKNTSHEK

SEQ ID NO: 72784 - protein, 457 aa, Mesorhizobium sp. BNC1
MTDRSNELNAWDRDHFFHPSTHMGTHARGESPNRVVAGGEGVYITDVNGRTSLDAFAGLYCVNVGYGRQKIADAIAEQARNLAYYHAYVGHGTDASIRLAKMIIDRAPQGMSRVYFGLSGSDANETNIKLIWYYNNVLGRPEKKKIISRWRGYHGSGIMTGSLTGLDLFHNAFDLPRAPILHTEAPYYFRRPDRSMSEEQFSQYCADKLEEMILAEGPDTVAAFIGEPILGTGGIVPPPAGYWEKIQAVLKKYDVLLIADEVVTGFGRLGTMFGSDHYGIKPDLITIAKGLTSAYAPLSGVIVSDKVWQVLVQGSDKLGALGHGWTYSAHPLCAAAGVANLELIDEMNLVENAGTVGAYFRAELANAVGSHPNVGEVRGDGMLAAVEFVADRDDRVFFDASKKIGPQIAAALAERGVIGRAMPQGDILGFAPPLCLTKEEADKVIAATASAVDSVLG

SEQ ID NO: 72785 - protein, 113 aa, Arabidopsis thaliana
MFNSTALVIFAILFLLISADAFPIPSPNGEIDAMLIRNSIIGEDEDLMPTEISRRVLMAQKRYIGYETLRRDMVPCQKPGASYYDCRSGQANSYSRGCDTITRCARDTNDINT

SEQ ID NO: 72786 - protein, 196 aa, Medicago truncatula
MGSKGVGSIFIIFLNLLLVSTLVASHTPRRPPPPPCLSTPPPVDTPSTPPPVVTPSTPPPSTPPPSTPPSPSPPIITPSAPPPSTPPPTTPPSTPPSIPRTPPSTPPPIPVTPPQNCNLLNLNICAKVLNNVVGLNPRNNRCCTLISGLVDLDAAVCVCAALKANIIGISVNINADLKIILNSCGVNTPAGFTCRR

SEQ ID NO: 72787 - protein, 525 aa, Mesorhizobium sp. BNC1
MTIRAEPVPARNLSDQISVLRCPSKRLSMNAATAKIDLSAKLDLLHDKSLLRELAYVDGRWVTGHEPVNFEVRDPATGAVLAYVASLNAAQVDSAIDAAARAFLSWKRLLPQERAATLRAWYELIVAAKEDLALLMTLEQGKPLAESRGEIDYAASFVEWYAEEAKRLNVESVTSHLPGAEMMVRREPLGVVGVVTPWNFPSAMLTRKAAAALAAGCTIVAHPSSETPLSALALAELGERAGLPAGVLNVVTGDAATIVGRMCGDSRIRAMSFTGSTEIGRLIAAQCAPTMKRLVMELGGHAPLIVFEDAPLDKAVDIAIGAKFATSGQDCLAANRIYVQRGIYGAFCEAFAARIATLKVSDGLDETGDIGPLMHERAIAKVEEQVTDALGRGARCLIGGERHPAGRLFYQPTLLADVPDAALIMREETFGPVAAAVPFDTEDEVVRRANNTEYGLVAYVVTENGARQLRMGRALDYGMVAINRVKITGAPIPFGGVKQSGIGREGARHGLEAFTDLKYLCLDAA

SEQ ID NO: 72788 - protein, 257 aa, Saccharomyces cerevisiae
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDLRKFQKSLFCTPIKA

SEQ ID NO: 72789 - protein, 372 aa, Sulfolobus tokodaii str. 7
MTLYCKRGYKGYLYLEDGTLIEGCGFGAKGIRAGEVVFTTSMNGYPESLTDPSYRGQILVITHPLVGNYGVPEKQRVEGILTNFESEQIQVEGLVVSEETDPFKWNSSKSLHEWLLSEGVPGLSDVDTRSIVKKVRSRGVMMGVIASGYEIEDPKKFLEKKYDEIDFTQFTSPKAPIVHLGNTGETIVVVDCGVKHGILYQLHQRGFTIVRVPCKFNVSKIMDYYPKGVVFGNGPGNPNLLQEVIENFKELTEYKIPILGICLGHQVATLAMGGKVNKMKFGHRAINKPVIDISSNKCYITTHNHGYGILSKEDLPPNSKLWFINPDDGTIEGWIHEKLPIITTQFHPEARPGPWDVTWVFDKFKKMVSRNA

SEQ ID NO: 72790 - protein, 258 aa, Buchnera aphidicola str. Sg (Schizaphis graminum)
MMSPLVIKLGGVLLESDNAMMRLFKALLDYQKSNKRHILIIHGGGRLIDDLMNKLSLPIEKKNGLRITQSEHINVITGALAGTANKILLSWALKYKINAVGLCLADGKSVNVEKLDQDLGHVGKAKPGSPLFLTKLCEQGILPIISSIGITDDGLLMNVNADLAATALATTLKANLILLSDISSILDGKGQRISEINYLQAKKLISQGIITNGMIVKVNAALEAARVLQRSIDIASWQNTDQLKLLFNGINIGTRVLV

SEQ ID NO: 72791 - protein, 212 aa, Thiomicrospira crunogena XCL-2
MQHPLYQQATYLKSAPDLSHCPEDFGYEVAFAGRSNAGKSSALNVITSQRGLAKTSKTPGRTQLINFFECDEQRKLVDLPGYGYAKVNVNTKRAWERSLSQYIEVRSSLKGLIMMVDSRMPPTEIDLMMLDWTLTLNLPVHILLTKSDKLKKGPAQNSLLKMRQLLNEKYPHATVQLFSSLKRQGLDEVWAKLDEWMEYERPVKSQPETKES

SEQ ID NO: 72792 - protein, 448 aa, Helicobacter pylori 26695
MYVEKILQSLQKKYPYQKEFHQAVYEAITSLKPLLDSDKSYEKHAILERLIEPEREIFFRVCWLDDNNQIQVNRGCRVEFNSAIGPYKGGLRFHPSVNESVIKFLGFEQVLKNSLTTLAMGGAKGGSDFDPKGKSEHEIMRFCQAFMNELYRHIGATTDVPAGDIGVGEREIGYLFGQYKKLVNRFEGVLTGKGLTYGGSLCRKEATGYGCVYFAEEMLQERNSSLEGKVCSVSGSGNVAIYTIEKLLQIGAKPVTASDSNGMIYDKDGIDLELLKEIKEVRRGRIKEYALEKKSAEYTPTENYPKGGNAVWHVPCFAAFPSATENELSVLDAKTLLSNGCKCVAEGANMPSSNEAIGLFLQAKISYGIGKAANAGGVSVSGLEMAQNASMHPWSFEVVDAKLHHIMKEIYKNVSQTAKEFKDPTNFVLGANIAGFRKVASAMIAQGV

SEQ ID NO: 72793 - protein, 566 aa, Oryza sativa Indica Group
MPLRPPPPPQGFLTAYPSAAFPPVKRPHEDDLGAGDVLTFRFHSLAVLKLFDRIREYRLHDYRYQATRGWYSSGTAPEDALLPCAVARPPRMYGCVIGVQRGRTVEVVDTSDILLDTDPGTLDRDLLKKKLETYKKAFPGLAILGWYSIDTHVTNTDMETNQATVIWLSVWSYYEEMLLLLMDASGTTFYLLFNPAMNLSLKDLPVTIYEKVHSTNRSPTPLIFVQGKYKTETVEAERISLDHTCPVVSDVSVPPLVGKGQHANIMQTSGFKLMLFEIPSGFAMFEVSQELIARPKDIWARFAYQDDITNVIVTLGSIQIHNKSVARDIIVGPGDELKEFILSFCTHNYLIVQDVELKDVIEKKLNIYCYCNPTVVGELTWGLNYVLHKLLPQEQSLTHEPYLPLSKAMSKQIKEYGFKISPREIDREFLRAMSFLNYLGYMSERYSLLLDHLFGQYRKNNMSDIEFAKSIASHLHSSEGIVPRDERYTRAEIMEFIDFIIAAPENRSRTLSFLRRIEAASIDDSPPPPSLPGGMGVSLLKRLRLDWITVCCLGCAVALYPFYRRV

SEQ ID NO: 72794 - protein, 681 aa, Staphylococcus epidermidis ATCC 12228
MTNNNRIKRFSIRKYAVGVVSIITGVTIFIGGQQAQAAETSVQHADAHPEDSQTTQQLKNDKVEETLKASKQGNADSQQVQTIDQSKTNQNNQHSVAESAQLKSDETANQPKKEEGSSVKQDVQPSKNVNQQDVATQSNERENNDIKDEGQTSKTSNQHIQSSNSHNQSTGTKDSYSEEIDQPLVKLQKPSNDSTYQTQSKTKQDSSKQLPQEKTTKRQIQTTENEQTTKVDSKKANDTQNVEKHTQEPKNDTSTSQKNHQQVATKEQSNRSTTRETQKQSANANQNHQSTHQAQFKNQYPVVFVHGFLGFAGDNQFSLAPKYWGGTKYNIDRNLTNEGYNVHEANIGAFSSNYDRAVELYYYVKGGRVDYGAAHAAKYGHHRYGRTYKGIMRDWEPGKKIHFIGHSMGGQTIRQMEEFLRNGNQEEIEYQRQHGGTISDLFTGGKDNMVASITTLGTPHNGTPAADKIGTRKLVKETINRIGRLSGGKDVDIDLGFSQWGLKQQPNESYIDYAERVSKSKIWNTEDQAVNDLTTQGAEKINQQTSLNPNIVYTTYTGSATHTGPLGNELPNSSEILLLNLTSRIIGKDANKEIRPNDGVVPVISSQHPSNQAFKKVDDHTPATDKGVWQVRPVQHDWDHLDLVGMDAFDLTHTGRELGQFYLGIMDNIMRIEEADGITNK

SEQ ID NO: 72795 - protein, 223 aa, Streptococcus suis 89/1591
MNFQKNKDAIFSAVAKAAEKAGRPSESVKVIAVTKYVDSSIANQLVNTGITHIGENRVDQFLEKYNALADKQLTWHLIGTLQRRKVKDIIPFVDYFHALDSVKLAQEIDKRATKIVKCFLQVNVSGEESKHGFAVSEIDAALAEISLLENIELVGLMTMAPIDATDDELDEIFSKIQEIQEELATRNLPRMPFTELSMGMSGDFERAIAHGATYVRIGSAFFE

SEQ ID NO: 72796 - protein, 820 aa, Vitis vinifera
MILQNSIIFLFCFFLLILFIPLLDLVFPLILAVEGQAGEVLITGNKTILSENGTFKMGFFSANGGPNWYLGIWYASLPTPTYVWVANRETPVKSVESATVELGGDGRLKIMEVGGSVVWQTTNVEKSTAVKLLESGNLVLLSRKEKVVWQSFDFPADTWLPGMNMTAHRSITCWKSSVDPSPGSYSLRLKPPDYGEFELVFNGTMMYWSTGNWTGDRFAGVPEMTIPYIYKFRFLHPFTPAAAFWYTATALENSGGGGRPPLNRFHVDSSGLLRQYTWFPQTDTWNMFWSQPENRCRVYGLCGNLGLCNTVTLKPCECLAGFQPSDELSWSSGDFSGGCLREDNNVCSETDGGFEGIGSVSFNGAALVPIPGNSKSCEASCLMNCSCIGLYRNARSNLCYNVYGPVLNLKNLSSDSTEEGELHVRVHRRGNGKKNKWKWPVLIACVAGFSIILGLSMAVLLVFRKRRQRKKKVEEEDVFSVTNLRVFSYKELNAATQGFSEKLGHGGFGTVFKGELSDSSQVAVKRLERPGGGEKEFRAEVCTIGNIQHVNLVRLRGFCSENSHRLLVYDCMQNGPLSVYLRRDGENLSWDVRFRVAIGTARGIAYLHEECRDCIIHCDIKPENILLDSDFIPKVSDFGLAKLMGRDFSRVLATMRGTWGYVAPEWISGVAITAKADVYSYGMTLLELIGGRRNVETPPSAGGGGAAATGDEWFFPPWAARQIIEGNVAAVVDERLRDSYNTAEAERVGLVAVWCIQDEEAARPTMGMVVKMLEGIVEVAVPPPPKLLQALVSGESFHGVLAESGGTSTGDANSHSSHRW

SEQ ID NO: 72797 - protein, 471 aa, Mycobacterium sp. MCS
MSEQRPAPHIFVLFGATGDLAKRKLFPGLYRLAAAGRLPEEYAIIGSGRHSPGGDDEFRDSVGDGLRDSVDDIDDRVLSNLLQSLSFQTSDSDDGSDLAEAVRSARTRLGDGAQTLIYLSVPPRAMQPMIGMLGREGLAEGARVVVEKPFGTDLDTARELDATLKDVVDEDQVYRIDHFIGKEAVQNILAVRFANGLIEPAWHRNHLVSVQIDVPEELTIEGRGSFYESTGCFRDMISTHLCQVLGFVAMEPPVHLDPVSLRNEKAKVFEAMRPLDPDRVVFGQYDGYREEEGVADDSQVETFVALEAFIDTERWQGVPFYLRTGKALGATRRTVTLTFRSPPMALFGADDNEHSPNQLVLELTDSPEFQVRLLAKRPGPDLGLMPLDLSLGVADEDSDDTPLEAYERLLLDVMRGDQTLFTRADEVDRLWQVCQPVLDAPPPALTYASGSWGPQEALALPGAAGWRLPDA

SEQ ID NO: 72798 - protein, 65 aa, Gracilaria gracilis
WAIGTGKVATPEQAQEVHKFLREWLASNVGADLPLLRASLYGGSVKPTNANDLATQPDIDGFLVG

SEQ ID NO: 72799 - protein, 122 aa, Zea mays
  misc_feature (17)..(17): Xaa can be any naturally occurring amino acid
  misc_feature (88)..(88): Xaa can be any naturally occurring amino acid
KVFHDDFFKQSTSKAFXVVWNPGLFKRVGICPGVNGKAYGFFSLYRVTGNVEPLFRAKAFACFFLEKTDQFITQGAMQGGDRPFSLFXRKTGMSNLLLDKVDPFETRFPGYELLDKLLPSDL

SEQ ID NO: 72800 - protein, 370 aa, Vitis vinifera
  misc_feature (24)..(24): Xaa can be any naturally occurring amino acid
  misc_feature (309)..(309): Xaa can be any naturally occurring amino acid
MRTKRELDDDKEKERKKRRRRTGXWNTQRTHLTVMSSTSFSFGPILPLHSPCVESRRIVINVPNWCLKRYGIFFDTLYGMYRFHSKMIRIAQIESSSSVIEAVEELKLHLVPTDNALKCKAIEISSNEYEPSQKDILYAEGVTQSNGLAFMEFSFDDRSPMSETYNENLECPPPSSKYQLIRINSKGLHDGCKWLDMFEDVRAVIFCVALSDYDHMYTDSAGSLYNKMLASRDLFESLVRHPCFIDTRFVLLLNKYDAFEEKINRSPLAVCEWFWEFSPVRPHHNNQSLAHQAYYYVAMKFKDLYHSIXSRKLFVWKTRAREPSSVDEAFKFIREVLKWEEDKDDNTYDITGDESFYSTEPSSSPYIRQE

SEQ ID NO: 72801 - protein, 96 aa, Vibrio sp. Ex25
FIMDKVDMILLMSVNPGFGGQSFIPHTLDKLRAVRKMIDESGRDIRLEIDGGVKVDNIREIAEAGADMFVAGSAIFGQPDYKQVIDQMRTELAEVK

SEQ ID NO: 72802 - protein, 669 aa, Saccharomyces cerevisiae YJM789
MLRTRLSVSVAARSQLTRSLTASRTAPLRRWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRKHIKELVPIIYTPTEGDAIAAYSHRFRKPEGVFLDITEPDSIERRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 72803 - protein, 520 aa, Oryza sativa Japonica Group
MESMLETGAGAAAVAAVGGLVAAAGVCRQGSLRRRRRARTAPTRLQRRITKNKLISVHYKSFSNNIVSYCNAAVPGLPIIGNLHQLKEKKPHQTFAKWSETYGPIYTIKTGASPVVVLNSTEVAKEAMIDKFSSISTRKLPKAMSVLTRKSMVAISDYGDYQKMAKRNIMIGMLGFNAQKQFRGTRERMISNVLSTLHKLVSLDPHSPLNFRDVYINELFSLSLIQSLGEDVSSVYVEEFGREISKDEIFDVLVHEMMMCAVEADWRDYFPYLSWLPNKSFDTIVSTTEFRRDAIMNALIKKQKERIARGEARASYIDFLLEAERSAQLTDDQLMLLLSESILAAADTVLELLYQEIREACGGEAVTEDDLPRLPYLNAVFHETLRLHSPVPVLPPRFVHDDTTLAGYDIAAGTQMMINVYACHMDEKVWESPGEWSPERFLGEGFEVADRYKTMAFGAGRRTCAGSLQAMNIACVAVARLVQELEWRLREGDGDKEDTMQFTALKLDPLHVHLKPRGRM

SEQ ID NO: 72804 - protein, 447 aa, Saccharomyces cerevisiae YJM789
MVEKDTWKLITATALFTVAVTTITDYAWTSWQAQKQVIAQQKNKNKGGQTKSDTDKYHQYDEQFIRQSLKNNVEFLGEDTIEKLSNQYVVVVGAGGVGSWVVNSLVRSGCRKITVVDFDQVSLSSLNRHSCAILNDVGTPKVECLRRHMREIAPWCEIDPINELWTLQNGERLTLGNGTPDFIVDCIDNIDTKVDLLEFAYNHGIKVISSMGASAKSDPTKLNVGDLATTEEDPLARVVRRKLKKRGILSGIPVVFSAEKPDPKKAKLLPLPDEEYERGKVDELSALKDFRVRILPVLGTMPSLFGLTITTWILSNISDKPLEPVEGKNRIKVYDGIYQSLAGQMSRVGIPSQRIPLALKDVSYLVEEVFKGKSPISGISTRLTLTKWDPSKPISLQNVVVLTKNEQKVHEDRVLKGKESLQDVYDAKVLKLVSQRFREEAYYSQFR

SEQ ID NO: 72805 - protein, 518 aa, Nostoc sp. PCC 7120
MIEAEVHLSLHNFLRSQAGFPSWPHHLTMARLVARALRLGRSALIQVGAVCGYQGRYRTSFIASALMWHGPVIIVATETVQQLLLRVEIPRLQQWLQVNKPIRTGDAWPNPEFQGILLTSPEAWLRGQLTSADNFPQGIPTIIDGVDDLEDWVRHQLTQDIQPQDWDQLILACPEQAETIRLARIELTSELFKHPANPYECYLISPSETDILTKLHTALKSASGVPEVWQKFWQQLPSEQNHPPSSSPPLFWATIARRQGLFSLHYAPIELGDILSPIWQRQPVVLIGSALEPETEAPLFQERLGLDDLTCLKFASDSQSEAIQLYIPYKLPLPNTPEFQAAFIHKVRTLVCLSATAPGLTVLLVGDVPLKAQVGAILASEFGSRVQVEKTCLDENGILVSGWEFWREHQAVLPAPQLLVIATLPLPSLEHPLVAGRVAHYKRSHQDWFRLFLLPTALNELQRAVAPVRENQGIVALLDSRVVNRSYGSQILNVLSPLARLNYLDPSLFAPSGEENSA

SEQ ID NO: 72806 - protein, 268 aa, Rhodobacter sphaeroides 2.4.1
MAEARPRVATVDPVWQRIVEEGHAAILAEPLLGGLVHSSLLHHPSMERALAYRFSLKLASGEMSEQILREIADEAYASDPELGQMARADMVAVYERDPACHRFLQPILFFKGYQAVQAYRVGHWLWTNGRQDLAYFVQMRVSEAFGVDVHPAARIGRGIMIDHAHSIVIGETAVVGDNVSMLHSVTLGGTGKEDGDRHPKIGNGVLIGAGAKVLGNIHVGHCSRIAAGSVVLQDVPPCTTVAGVPARVVGEAGCAQPAVTMDHLLSDG

SEQ ID NO: 72807 - protein, 493 aa, Oryza sativa Japonica Group
MESLLAAGAGGIGVAAAAVGGFIAAATLAVAPPKNRRNPPPEKKPHQTFTKWAEIYGPIYTIRTGASSVVVLNSTEVAKEAMVAKFSSISTRKLSKALTVLSHDKSMVATSDSGDFHKMGKRYIMLSMLGTSAQKQFRDTRDMIINNMLSTFHQLVKDDPHAPLIFRDVFKDELFRLSMIQSLGEDVSSVYVDEFGRDISKEEIYNATVTDMMMCAIEVDWRDFFPYLSWVPNKSFETRVFTTESRRTAVMRALIKQQKERIVRGEARTCYLDFLLAENTLTDEQLMMLVWEALIEAADTTLVTTEWAMYELAKNPDKQARNIERLYQEIREVCGDEAVTEEHLPWLPYLNAVFQETLRRHSPVPLIPPRFVNEDTMLAGYDVPAGTEMVINLYGCNMNKKEWESPEEWAPERFAGGRFKVADMYKTMAFGAGRRVCAGSLQATHIACAAIARFVQEFGWRLREGDEEKVDTVQLTAYKLHPLHVHLTPRGRM

SEQ ID NO: 72808 - protein, 621 aa, Oryza sativa Japonica Group
MEAFVPGGAGAAAAAVGGFVAAAALAERAGVIAPRKRPNAPPVSYGWTCNRATRVVASPPQLHDRVKWATAASAHAACDPWRRSCRVARGRAAPAVAAVGGFVAAAALAERAGVIAPRKRTNAPPAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISKEEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQARNIVTLFQLIVGILGIINQSFLFLAFFLLSCQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 72809 - protein, 424 aa, Oryza sativa Japonica Group
MEAFVSGGAGGVGAAAVVGVFVAAAVVGGFVAAVALAERAGVIAPRKRPNAPPGQPGLNISLSSLKLKAMVAKFSSISTRKLSKALTVLTRDKSMVATSDYGDFHKMVKRYVMSSTLGTSAQKKFRDTRDMMINNMLSTFHKLVKDDPHVPLIFRDVFKDELFRLSMIQSLGEDVSSVYVDEFGRDISKEEIYNATVTDMMMCAIEVDWRDFFSYLSWVPNKSFETRVFTAEARRTAVMRALIKQQKERIVRGEERLYQEIREVCGDETVTEEHLPRLPYLNAVFHETLRRHSPVPLIPPRFVHEDTKLAGYDVPAGTEMVINLYGCNMNKKEWESPEEWVPERFTGGRLEVADMYKTMAFGAGRRACAGSLQVMHIACTAIARFVQEFGWRLTEGDEEKVDTVQFTAYKLHPLHVHLTPRGRM

SEQ ID NO: 72810 - protein, 215 aa, Populus tremula x Populus tremuloides
MSDVTKTQENEVETKHQAPRLNERILSSLSRRTVAAHPWHDLEIGPGAPHIFNVVVEITKGSKVKYELDKKTGLIKVDRILYSSVVYPHNYGFIPRTLCEDNDPLDVLVLMQEPVLPGCFLRARAIGLMPMIDQGEKDDKIIAVCADDPEYKHYTDIKELAPHRLSEIRRFFEDYKKNENKEVAVNDFLPSNTAVEAIQYSMDLYAEYILHTLRR

SEQ ID NO: 72811 - protein, 404 aa, Gluconobacter oxydans 621H
MAFRTLDGVDARGKRVLVRADLNVPMHDGVITDDTRLQRVAPTIRELVDKGARVVVFSHFDRPKGQVVPAMSLRPIALKLGQILGQPVGFVAECVGPTVEAAVGAMADGDIIVLENTRFHAGEEANDPEFAKALAQNGDIFVNDAFSAAHRAHASTEGVARDLPSFAGRLMQAELSALSAALENPERPVGAIIGGSKISTKLDLIGNVIEKVDTLFITGAMANTFLAAEGMNVGKSLQEAEMHETARKIAHLAQEKGCEIVLPVDAVVAREFKANVPTETCLIGEVPDDAMILDAGPRTVELIRDRLDTLKTLVWNGPLGAFEIAPFDKATVEVAQYAAQLTEEGKLKTIAGGGDTVSALRHAGVANEMTYVSTAGGAFLEWLEGKILPGIEVLRSAGHDLGLE

SEQ ID NO: 72812 - protein, 213 aa, Buchnera aphidicola str. Sg (Schizaphis graminum)
MNQTLLSEFGNPIERVKKAISALQLGEGIIILDDEKRENEGDLVFSSETMTVEQMALTIRYGSGIVCLCITESKRKKLNLPMMVKHNTSTYRTGFTVTIEASKGVSTGVSAKDRLTTIKTATADDAQPSDLNRPGHVFPLRANGGGILARAGHTEAAIEIVSLAGFKPYGVICELTNKDGSMSRTPEIIKFSKSKKMKILTIKDLILYVQNKK

SEQ ID NO: 72813 - protein, 352 aa, Gluconobacter oxydans 621H
MPEFSRNGVGQVMAVKIAINGFGRIGRLVLRGIIESGRTDVEVVAINDLGSVEANAHLLAYDSTHGRLPGTVRAEGNSLIIEANGRTYGPIKVSAERNPAQVPFQGVDVAMECTGLFTSREKASALLEAGAKRVVISAPATDVDATIVYGVNNDVLTPDMKIISNASCTTNCLAPVASVLDKAFGIECGYMVTIHSYTGDQRTVDTLHKDPRRARAAALNMIPTSTGAAKAVGLVLPHLKGKLDGTSIRVPTPNVSVVSLDFVPTRTPASAEAVNEAIRAASLEGPLKGILEYNTAPLVSSDFNHDKASSIFDATQTVLVDGGKMVRVCSWYDNEWGFSNRMADTAALFGSL

SEQ ID NO: 72814 - protein, 600 aa, Synechococcus sp. RS9916
MALLVQKFGGTSVADVERIQAVARRIAASKEDGHDLVIVVSAMGHTTDELTSKARAISSNPPQREMDMLLATGEQVSIALLSMALNTLGIPAVSMTGPQVGIVTESAHGRARILEVRTDRLRSRLTEGQVVVVAGFQGTSQSSGGTAEITTLGRGGSDTSAVALAAALGADACEIYTDVPGVLTTDPRKVADAQLMPEVSCDEMLELASLGAAVLHPRAVEIARNYGVTLVVRSSWSDEPGTTLTSRSARPIGREGLELGRPVDGADLVEGQAVLALSHVPDQPGVAAQLFEALSAGGVNVDLIIQATHEGSSNDITFTVAEADLEQARSICASLLDDWGGQLVAEGGMSKLSINGAGIMGRPGIAAGLFDTLSREGINLRLIATSEVKVSCVIDADQGAKALRAVTTAFELNDQQVHLNPPASGADDPEVRGVALDRDQAQVSVRHVPDKPGTAASLCSALADAGISLDSIVQSERQHADGSRDISFTLKREDRGRADQALAPLLAQWPGAQLEDGPAIARVSAVGAGMPATAGTAARMFRTLADAGLNIELIATSEIRTSCVVAEDDGVAALQAVHAGFGLGGNTIHQAQGTESPLDA

SEQ ID NO: 72815 - protein, 183 aa, Photorhabdus luminescens subsp. laumondii TTO1
MTANAQQLQFIKDSIETIPDYPKPGVLFRDITTLLDNPLAYQATIDLLVERYQGKGITKIVGTEARGFLFGAPVALRLGVGFIPVRKAGKLPRETLSETYNLEYGTDTLEMHKDSVRENDKVLVIDDLLATGGTVEATVRLIRRLGGEVSEAAFIIGLLGLGGVERLQRQGVSSFTLLEFPDH

SEQ ID NO: 72816 - protein, 99 aa, Anabaena variabilis ATCC 29413
MATYQVRLISKKENIDTTIEIDEETTILDGAEENGIELPFSCHSGSCSSCVGKVVEGEVDQSDQIFLDDEQVGKGFALLCVTYPRSNCTIKTHQEPYLA

SEQ ID NO: 72817 - protein, 158 aa, Synechococcus sp. RS9916
MATFEGRFTDAQGLRIGVVVARFNDLVTSKLLSGCLDCLSRHGVDASATSAQLDVAWVPGSFELPLVAQAMARSGRYDVLITLGAVIRGDTPHFDVVVAEASKGVAAVSRDSGVPVIFGVLTTDTMQQALERAGIKSNLGWSYGLEALEMGSLMKALA

SEQ ID NO: 72818 - protein, 651 aa, Cryptococcus neoformans var. neoformans B-3501A
MAHYVPTSFKPMRSLVAAAGIQLSPSPSSDHNEGTFETEDGELLLGNIIIDEFPADGDRPPVKGEHFQPPGLFNTSMMPTIVTTDGKLHVELKTKDDKVAISEKGQGEGLMLPQHVLLETSSAVQAAEDGGDDGEEGDHSLGGDDFLEGLHFVDDDIIRGSRRYFNPEPEDNLEVEATFLATADSRKVCQNCKRPGHQASKCPHIICTTCGAMDEHERRDCPLSKVCYGCGRRGHHKSECPDPISRNKRWAGCERCGSREHTDKNCPTLWRIYTYRSDSGRRETIKLKEKAEGWVKEAIGGDAMEDWCYNCARTGHFGDDCPQRRGSLVRLTAPSAFSREIARRGPFFSAPKSFLPNPTHSRWEDDDPSAIPYTSAYDSFAGSNAGRRGREKEKQRMMARDTDFNEEDDWFSGDRNRNIGKGAGTPRNNPRGGRGGKRPWDSEMRGKEWDRDRYDRERASREFFDRDREPPRSRGQAPPRRRSRSPNRRDGSRDNAVQETAPNSAPPKAVYRPAINIRDRAIDSPSVREGERGAKAGSKALVSRALSGQNSNNSTPRGQRSSNSPSALPSLLSRIESPTPSNSTSRSRKGRGKEQERDWENEWRRRGNGGGKVANWGKDLDKETEGLSLKKKTKDDISRGSSGQKYYGGYM

SEQ ID NO: 72819 - protein, 387 aa, Streptococcus suis 89/1591
MKIKVNRIAEQKINRGIQLLDSADFSGVSFDEDRLAVLYSESGSYLGQAYLSKQNKGIGWLFSRSNQDLTMDFFVKLFVDAKQKRQHFYQSEMTNAFRLFNQDGDSFGGMTVDLYDEYAVFSWYNTFIYSVKEMIVAAFQQVFPEVRGAYEKIRFKGLAFESAHLYGEEAPEYFTVLENGVHYQVFMNDGLMTGIFLDQHEVRGSLVDGLAAGKSLLNMFSYTAAFSIAAAMGGAEETTSVDLAKRSRELSKAHFKVNSLDLDNHHFVVMDVFEYFKYAKRKGLTYDVIVLDPPSFARNKKQTFSVAKDYHKLISQSLEILNTGGTIIASTNAANVSVEKFKRQIEKGFDVRKHRYEATYRLPADFVINKNDESSNYLKVFTIQVDK

SEQ ID NO: 72820 - protein, 510 aa, Oryza sativa
MAIALRLAAAPLRLRLVSPAPPAIGGAGDGGRRGGGGAARIGVLGRARCRRRRGGGGRLEVAAAAADDSARCRAKGVGAAAAAAETLGGIGVGGGDQLSVVMKFGGSSVSSAARMREVAGLILAFPEERPVVVLSAMGKTTNLLLLAGEKAVGCGVIRVSEIEEWNLIKDLHIKTVEELALPRSVIHTMLDELEQLLKGIAMMKELTLRTTDYLVSFGECMSTRIFAAYLNKIGVKARQYDAFDIGFITTDDFGNADILEATYPAVAKRLHGDWIRDPAIPIVTGFLGKGWKSGAVTTLGRGGSDLTATTIGKALGLREIQVWKDVDGVLTCDPNIYPNATTVPYLTFEEAAELAYFGAQVLHPQSMRPAREGDIPVRVKNSYNPKAPGTLITKQREMDKVVLTSIVLKSNVTMLDIVSTRMLGQFGFLAKELDHVVEELEKIAVVHLLQQRAIISLIGNVRRSSLILEKVNMSLIVHDSEAKQCIKALHQAFFEDDVLTEVEEEALHMS

SEQ ID NO: 72821 - protein, 326 aa, Streptococcus pyogenes M1 GAS
MTERYADKQIKLFSLTSNLPIAEKIAKAAGIPLGKMSSRQFSNGEIMINIEETVRGDDIYIIQSTSFPVNDNLWELLIMIDACKRASANTVNIVLPYFGYSRQDRVAKPREPITAKLVANMLTKAGIDRVVTLDLHAVQVQGFFDIPVDNLFTVPLFAERYSKLGLSGSDVVVVSPKNSGIKRARSLAEYLDSPIAIIDYAQDDSEREQGYIIGDVSGKKAILIDDILNTGKTFAEAAKILERSGATDTYAVASHGLFAGGAADVLETAPIKEIIVTDSVKTKNRVPENVTYLSASDLIAEAIIRIHERRPLSPLFSYQPKGKNNA

SEQ ID NO: 72822 - protein, 500 aa, Xylella fastidiosa Temecula1
MLLTQTKTPPHQQTLTSKSETRSMHNTLLLFGATGDLAQRYLFPSLLQLFTDGLLPQDFRIRALALSPHNTTQFRDILRTRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPVSMEADRIRDEKVKVLRALRPLNAQNAAMHSVRGRYSAGTINSQPVPAYQPPEGSNVETFVGVTAYIDNWRWAGVPFHLCTGKRLAERSTQIVVTLKPVTHWLFERPNRNNAAPNRLCFKLQPQENIELNLMSSLAGPEWGTLELQPLELELSVPTGKHRHIAYERLFLDAFNGNPALFVRHDEVTEAWAWIDSISNAWELSDLPLQPYPAGGWGPPQAHQFLPPLGIDGHGNNA

SEQ ID NO: 72823 - protein, 519 aa, Burkholderia mallei ATCC 23344
MPAQGNAQRTAPLARPAPTDAGHGKFKKQLSLTDLTFIGLGAIFGSGWLFAASHVSTIAGPAGILSWLLGGFAVLLLGIVYCELGAALPRAGGVVRYPVFSHGPLLGYLMGAITLIAFSSLIAIEVVAARQYAAAWFAGLTVEGSGNPTTLGWLVQAALLCFFFYLNYSSVKTFAKANNVISVFKFVVPLAVIVVLFAFFKPANLTLHGFAPFGMPGVEMAVSAGGIIFAYLGLTPIVSVASEVRDPQRTIPIALILSIVLSTLIYVLLQLAFLGGIPSAMLAGGWLAYMVVADAMISPSGCGNIYMNATPRVVYGWAKTGTFFKVFARVDEASGIPRAGLWLTFALALFWTLPFPSWEALINTVSAALVLSYAVAPVSVAALRRTAPGLPRPFRASAFALTGPASFVIAALIVYWSGWRTVSWLLGLQIAMFAVYLACRRRVPTAHLSLAEQVRSCAWLIAFYALMIVASYFGGFGGTGQLAHPYDTFAVAAVALVIYYWGAHTGVPSAKLQLDDDEN

SEQ ID NO: 72824 - protein, 331 aa, Streptococcus pyogenes M1 GAS
MSIRSLFGGLREKILGKNMKIVFPEGNDERVVRAAARLKFEGLLEPIILGQSEEVRNLLTKLGFADQDYTIINPNEYADFDKMKEAFVEVRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIATGLNPDLALDGELQFDAAFVPETAAIKAPDSAVAGQANTFVFPDLQSGNIGYKIAQRLGMFDAIGPILQGLNKPVNDLSRGSSAEDIYKLAIITAAQAIESQG

SEQ ID NO: 72825 - protein, 596 aa, Arabidopsis thaliana
MPFWWPLIVLAFAYAICKFLLMLIPPNVPSIDVDASDVLAHGKDTEENSFIYIPPRGRSQQSDKKVQCYEPATMKYLGYFPALSPTEVEERVTLSRKAQKTWAQSSFKLRRQFLRILLKYIIEHQELICEVSSRDTGKTMVDASLGEIMTTCEKITWLLSEGERWLKPESRSSGRAMLHKVSRVEFHPLGVIGAIVPWNYPFHNIFNPMLAAVFSGNGIVIKVSEHASWSGCFYFRIIQAALAAVGAPENLVDVITGFAETGEALVSSVDKMIFVGSTAVGKMIMRNAAETLTPVTLELGGKDAFIICEDADVSHVAQVAVRGTLQSSGQNCAGAERFYVHKDIYTAFIGQVTKIVKSVSAGPPLTGRYDMGAICLQEHSEHLQSLVNDALDKGAEIAVRGSFGHLGEDAVDQYFPPTVLINVNHNMKIMKEEAFGPIMPIMQFSTDEEVIKLANDSRYALGCAVFSGSKHRAKQIASQIQCGVAAINDFASNYMCQSLPFGGVKDSGFGRFAGIEGLRACCLVKSVVEDRFWPLIKTKIPKPIQYPVAENAFEFQEALVETLYGLNIWDRLRSLIDVLKFLTDQSSNVSRTRKSH

SEQ ID NO: 72826 - protein, 442 aa, Rhodobacter sphaeroides 2.4.1
MATEILMPALSPTMEEGTLAKWLKKEGDEVRSGDIIAEIETDKATMEFEAVDEGILGKILIAEGTAGVKVNTPIAVLVEEGESVDAVSSAKVPEPQEPADEAAPAQGAPKEAPAPAAKAPAAQAARSEGERVFASPLARRIAKEKGIDLAAVQGSGPRGRIVKADVEGAQPSAAPAAKADAAAPKAEAPAAAAAPVAAPAASAASVAKLFADRDYEEVTLDGMRKTIAARLSEAKQTIPHFYLRREVALDALMAFRADLNAKLESRGVKLSVNDFIIKACAVALQQVPNANAVWAGDRILRLKPSDVAVAVAIEGGLFTPVLRDAHQKSLSALSAEMKDLAARARTKKLAPHEYQGGSFAISNLGMFGVENFDAVINPPHGSILAVGAGIRKPVVGKDGAITTATMMSMTLSVDHRVIDGALGAEFLKAIVENLENPIAMLA

SEQ ID NO: 72827 - protein, 629 aa, Anabaena variabilis ATCC 29413
MEASFEVTLQMAIAVFAGIGAQVLAAYLRVPSIVILLLLGIFLGADGVGLLHPQLLGTGLEVIVALATAIILFEGGLNLDLRELGRVSISLQRLVTLGTLITLIGGSMAAHWLGEFPWNIAFLYASIVVVTGPTVISPLLKQINVDRQVATLLEGEGVLIDPVGAILAFVVLDTIVNGDADPVNAIIGLLMRLGIGAAIGAAGGYFMSLIFKRANFLSSELKNLVVLAVLWSLFTLAQMIRSESGVMTTVIAGAVFANSSVPEERSLRSFKGQLTILSVSVLFILLAADLSIASVFALGWGSLFTVLVLMFVVRPVNILFCTWNSNLNWRQKLFLSWVAPRGIVSASVASLFAILLTQRGVNGGDSIKALVFLTIIMTVVCQGLTAGWVATCLGITSQEATGAVIVGCNPLSLLIARFFQERGENVVLIDTDPDCIAQAETQNLRVIASSALDGEVLEEAGLASMGTFLAMTSNGEVNFVLAERAAEEFNPPRVLAVFPRDPQANGSTNNKVQQAFVSDLPIKIWNEYLNDGRVKLGTTTLSESEFTSQQEHIQEKIRTGVLVPLLVEREERLQIIPANQEWEVGDRIIYLLHDPRPNLLKRLSGASQSTPLVLETLPEVEEVPLAKAL

SEQ ID NO: 72828 - protein, 397 aa, Rhodobacter sphaeroides 2.4.1
MGWKTLDDMDLAGKVVLVRVDVNVPMENGEVTDATRIEKIVPTVEDILKKGGKPVLLAHFGRPKGKVVDEMSLRLVLPALQNALPGTKVSFAADCVGPEPEQAVAAMLEGEVLLLENTRFHAGEEKNDPELAAAMAKLGQVYVNDAFSAAHRAHASTEGLARLLPSAAGRLMEAELKALEAALGHPERPVVAVVGGAKVSTKLDLLGNLVGRVDHLVIGGGMANTFLVAQGIEVGKSLAERDMADTAREILSKAKAAGCTIHLPLDVVVAREFKAGAANETVETAACPADAMILDAGPKTVAALSEVFASAKTLIWNGPLGAFEIEPFDAATNAAALQVAQLTKAGQLISVAGGGDTVAALNKAGAAEGFSYISTAGGAFLEWMEGKELPGVAALTV

SEQ ID NO: 72829 - protein, 140 aa, Anaplasma phagocytophilum HZ
MQERTLSILKPDVVERGIIGNVISYIEAAGLKVVAQRMCRLTVSQAEEFYDVHRDRPFFPELVKFMTSGPVVVQVLEGESAIAVYRDVMGATNPKEAAKGTIRADFAESIDANCVHGSDNADNAKREIMFFFGECEIFKR

SEQ ID NO: 72830 - protein, 333 aa, Oryza sativa Japonica Group
MMGGFLSRVLLLAFGYAYPAYECYKTVELNKPEIEQLIFWCQYWILVALMTVMERFGDFTISWLPFYSEAKLMFFIYLWYPKTKGTTYIYGTFFRPYISQHENEIDRNLLELRARATDVVVLYFQKAATVGQNTFFDVLKYVASQSPSQRSSQQPSQEPQQPKQQQAPVQQQPTQKQAPTVLRRSASIAARQAAMAQQSQDAKTVPSSPKIKRQASTKAAPVASTKLTGAAAPSTPKSDADAPKKNEAAPASLQVATPATKADVPASEPSAPLPEAEEADKMAIDEADDAVEGTEEGDPVPGETVEERPMEETIRVTRSKLRRRTASEDPAGN

SEQ ID NO: 72831 - protein, 760 aa, Oryza sativa Indica Group
MENTSGGIGGGRQQSTQDGDFDLPLLAASPRPSDLAQMFSHGADSAHDAGAVSTGASGVPTRFVWPYGGKRVYLTGSFTRWTEHLPMSPVEGCPTVFQAICSLSPGIHQYKFCVDGEWRHDERQPTITGDYGVVNTLCLTRDFDQINTILSPSTPGSRMNMDVDNDNFQRTVSLSDGIIQEGPQRISEAAIQISRCRVADFLNGQTGYDLLPDSGKVIALDVNLPVKQSFHILHEQGIPVAPLWDSFRGQFVGLLSPLDFILILRELETHGSNLTEEQLETHTISAWKEAKRQTYARNEGSWRANHHLVHATPYESLREIAMKILQNGVSTVPIMFSSSPDGSYPQLLHLASLSGILKCICRYFKNSQGNLPILSQPVCTIPLGTWVPKIGDPNGRPLAMLRPNTSLSAALNLLVQAGVSSIPIVDDNDSLLDTYSRSDITALAKDKVYTHIRLDEMTIHQALQLGQDANSPFGFFNGQRCQMCLRSDTLLKVMERLANPVNSSFSCLVKVKVKVQVQRAVRPWSLSSNGDGLGVERKDLERLNEKVKEHIEEKAGRAVAKHSQLVKEVDVRLSARGGELSRGPKICRCEITLFTKRHGVIRAEEDAESTYASIDLASSIIKRKLRKIKEKETDVRHLKGTKPPVSDWPPSLLDNNDDDAQAQLKDLEEAVGAEDEDTVLTKVVRTKVFEMPPLSVEEAMEQLVNVDHNFYAFRDEKTGEMNVLYKRKEGGFGLIVPKGDGHLHKETIPNSDHHHPSLAA

SEQ ID NO: 72832 - protein, 328 aa, Gluconobacter oxydans 621H
MEVIAVATMLAPYIPLPYAVLEILIMALMTGVNLMSVKGYGEFEYWFSAIKVLAIVCFIGIGVWALLSRPIPVHDNLFAHGGLLPHGWLALLAVIPTILFSMGGSEISTVAAVESDNTEQNIVRATRSIALRIGGFYLVSIALVLCLVPWSDVVSGYSPFLLVLHRLHVPFADVALAVVVMTAALSSLNSGIYVTSRILYELAESGSAPGLFLTVDASTKLPRRAILVSAFASILVAAVAVLSPTLIFGLLVSLTGGFMVFNNTMIVAGRLKLVPESPWKAYAALVLIGCTLVAMLIQPETRSQIVLGAAALLLIFLAERFVPRRQPD

SEQ ID NO: 72833 - protein, 297 aa, Picea sitchensis
MNFNNVRVPNVPGGGGAAWALTRAIVLGGLGLYGALNSLYNVEGGHRAIVFNRIVGVKDKVYPEGTHLMMPWFDRPVIYDVRARPHLVESTSGSRDLQMVKIGLRVLTRPMPDQLPTIYRALGENYNERVLPSIIHETLKAVVAQYNASQLITQREAVSREIRRILTERATNFNIALDDVSITSLTFGREFTAAIEAKQVAAQEAERAKFVVEKAEQDKKSAIIRAQGEATSAQLIGEAISNNPAFITLRKIEASREIAHTISNSSNRVFLSSDALLLNLQDMSLDDAHMPPPKPKK

SEQ ID NO: 72834 - protein, 329 aa, Saccharomyces cerevisiae YJM789
MTTVSINKPNLLKFKHVKSFQPQEKDCGPVTSLNFDDNGQFLLTSSSNDTMQLYSATNCKFLDTIASKKYGCHSAIFTHAQNECIYSSTMKNFDIKYLNLETNQYLRYFSGHGALVNDLKMNPVNDTFLSSSYDESVRLWDLKISKPQVIIPSLVPNCIAYDPSGLVFALGNPENFEIGLYNLKKIQEGPFLIIKINDTTFSQWNKLEFSNNGKYLLVGSSIGKHLIFDAFTGQQLFELIGTRAFPMREFLDSGSACFTPDGEFVLGTDYDGRIAIWNHSDSISNKVLRPQGFIPCVSHETCPRSIAFNPKYSMFVTADETVDFYVYDE

SEQ ID NO: 72835 - protein, 570 aa, Buchnera aphidicola str. Sg (Schizaphis graminum)
MISGILASPGIAFGNVLLLKKEEIVINRQNISTENIKTEINKFFNGRKKSVKQLTEIKIATGEKFGKKKEGIFEGHIMLLEDEELEKEIINLITEKKISAAEATKFIIEGQAKALEKIKDEYLKNRAIDVRDIGSRLLKNILNISIVDLNNIKNQVILISKDLTPSETAQINLKYILGFITDLGGPTSHTSIMARSLEIPAIVGTVNITKKVKNNDFIILDSLNNEIIINPSDQIINEKKQVERKYFFKKENLKKLRNLYATTTDGHNIKIGSNIGNIQDIYSAKKNGAECIGLYRTEFLFMGRNALPTENEQFQAYKEIAESMENKPVIIRTMDIGGDKDLPYMNLPKEENPFLGWRAIRISMDRKEILHAQLRAILRASAFGKIYILFPMIISVEEIRTLKIEVHKLQIQLKKEHLVFDENIKIGIMIETPASAIIADHLIKEVDFFSIGTNDLTQYTLAVDRGNDLISHLYNPISPSVIQLIKQVIDISHLHGKWTGMCGELAGDERVTTLLLGMGLDEFSMSSTSIPKIKEIIRKTSFSKSQELAKKVLKAATTKEILDLLNKFII

SEQ ID NO: 72836 - protein, 438 aa, Arabidopsis thaliana
MSNLPLDLVEEILSRVPATSLKRLRSTCKSWNNCYKDQRFTEKHSVIAAKQFLVLMLKDCRVSSVSVNLNEIHNNIAAPSIELKGVVGPQMQISGIFHCDGLLLCTTKDDRLEVWNPCTGQTRRVQHSIHYKTNSEFVLGYVNNNSRHSYKILRYWNFYMSNYRVSEFEIYDFSSDSWRFIDEVNPYCLTEGEVSLKGNTYWLASDEKRDIDLILRFDFSIERYQRLNLPILKSDYETEALSVVREKQLSVLLKRNDTLEREIWVTTNDKIDHTTKNLLWIKFLAIDQRTCYHWSCVSFFIDEEKKMAVFCDGYIGGINETSRRMFYIIGEDKYYRELYVGDSPIRSHRPFVFNYVPSLVQIPQATVIPKRRRQQLSLVLQRCRASKVDVWITDKIDTKEVQWSKFFTVDVDIGGRAMLSYDSFFIDKEKGMALLCGL

SEQ ID NO: 72837 - protein, 222 aa, Helicobacter pylori 26695
MLDYRQKIDALITKIEKARTAYSRHHIVKIVAVSKNASPEAIQHYYNCSQRAFGENKVQDLKTKMHSLEHLPLEWHMIGSLQENKINALLSLKPALLHSLDSLKLALKIEKRCEILGVNLNALLQVNSAYEESKSGVVPEEALEIYSQISETCKHLKLKGLMCIGAHTDDEKEIEKSFITTKKLFDQIKNASVLSMGMSDDFELAIACGANLLRIGSFLFKE

SEQ ID NO: 72838 - protein, 322 aa, Buchnera aphidicola str. Sg (Schizaphis graminum)
MNKIYEDNSFTIGNTPLVRLNNIGNGNILAKIESRNPSFSVKCRIGANMIWDAEKKGRLNKNIEIIEATSGNTGIALAYVAAARNYSLTLIMPDSMSIERRKLLKSLGAHLILTNGKHGMKGAISKANEIVSLNTKRYLLLKQFENPANPEIHQKTTGPEIWKDTKGNIDILISGVGTGGTITGITKYIKIKEGKKDLISVAVEPLESPVITQFLSGKKIKPGLHKIQGIGAGFIPKNLDLSLIDRIITVSSEEAIFNAKKIMKKEGILSGISSGAAIAAALKIQKENDFKNKNIVVILPSSGERYLSTELFSRSFKNENNY

SEQ ID NO: 72839 - protein, 669 aa, Mortierella alpina
MALSSLSTLPRSSAARSFFLQKGNNSCLHSSFSCCYSTKISIPRHTLKPRLTNSLQSHTSLAPLFSTRLSTPSITPTTTHSIFRSLSSASVAIPDHLSNTHQHTDNMTGTATPTELRSALHLQGLTPAKVESFELQKKRALAQLRSKSSDIEKYVFLAWLRNTNVRLFYGLVGDQLEETLPLIYTPTVGTACQNYSSIYPFLAPPGQPDGLFLSINDLPNLTQIIQNYKPFPQDPSLTPQIAVITDGSRILGLGDLGVGGMGIPVGKLQLYVAGAGIDPRRTLPITLDLGTNNEDKLKDEFYLGLREKRAGDDKFFPFVDAVIEALTSLYPKLLIQFEDFSSEHAFQLLDKYQPKKFCFNDDIQGTGAVILAGFMNAINLAGIPAKDHKILFFGAGSAAVCVAKQLAAYFVNDHGMTEDEAREMVWLVDSKGLVTLDRGDKLAEHKLYFARKDNAGSQYPSIASVIEHVRPTALFGLSSQSGAFSEDVLKSMATLNQRPIVFPLSNPAYQAECSFEQAMIHTKGKVIFASGTAFPKYTDPNTGLISAPGQGNNMYIFPGLGLGGILAQPETISDRLIYSAARACANALTVEERSQGLLYPVLPRIRQVSAEVAAAVVTEAVAEGTATNEEAIKLVKSHDKAALLNFVNSNMWTTDGVQHEISTTFAPHL

SEQ ID NO: 72840 - protein, 486 aa, Triticum aestivum
MDSNANGGRSTMVGEMESSLERVRRQLSSTSTRHILQGPLLKRSDTLRKWNERWVILDPATGKMEYKVRRSDTTVRGIIVFDSTSTATLSPTNFHGLPKYEGCCVYIGTPQKKEYFLCAETPSAARAWVSTLHATQLVLQAHKQAVDSLGGNGSAKLGTVATVVAVANATAIEASKEVEAAMKISLRAALGSTTNKLSKGQLDDLTIMMETLRVKDDELHQLLQDIRARDSTIREITDKLQETAEAAETAASAAHAIDEARRFLSSELERLKQDQENQVELSLLRLRESEEKSKLLAEEREHLLKERDSALQEAQMWRSELGKARGNAVILEAAVVRAEEKARVSAADADMRIKEAVSKLESAAKEKEELLALVDALKSQIQRQETSTKQICEERSELCSTSKHMDMDDDNVDKACLSDTDLIPIAENIVELDDEGVDIRTIGDTEWENPHSSEVSDVREVTTEAEENSLDIPVDSQPVADDTFQA

SEQ ID NO: 72841 - protein, 245 aa, Synechococcus sp. RS9916
MFKQIRADLAVIRERDPAARGALEILLCYPGFQAITAHRLSHRLWRSRLPLKLPARLLSQLSRGLTGIEIHPGARIGNGVFIDHGMGVVIGETAEVGDHCLLYQGVTLGGTGKESGKRHPTLENNVVVGAGAKVLGALKIGTNTRIGAGSVVVRNVEANCTVVGIPGRVIHQSGVRINPLAHSALPDAEANVIRNLMERIDQLENQVTNLQATLKAVASDLPIKEVRSGQAQNLKDREILEFLGE

SEQ ID NO: 72842 - protein, 408 aa, Oryza sativa Indica Group
MAVQVQRTPLPRSTYTGHRGYLLRAPPAVTRCTVDRAFPRSHGPPLPRLLYKTSRPDASSSNSTSRHFPRRSKDCCCFAVRSIPDGIMGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 72843 - protein, 256 aa, Escherichia coli O157:H7 EDL933
MKCFTLSSQRRRIIGIPIFCTSTFLIFFSVCCFFTLFAAFAHKTVLFCILKDLHKANNAPKVISKSFIAEVSMSDVLRPYRDLFPQIGQRVMIDDSSVVIGDVRLADDVGIWPLVVIRGDVHYVQIGARTNIQDGSMLHVTHKSSYNPDGNPLTIGEDVTVGHKVMLHGCTIGNRVLVGMGSILLDGAIVEDDVMIGAGSLVPQNKRLESGYLYLGSPVKQIRPLSDEEKAGLRYSANNYVKWKDEYLDQGNQTQP

SEQ ID NO: 72844 - protein, 250 aa, Anabaena variabilis ATCC 29413
MQQSLDGIENPPDSTHTSLVKNLLSGVFLEPLLSDFLIIFERDPAARNWLEVIFCYPGLHAICLHRFAHWLHRRGVVFFPRLISHLARFLTGIEIHPGAVIGKGVFIDHGMGVVIGETAIVGDYALIYQGVTLGGTGKESGKRHPTVGDHVVVGSGAKVLGNIQIGDRVRIGAGSVVLRDVPHDCTVVGIPGRIITHKPKTDLSPLEHGKLPDVEADVIRSLLSRIEQLEQKLQTLTNQPKEPELLTKDK

SEQ ID NO: 72845 - protein, 671 aa, Oryza sativa Japonica Group
MHPLSTTMQAFVFIFAVLALLAGDVEGRQGCYPFSCGHLQNISHPFRRRGDPQRCGVPSYELDCRDSKATIRINTGTYYVTSINYTTSVFWVVDASLKDTNSSCPLPRSDQLPFVSGGIQGSHGGWDLALDPGPGATWVSFVNCSQAVRNNSVYVPVDCLSTSSSFVYVFGSWIMPPSVFPIIGNLETSCRYLAMIPLGGWDSPLPHNASFSDIVRSMRNGFAVHFPIIHRWSRIGHIKDCLMGSIRILWRIHCTICFVCFQVDCWYFYDSVFLIIQYIITTAPFQCLKTHLLKVITVYVKLFFYAVLCRFVIAPLTLLTFLAFKYWKTRIKIDAVEKFLQMQLMLGPTRYAYTDIIAMTSHFRDKLGQGGYGSVFKGVILPGDVHVAIKMLSNYNCNGEEFISEVSTIGSIHHVNVVRLVGYCAEEMRSALVYEYMPHGSLDRFIFSPDKSLSWDKLNEIALGIARGINYLHQGCDMQILHFDIKPHNILLDSNFVPKVADFGLAKLYPRDNSFMPVSAARGTVGYIAPEMISRSFGIISSKSDVYSFGMLLLEMAGGRRNSKQNMSSSSQSYYPSWVYNQLVQQKMGEIANAFNMHELEKKLCVVGLHCIQMKSHDRPTMSEVIEMLEGDVGGLQLPSRPFFCDDEPLPLLVDSCRFSSELTEISEEDE

SEQ ID NO: 72846 - protein, 204 aa, Vitis vinifera
MGKAKKAQKFAVMKKMVTSKALKKHKEEVLNPTKKDENKEKTSRNVPYVPSALFFKYNTALGPPYRVLVDTNFINFSIQNKLDLEKGMMDCLYAKCTPCITDCVMAELEKLGQKYRVALRIAKDPRFERLLCTHKGTYADDCIVDRVTQHKCYIVATCDRDLKRRIRKVPGVPIMYITKHQYSIERLPEATIGGGRLETVYLYI

SEQ ID NO: 72847 - protein, 30 aa, Zea mays
AHVCHWCGTWKGDKICSSCKKARYCSEKHQ

SEQ ID NO: 72848 - protein, 565 aa, Bacillus licheniformis ATCC 14580
MSHNKLNEQVIETRLRGFEVLATPLLNKGVAFPPEERDALGLTGLLPPKVLTLEEQAKRAYKQFQSQPDDLSKNVYLTALHDRNEVLFYRLLNDHMTEMLPIVYTPTVGTAIQQYSHEYRKPRGLFLSVNDPEGMKTAFENLAAKRSRIDLIVATDAEGILGIGDWGVGGIAISIGKLAVYTAAAGIDPNRVLPVVIDAGTNQERLLNDPLYVGNQHSRIRGERYESFIDQYVQIATETFPGVLLHWEDFGTQNARQILKKYKDKICTFNDDIQGTGAVTLAAVLAAVKISKMPLKDHKVVIFGAGTAGIGNAEQIRAALVQEGVSEEESYRRFWCVDRNGLLTDDMNDLQDIQQPYARPADEVKDFSRNGPGDAIDLLEVVKRVQPTILIGTSTVSGAFTEEIVKEMAKHVKRPAIFPMSNPTPLSEARPEDLINWTEGRALVATGSPFAPVEYSGTRYAIGQANNAFVFPGLGLGTLVSKARLITDNMFYASAAAIAGMVDTGRPGAALLPEVEDLRTVSATVATAVIKAAIEDGVAENEPDDVIQAVQDAMWHPVYRPIRAI

SEQ ID NO: 72849 - protein, 202 aa, marine gamma proteobacterium HTCC2143
MTEKHIDFRQAEFRTSAAKLADCPSDDGCEVAFAGRSNAGKSSAINTLTDNKRMARTSKTPGRTQLLNFFDVGERQRLVDLPGYGFAKVPLAVKEKWQRHLGEYLRERESLAGLVLLMDCRHPLQEFDRMMLAWAEGCEMPVHILLTKADKLKKGPANSVLLKVREELKQQELVSIQLFSALKRTGLDQLREKLQIWLRFEE

SEQ ID NO: 72850 - protein, 457 aa, Sulfitobacter sp. EE-36
MTDIIKCKAAVAWAVNEPLSIEEIDVMPPKAGEVRIKIIASGVCHTDAFTLSGEDPEGLFPVILGHEGGGIVESIGEGVTSVAVGDHVIPLYTPECGECKFCKSGKTNLCQKIRETQGRGLMPDGTSRFYKDGQPILHYMGCSTFSEYTVLPEISLAKVNPDAPLEEVCLLGCGVTTGMGAVMNTAKVEEGSTVAIFGMGGIGLSAVIGATMAKASRIIVIDINESKFDLARKLGATDFINPKDHDKPIQDVIVEMTDGGVDYSFECIGNVNVMRSALECCHKGWGESVVIGVAGAGQEISTRPFQLVTGRVWRGSAFGGVKGRSELPDYVERYMNGEFKLNDFITHTMGLEEINEAFDLMHEGKSIRSVIHFGEGSSAGRAVCRRGRGDLEALLESLKSAHLAPLCIPDQRCHSVEPMRHLGERREQEKRQHRAEMYNQKTRHPAGAPCRIEQQTR

SEQ ID NO: 72851 - protein, 433 aa, Mesorhizobium sp. BNC1
MIWCAMRTTLAIRVMALILLIGVPAHGAELRGHGGPVRSIAVTPDGEAAITGSFDTKAIVWSLETGEAREVLLFHEGQVNAVAVLPDGRFASAGADGRIAIWESGQSAPASVLEGHTAPVAALAISPDGSALASASWDASVRLWPLAGGEPKILKGHLGNVNAVAFLSDGTLVSAGYDAAVMLWPRQGEDVPIRVAVPTPLSTLAATADDRLFAGGADGKLYELDRSGDILAEVRVSSKPIVALAASANGRYLAAAGVDDAIVLLDANGLKSVRSLSGAGTPVWSLAFSSSGKRLLAGGADHLVREWDVETGEQLGPATEASADPMAEYAGNPDAQVFRACVACHTLDPDDGNRAGPTLHGIFGRRIASVPGYHYSPAFRGMDIIWTPETVSRLFEIGPSEFTPGTKMPEQTISDPEDRAALIRFLQAETRDD

SEQ ID NO: 72852 - protein, 425 aa, Rhodobacter sphaeroides 2.4.1
MSTIIDIHAREILDSRGNPTVEVDVTLESGAFGRAAVPSGASTGAHEAVEKRDGDKSRYMGKGVLEAVAAVNGEIAEMLVGFDATEQVGIDRTMIEMDGTPNKGRLGANAILGVSLAVAKAAAEFTNQPLFRYVGGSSARVLPVPMMNIINGGEHADNPIDIQEFMIMPVAAQNVREAIRMGSEVFHTLKKELAAGGFNTGIGDEGGFAPNISSTREALDYILRSIEKAGYKPGEDIYLALDCASTEYFKGGKYEMKGEGKSLTSAENVDYLAALCADYPIISIEDGCAEDDWEGWKLLTDKLGAKVQLVGDDLFVTNPKRLEQGIKAGVANSMLVKVNQIGSLTETLMAVDMAHRARYTNVMSHRSGETEDATIADLAVATNCGQIKTGSLSRSDRLAKYNQLIRIEEMLGEVAEYAGRSILKV

SEQ ID NO: 72853 - protein, 262 aa, Lolium perenne
PFISTDYMTYMFKYDTVHGQWRHHEVKVKDAKTLLFGEKEVAVFGCRNPEEIPWASAGADYVVESTGVFTDKDKAAAHIKGGAKKVIISAPSKDAPMFVMGVNEKEYTSDITIVSNASCTTSCLAPLAKVINDKFGIVEGLMTTVHAMTATQKTVDGPSSKDWRGGRAASFNIIPSSTGAAKAVGKVLPVLNGKLTGMAFRVPTVDVSVVDLTVRLEKAATYDQIKAAIKEESEGKLKGILGYVDEDLVSTDFQGDNRSSIF

SEQ ID NO: 72854 - protein, 271 aa, Arabidopsis thaliana
MASIASSSSTTLLSSSRVLLPSKSSLLSPTVSFPRIIPSSSASSSSLCSGFSSLGSLTTNRSASRRNFAVKAQADDLPLVGNKAPDFEAEAVFDQEFIKVKLSEYIGKKYVILFFYPLDFTFVCPTEITAFSDRYEEFEKLNTEVLGVSVDSVFSHLAWVQTDRKSGGLGDLNYPLVSDITKSISKSFGVLIPDQGIALRGLFIIDKEGVIQHSPINNLGIGRSVDETMRTLQALQYVQENPDEVCPAGWKPGEKSMKPDPKLSKEYFSAI

SEQ ID NO: 72855 - protein, 184 aa, Populus trichocarpa
MFFYQTQYLNINSSVLGISKVFGQAAMLLWSIIYNCYLKSVPSKKLIAAIQGVMAVFMLSDLLFVKGVYRNMGVPDSLYVIVFSGLLEVLFFFKILPFNILIAQLCPSGCEGSLMALVASANALSFIVSGYLGVALSSFVGVTGSDFSGFPQALLIQAVCTLLPIYWSSCIPDDKQAKTSTKKE

SEQ ID NO: 72856 - protein, 536 aa, Triticum aestivum
MSLELSMALAAPPGGGLLAPPPPAPPGKEQQVAGVGILLQISMLVLSFVLGHVLRRHRFYYLPEASASLLIGLVVGGLANISNTETNTRTWTWFNFHEEFFFLFLLPPIICQSGFSLSPKPFFANFGAIVTFAILGTFIASIVTGMLVYLGGLTFLMYKLPLVECLMFGALISATDPVTVLSIFQELGSDVNLYALVFGESVLNDAMAISLYRTMSSVRSNAAGGENIFMMILQFLEIFVGSMSSGVGVGFISSLLFKYAGLDIDNLQNLECCLFVLFPYFSYMLAEGLGLSGIVSILFTGMVMKHYTYSNLSDNSQRFVSAFFHLLSSLAETFVFIYMGFDIAMEEHSWSHVGFIIFSIIFIIVARAANVFSCAYLVNISRPEHRRIPLNHQKALCFSGLRGAMAFALALQSVHELPEGHGKTILTATTAIVVLTVLLIGGSTGTMLEALDVIGDENTSIETYEDNNGYIPPTYEEGTSSGGGLRMKLKEFHKSTTSFTALDKNYLTPFFTSQTDEDADDFGDQPQNQRRGFYDQ

SEQ ID NO: 72857 - protein, 493 aa, Agrobacterium tumefaciens str. C58
MTIATPLKAQPKASHFIDGDYVEDNTGTPFESIFPATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 72858 - protein, 516 aa, Triticum monococcum
MAMAMELLVSYPEVLLAIVSYLCLSLLRLILRCQKSGIPVKWPVVGMLPFLVRNRHHIHDKFAHALHEAGCNLMFTGPWFLDMDFFLSCDPATVNHCLSANFNNYPKGGEFAEMLDFLGNGIIVSDSESWEYQRHMAMHILGSRAYRTFSMSTITTKAGATLLPYLDGMARRGSEVELEGVFMRFLLDVTYTSAFATDLDGLSMSLPIPAFGQATKTAEEAVMFRHTVPRSLWKLLRALKVGSEKKMAGARVVIDRHIYQEIAKRKAHLLQGEEGDVLSMCIKWPMDPSMSEQHKTQFLRDTLLGFIFAAKDLTAVTLTWFFYMMCNHPHVEARIIEEITALLQLQSTTMPAGSLSVLDGDMLRQAVYLQAAFLETLRLFPASPFEEVEAVNDDALPNGTRLSKGTRIVFSLYAMGRLEGIWGKDCAEFRPERWLSKSGRLRHQPGYKFPAFNAGPRSCVGKDLALGSMKMIAASIIYNFKVQLVEGHAVMPGSSIVLHTRNGIMVSLKRREAAAA

SEQ ID NO: 72859 - protein, 567 aa, Gluconobacter oxydans 621H
MMGLMQTLALGGCAQTDHAAVSPAPVAPPSTATTSMAATANPLASQAAMDVIRRGGSAVDAAIAAQMVLAVVEPQASGLGGGSTILYWDKGAGKLSFYDGLAAAPAIVPRDYAHDADGHAIPHALLERSGRVVAVPGTLRTLELLHRRYGKLPWADLFQAAIATARNGYAMPGYLHLVLTERPELAQKASFKAYFDADGHPLPKGTILHNPALAETLTQVAAKGADYFYGPAFARKISAAVATGPYPGHITPKDLASYKVRERAPLCVEAFGRRICSAAPPVAGGLSVLQQLAILDRLKIGQYRPGSVEAAHLLLEASRLAEADRRKYAADPDYTPVATDELLSPAYLDARAALVSKGEAAGQVHPGVLKNRLASLPVSDAMTVPATTHLSIRDAAGDALSFTTTINLNFGADIVVDGVVLNNAITNFATHPVVDGQPVANIAAPGKRPITTMAPTIVFGADGQPEVIVGAGGGARIIDSVVQTLVGHLAWGQNIRTAIEQPRIGAQNRAEELEHGTSAAELKTALESMGHHPHAAVMNAAVQAITIGPDGLTGWGDPHRDGVALGQ

SEQ ID NO: 72860 - protein, 319 aa, Staphylococcus aureus subsp. aureus MW2
MRRLFSIGEALIDFIPNITNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 72861 - protein, 71 aa, Glycine max
  misc_feature (43)..(43): Xaa can be any naturally occurring amino acid
  misc_feature (54)..(54): Xaa can be any naturally occurring amino acid
YYPFALFAERELMLIKIAVNAAAQCDVLDIASILGAKTVRFMXSSLPLKLTADXDKMVALHRLLQPYGLCE

SEQ ID NO: 72862 - protein, 440 aa, Helicobacter pylori 26695
MQAFLNRSFAPLLNPNESPLEQVKSSIILKKGVSYFDWGASGLASVLVEKRVKSLLPYYANAHSVASKHAILMGMLLKECQEKLKRSLNLSANHCVLSAGYGASSAIKKFQEILGVCIPSKTKKNLEPYLKDMALKRVIVGPYEHHSNEISWREGLCEVVRIPLNEHGLLDLEILEQTLKKSPNSLVSISAASNVTGILTPLKEVSSLCKKYKAALALDLANFSAHANPKDCEYQTGFYAPHKLLGGIGGCGLLGISKDLIDTQIAPSFSAGGVIKYANRTRHEFIDELPLREEFGTPGLLQFYRSALAYQLRDECGLDFIHKKENNLLRVLMHGLKDLPAINIYGNLTAHRVGVVAFNIGGISPYDLARVLSYEYAIETRAGCSCAGPYGHDLLNLNAQKSSDFNAKPGWLRVSLHFTHSINDIDYLLDSLKKAVKKLR

SEQ ID NO: 72863 - protein, 615 aa, Gluconobacter oxydans 621H
MSATLWVMILFLLTALTKDPSLSCQIMRHFRAGPNHLLDIVKTSFPQRPRTHLMSEQQHPTGPRRGWTDIVAGLSLASVNIPQVLGYTRIAAMPAVTGLYTVLLPLVAFAAFGSSRHLVVAADSATAAIFSSAIGKMAPPESAHYIALVSMTALLCAALLLVARVFRLGFLADFLSRTVLTGFLAGVGVQVCIAMLHDMLGVSVSAHNPLVQAYETFRQIPHGSLMVAALSAVTVGILMTGQRLAPHLPAGLYVVIGSIALSMGLNLSHHGVPTLGHVAGGLPHFGLPDVSWNELLALLPVAAFCVFVIIAQSAATSRVFGERFHETVDEDRDLLGLSAANVAAGLSGTFTVNGSPTQTAMAVRSGARTQVAQVTFACVTLMVLLFLTRPLEALPRCVLAGIVFTVAVGMIDLKSLRAIRQESPGEFWLAVTTAAVVVGVGVEEGIFLAIALSLFRHVRHSYEPHTMVLQQSPTAGVLEALPAKDGLESAPGLIVFRFCADLFYANSTRFRQDLLDLVEHAPHPVRCVVLDASPVTDIDYSAAADLRDLIAQLHQRGIALLFGRVSVYLRADMDRHHITPALGDGNIYAELHTALKAAHQILGDTTVPPPTVRPS

SEQ ID NO: 72864 - protein, 422 aa, Shewanella sp. ANA-3
MNSHSGTIGRWQGAGLMATTLLGTGVFILPQMTIDKAQAGALIAWSLLTLAIIPVALIFGRLASVFPHAAGPAYFVEKAFGRTAGRTIGLIFLLVVPMGAPAAILMTFQFVNALIPLDGWPKVGAEVLVIFGLFLLNLRGIQVSAKLQFGLTLCIVAIVVLLFGASSVQPGHLTSLASYGTPEIPTIMIAAGIAFWSFLGIEAMTHLADDFRRPQQDMIPAMMMGTVLVGIIYVACTLILLLVPTDKSVAMIGVFDALLGGYGAQVIGVLGIASGLATVNVYAASAARLIWSFSNEGILPRCFAVKNRHGVPIRALAALLSVMACVIVLTHTTGQELEHLIAWSNGVFVVIYLMAMLAAAKLLPRSNLPLVVLGCGFCLALGIALGASMAYVLVLILFVAPFLWWQKTHISRKQSLAINKAS

SEQ ID NO: 72865 - protein, 508 aa, Helicobacter pylori 26695
MILVLDFGSQYTQLIARRLRERGIYTEIVPFFESIENIQKKAPKGLILSGGPASVYAKDAYKPSGKIFDLNVPILGICYGMQYLVDFFGGVVVGANEQEFGKAVLEITQNSVIFEGVKIKSLVWMSHMDKVIELPKGFTTLAKSPNSPHCAIENGKIFGLQFHPEVVQSEEGGKILENFALLVCGCEKTWGMQHFAQREIARLKEKIANAKVLCAVSGGVDSTVVATLLHRAIKDNLIAVFVDHGLLRKNEKERVQAMFKDLKIPLNTIDAKEVFLSKLKGVSEPELKRKIIGETFIEVFEKEAKKHHLKGKIEFLAQGTLYPDVIESVSVKGPSKVIKTHHNVGGLPEWMDFKLIEPLRELFKDEVRLLGKELGVSQDFLMRHPFPGPGLAVRILGEISESKIKRLQEADFIFIEELKKANLYDKVWQAFCVLLNVNSVGVMGDNRTYENAICLRAVNASDGMTASFSFLEHSFLEKVSNRITNEVSGINRVVYDITSKPPGTIEWE

SEQ ID NO: 72866 - protein, 406 aa, Escherichia coli K12
MIFSVDKVRADFPVLSREVNGLPLAYLDSAASAQKPSQVIDAEAEFYRHGYAAVHRGIHTLSAQATEKMENVRKRASLFINARSAEELVFVRGTTEGINLVANSWGNSNVRAGDNIIISQMEHHANIVPWQMLCARVGAELRVIPLNPDGTLQLETLPTLFDEKTRLLAITHVSNVLGTENPLAEMITLAHQHGAKVLVDGAQAVMHHPVDVQALDCDFYVFSGHKLYGPTGIGILYVKEALLQEMPPWEGGGSMIATVSLSEGTTWTKAPWRFEAGTPNTGGIIGLGAALEYVSALGLNNIAEYEQNLMHYALSQLESVPDLTLYGPQNRLGVIAFNLGKHHAYDVGSFLDNYGIAVRTGHHCAMPLMAYYNVPAMCRASLAMYNTHEEVDRLVTGLQRIHRLLG

SEQ ID NO: 72867 - protein, 183 aa, Picea sitchensis
MSSPSKRREMDVIKLMMGDYKVEMINDGMNEFYVEFNGPRDSPYQGGVWKIRVELPDAYPYKSPSIGFVNKIFHPNVDEMSGSVCLDVINQTWSPMFDLVNVFEVFLPQLLLYPNPTDPLNGEAAALMMRDRQVYEQKVKEYCARYAKPKDVGKQEEEESSDEEVSEDEYGSSDEEVAGHADP

SEQ ID NO: 72868 - protein, 220 aa, Oryza sativa Indica Group
MSDAQAQPIRPGDVYPPSAADHHQARRERDKAVAADQGGGGGDLRVTEADLPAAGKRVVTATAGGQVMAQFTVPVPSAEEETTDAVTIGEALQAAGSDDNEPVGLADAAAVQAAEMRATGLAGVVPGGVAAAAQQAAEANMRRRPDGDDGENKATTTTLMKDVVGGAAEALPADMVATREDADRVAAAAARNAARRGGGGGKGVAEAVAAAAEMNEGRMV

SEQ ID NO: 72869 - protein, 102 aa, Arabidopsis thaliana
  misc_feature (12)..(12): Xaa can be any naturally occurring amino acid
  misc_feature (32)..(32): Xaa can be any naturally occurring amino acid
  misc_feature (38)..(38): Xaa can be any naturally occurring amino acid
  misc_feature (44)..(44): Xaa can be any naturally occurring amino acid
  misc_feature (47)..(47): Xaa can be any naturally occurring amino acid
  misc_feature (49)..(49): Xaa can be any naturally occurring amino acid
  misc_feature (61)..(63): Xaa can be any naturally occurring amino acid
  misc_feature (65)..(66): Xaa can be any naturally occurring amino acid
WLSSMLSSAAGXTSPAQATMVAPFTGLKSSAXFPVTRXTTKALXTPXAXNGGRVSCMKGVXXXIXXKKFETLSYLPGPAGQASRPFLQQGGFLGSGYLFTLF

SEQ ID NO: 72870 - protein, 450 aa, Synechococcus sp. RS9916
MITQDGGNRAGLGSQCSANLNTATQAAWMPWHPHLWHPTTQVALHPEPLRVSSAKGAVLQRDDGSSLIDAISSWWVTLHGHSEPSIAAAIAKQAQVMEQVIFANFSHSPAEQLATRLAAHSGLERLFFSDNGSTAVEVALKIAWQFWRNQNNERRQLIAFEGAYHGDTFGAMALGDRSIFTEPYDPLLFDVARVPWPHTHWGDDDVETREAEALKALEAALAIPTAAVILEPLIQGASGMRMVRPEFLRGVEALVRAHGALIIADEVMTGFGRTGALFACQRAGIQPDLMALSKGLTGGFLPMGGTLASEALYQGFISEEPLKTFFHGHSFTANPLGCAAALASLALLEQNPKRFEDFEARHTQHLQTLASLPQVKDVRCQGTMAAFELKCGSTSYLNPVGRQLQKLCLQRGVYIRPLGNVVYLLPPLCISDDQLSNCYRAIGDGIPQIA

SEQ ID NO: 72871 - protein, 322 aa, Prochlorococcus marinus str. MIT 9515
MEIASDITSLVGNTPLVKLDRIKDYCKCHTEIIAKLESFNPSASVKDRIAYSMLNSAEEDGLILPGKTTLIEATSGNTGIALAMVAAAKGYRLILTMPDTMSIERRAMLRAYGAELQLTPGTEGMRGALELANELSSSIPNSFQFNQFENLANPEIHERTTAKEIWDQSNQNIDGLVSGVGTGGTITGCARFLKKVNPNCKIYAVEPAKSAVISGEKPSSHSIQGIGAGFIPKVLNTQLIDEIIKIDDDDAFYYGRLLARLEGLLSGISSGAALAAAIKIGKRKEFIKKRLIVILPSFGERYLSTAMFESNTVVQARQDGYL

SEQ ID NO: 72872 - protein, 483 aa, Gluconobacter oxydans 621H
MSLKRPLPSAEVSKARKAGMMQDFDLFVIGAGSGGVRCARIAAQNGARVAIAERRHWGGTCVNLGCVPKKLMVYAAEYGREIADAPSYGWDVKPVAHDWSTLISAKDREIERLNRIYVSMLEKAGVTLFTGDASFVDAHTVEIGPSELAPDASVQRVRAKNIVIATGSTPTRLNIPGAEHAIVSDDAFHLADRPERVAVIGSGYIGIEFAGIFAGLGSKVDLVFRQQLPLRGFDHEMRAHLSELLPLNGIKAHPGRSPERIEKVADGYRLHLEGGDVIETDCVFMATGRHPNLAPLKLGNAGVATWDGRIPAKPDDATTNVAGIYAIGDVTDTYNLTPTAIAEGHILAERLFGEPGREWSFATTPKAVFFSQPLATVGLSEEEAVQSHDVDIYTSSFTPMRQTLSGRKGKTLMKLVVDAKSKIVLGAHMIGPDAPEIIQGLAIAITAKLTKRDFDRTIGLHPTSAEEFVTMRSLTRHVPRKAG

SEQ ID NO: 72873 - protein, 207 aa, Photorhabdus luminescens subsp. laumondii TTO1
MSYSDKRDQYAPHMALVPMVVEQTTRGERSYDIYSRLLKERIIFLTGQVEDHMANLVAAQMLFLEAENPEKDIFLYINSPGGVITAGMSIYDTMQFIKPDVSTICMGQACSMGAFLLTAGAKGKRICLPNSRVMIHQPLGGFQGQATDIEIHAQEILKVKSRMNELMAKHTGRPIEEIAKDTERDRFLSADEAVEYGLVDKIFTHRD

SEQ ID NO: 72874 - protein, 408 aa, Zea mays
MDMAIDTPSPAPPTPPAPSAAAGRQTRAAEAVRLEHQLVRVPLESLRATVRSNHRLAEKEIAAVLSSASAAPAESSAAAVDHLTSLVSRLHGLKRKMEEGARAEELQVQRCRARLDRLATASTGDDAEWEDMRLKRILVDYMLRMSYYNSATKLAETSGIQDLVDIDVFLDAKRVIDSLQNNEVSPALAWCAENKSRLKKSKSKLEFLLRLQEFVEFVKVKNFIQAIAYARKHLAPWGSVHMKELQRVTATLVFRSNTNCTPYKILFEQDRWDYLVDIFKQDFCKLYGMTLEPLLNIYLQAGLTALKTPYPRMFCSEGSCPKEDPLSLEGFRKLAEPLPFSKQHHSKLVCYITKELMDTENPPQVLPNGYVYSEKALQEMSKKNDGKITCPRTGDVYDVSECVRAFIS

SEQ ID NO: 72875 - protein, 228 aa, Arabidopsis thaliana
MTHRIAPRCFSTIMLLCLLYTSPLDVIAQGQGGQGDIPVVNPTAPGGSTTTPTITQPSPPSLTFPGPTTPTGGYPPLDGTTPTGGYPPLYGTTPPGGGDVGGGGGGYGGGTPGGGGGGGGDTGAGAGGGGYGGGGDTGAGGGVGSGQWCIAKANASPTSLQVALDYACGYGGADCGQIQQGAACYEPNTIRDHASFAFNSYYQKHPGSDSCNFGGAAQLTSTDPSKTS

SEQ ID NO: 72876 - protein, 453 aa, Oryza sativa Japonica Group
MHSTGMEMEVEVAGDDEAVPEAPERSVVLISAGASHSVALLSGGVVCSWGRGEDGQLGHGDAEDRPVPTVLTAAFDDAPGGVASVVICGADHTTAYSDEELQLYSWGWGDFGRLGHGNSSDVFNPQPIQALQGVRITQIACGDSHCLAVTVAGHVHSWGRNQNGQLGLGNTEDSLLPQKIQAFEGVRVKMIAAGAEHTAAVTEDGDLYGWGWGRYGNLGLGDRDDRLIPEKVSSVNGQKMVLVACGWRHTITVSSSGSIYTYGWSKYGQLGHGDFEDHLVPHKLEALKDTTISQISGGWRHTMALAADGKLYGWGWNKFGQVGVGDNEDHCSPVQVNFPNEQKVVQVACGWRHTLALTEAKNVFSWGRGTSGQLGHGEIVDRNIPKMIDALSSDGSACKQLESSKAVPMSAKVWVSPSERYAIVPDEKAGKGIPAGNGTETHVPQGDVKRMRV

SEQ ID NO: 72877 - protein, 602 aa, Oryza sativa Japonica Group
MAAAATAAAAATSTFTAAVPRARGRRHPTRVAAAAAATASSPEAAMAAAAPPLPMMRVAPETLQRQSGYLVRGRGEEGIGEGEAEAVGGDAAGGLGAMEYLTSVLSSKVYDVAIESPLQLATKLSERLGVNLWIKREDLQPVFSFKLRGAYNMMAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEVKIIGVEPSDANAMALSLCHGQRVMLEQVGGFADGVAVKVVGEETFRLCRELVDGIVLVSRDAICASIKDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQGETGANVLVGIQVPPEEFDEFKSRADNLGYEYMSEQNNEIYRLLLRDPKI

SEQ ID NO: 72878 - protein, 95 aa, Brassica napus
MGLLCSRSRHHTEDTDENAQAAEIERRIEQEAKAEKHIRKLLLLGAGESGKSTIFKQIKLLFQTGFDEGELKSYVPVIHANVYQTIKLLHDGTNE

SEQ ID NO: 72879 - protein, 558 aa, Rhodobacter sphaeroides 2.4.1
MAFGVPRAAARRLRLTRPPASGPLMKLSSRVLPSSETFRANRAHHLALIAETAEAAAWAAAGGGPAAQARHAARGKLPPRERVAGLLDPGSPFLEIGAFAAHGLYDGAAPAAGVIAGIGRVHGQEVMVVCNDATVKGGTYYPMTVKKHLRAQEIAAECRLPCVYLVDSGGANLPNQDEVFPDRDHFGRIFYNQAQMSAAGIPQIAVVMGSCTAGGAYVPAMSDVTIIVRNQGTIFLAGPPLVKAATGQVVSAEDLGGGEVHTRLSGVADYLAEDDAHALALARRALGQLNRTRPETVAWAAPEDPAHDPEEILGLVPADLRTPWDIRELIARLVDGSRFDEFKPRFGETLVTGFAHLMGCPVGIVANNGVLFSEAAIKGAHFVELCSQRSIPLIFLQNITGFMVGRRYENEGIARHGAKMVTAVATTAVPKITLLVGGSFGAGNYGMAGRAYSPRFLWTWPNSRISVMGGEQAAGVLATVRRDAIERQGGHWSAEEEAAFKRPTIEMFERQSHPLHASARLWDDGIVDPRKSRETLFLSLSAALNAPIAPTRFGLFRM

SEQ ID NO: 72880 - protein, 336 aa, Arabidopsis thaliana
MGSTFRDRTVELHSLSQTLKKIGAIPSVHQDEDDPASSKRSSPGSEFNKKASRIGLGIKETSQKITRLAKLAKQSTIFNDRTVEIQELTVLIRNDITGLNMALSDLQTLQNMELADGNYSQDQVGHYTAVCDDLKARLMGATKQLQDVLTTRSENMKAHENRKQLFSTKNAVDSPPQNNAKSVPEPPPWSSSSNPFGNLQQPLLPPLNTGAPPGSQLRRRSAIENAPSQQMEMSLLQQTVPKQENYSQSRAVALHSVESRITELSGIFPQLATMVTQQGELAIRIDDNMDESLVNVEGARSALLQHLTRISSNRWLMMKIFAVIILFLIVFLFFVA

SEQ ID NO: 72881 - protein, 232 aa, Saccharomyces cerevisiae YJM789
MSLFEWVFGKNVTPQERLKKNQRALERTQRELEREKRKLELQDKKLVSEIKKSAKNGQVAAAKVQAKDLVRTRNYIQKFDNMKAQLQAISLRIQAVRSSDQMTRSMSEATGLLAGMNRTMNLPQLQRISMEFEKQSDLMGQRQEFMDEAIDNVMGDEVDEDEEADEIVNKVLDEIGVDLNSQLQSTPQNLVSNAPIAETAMGIAEPIGAGSEFHGNPDDDLQARLNTLKKQT

SEQ ID NO: 72882 - protein, 498 aa, Saccharum hybrid cultivar SP-80-3280
MRTNPTTSRPGVSTIEEKSVGRIDQIIGPVLDITFPPGKLPNIYNALIVKSRDTADKQINVTCEVQQLLGNNRVRAVAMSATDGLMRGMEVIDTGTPLSVPVGGATLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAINLEEESKLKK

SEQ ID NO: 72883 - protein, 147 aa, Populus trichocarpa
MASIYLSICSTSKPLAAPPKSAGRTTASASSSSSCFKSQFCGWFLAGRLVCSGSRKQKKQMQVVSMAPDEEKLTRRSPLDFPIEWERPKPGSRPDIFPQFSPMKTPIPPPLPYDPPEEDEEEEEEKKKEEEEEDPEKEEEPDKPEKQ

SEQ ID NO: 72884 - protein, 180 aa, Buchnera aphidicola str. Sg (Schizaphis graminum)
MNLNLIKAGNNIPSDIYVIIEISSNSSPIKYEVDKQSGVLFVDRFIPTPMFYPCNYGYINETLSLDGDPLDVLVPSPYPIQSNVVINCKPVGILKMHDESGNDAKIIAVPNDKVSKEYENINDISDISELLKKQISHFFQYYKTLEKEKWVEIIGWGDHHEAKLEIKNSYDRAKKNTSLK

SEQ ID NO: 72885 - protein, 482 aa, Ralstonia metallidurans CH34
MTETYRNYIDGEWCDSASGRTVDNVNPADTRDIVSRHAASDARDAAAAVAAAAAAFDGWKKTPIGKRAKILNDAAAHLEANADTIATELTREEGKALNLARDEVMRSAQTLRFYAVEGQTFSGESYPNDDPDMLVYSLREPLGVVTVISPWNFPVSIPARKIAPALITGNTVVFKPSSDAPLSGYRLAEAFVRAGIPKGVLNFLTGSAAEVGPTIVESREVRAVSFTGSTSAGEQIHKSVPMTTRTQMELGGKNPLIVMEDADLDRAVDLAVKGGLSLSGQACTGTSRILVMRDVKQAFTEKLVAKVKALKIGSGMTAGMDLGPLATRKQLETVLSYIAIGKQEATLLCGGEQLSDGDFAHGYYVAPTVFTDVTQSMRIAREEIFGPVLAIIEVDSYADAIAQANDTEYGLSAAIATRNPRYMHDFTRDIESGTVKINRTTTGNLVNAPFGGLKRSSTSTFRESGRAGLEFYTQIKTVYQGI

SEQ ID NO: 72886 - protein, 343 aa, Photobacterium sp. SKA34
MKIKALSKLKPEEGIWMTEVDKPEVGHNDLLIRIKKTAICGTDVHIYNWDEWSQKTIPVPMVVGHEYVGEVVGMGQEVRGFAIGDRVSGEGHITCGHCRNCRGGRTHLCRNTIGVGVNREGAFAEYLVIPAFNAFKIPDDISDDVASIFDPFGNAVHTALSFDLVGEDVLITGAGPIGIMAAAVAKHVGARHVVITDVNEYRLDLAREMGVTRAINVAKESLTDVMAELGMKEGFDVGMEMSGNPAAFNSMLSSMNHGGKIALLGIPPSDMAIDWNQVIFKGLIIKGIYGREMFETWYKMATLIQSGLDLSPIITHHYKIDDFQEGFDVMRSGQSGKVILDWE

SEQ ID NO: 72887 - protein, 70 aa, Arabidopsis thaliana
  misc_feature (12)..(12): Xaa can be any naturally occurring amino acid
  misc_feature (33)..(33): Xaa can be any naturally occurring amino acid
  misc_feature (36)..(36): Xaa can be any naturally occurring amino acid
  misc_feature (52)..(52): Xaa can be any naturally occurring amino acid
TITSSILSSATXISSPPQPTMVSPFNRLKSSPXFPXTLNANNNITSITSNRXRVHCLHVSPPIVKTTSNT

SEQ ID NO: 72888 - protein, 353 aa, Synechococcus sp. RS9916
MAKRAVCAPRVLCLGEALVDRLGPLGGDPATATPAECDDRLGGAPANVACALARLGTPVAFLGRLGDDAIGSSFQELLRNRGVDLRGLQTDMQRPSRVVLVRRDANGERVFQGFAGERGQDFADQGLDHRQLALAWPALAPSARWLLVGTIPLATPASTDALLWAIEQVDHSGLRLALDVNWRPTFWDPQADPAAGPAPEQLATMAPLLDRASLIKLAKEEAIWLFNSANPEAISACLPTHPDVVVTDGGNPVQWCIAGHAGTMDVLPPPRVVDTTGAGDAFTAGLLHQLLALTPAGGSPLELSAAVVQQVIRYAAACGALVCAGAGGIDPQPSACDVEHFLQHSAPMATGLR

SEQ ID NO: 72889 - protein, 269 aa, Anabaena variabilis ATCC 29413
MSFRNKTIVLTGASAGIGRTLAISLSQQDANLVLAARNSEALEQTMTACTNYPGKVIAVPTDVTQAEACQQLIEIAIATFGQIDILINNAGIGMLTRFDEVTDISIFEQVMQVNYLGAVYCTHYALPYLKASQGQLVAISSICGKTGVPTRTGYVASKHAMQGFFDTLRIELHSTGVDVLVVSPGFVATDIRQRALGADGKPLGKSPRDETQGNMSVDECVRQIIWAMERRKREHIMTLKGKAIPWAKLIAPGFVDRIVAATIRKTTST

SEQ ID NO: 72890 - protein, 840 aa, Arabidopsis thaliana
MANISEISGDSNDGGDPNKKPEEQVLRRSRRIATRNENQNKKPKEEEEKDNRSVSFPIPNELTEACVALIRKCDYPSLSSVSSYFFNLIASSELYETRSRLGLSETFLYAAIRFPDTNPPNWYILHRNKVSSLRLSKLESLPPVPYGCSVVTIGQEMYVIGGLLDVRRLQLMTLIDCRTHKCRSLPKMKRGRYHAAAGVFDGKIYVIGGFRMRKPDAEWIEVFDLKKQIWESLPGPYPKTSMDSQFFAHAVMEDKLYILGSRCLIYEPKRNGEWDATVNANPIWNLWKVPCTMQCVIDDMLYTIDPQCTLGHPIVVYNPKDKTWRPVKGESLRTLPSYFVSDGSEMANFGGKLVILGSNGSCYDTGDCIGEKGIWIFITQESRVTRSLLTFVKKIQMKLWVYKYPNTFLKNQIRLCFHYFSLLTLHTTMVNISEIPDDSNDGCDPNKKPEEQVLRRSRRIATRNENQNKKPKEEEEEDNRSVSFPIPNELTEACVALIRKCDYPSLSSVSSYFFNLIASSGLYETRSRLGLSETFLYAAIKFPDTNPANWYILHRNKVSSLRLTEVGSLPPVPWGCSVVTVGQEMYVIGGLLDIRRLQLMTLIDCRTHKCRSLPSMKRGRYKAAAGVVDGKIYVIGGFRMRKPDAEWIEVFDLKTQIWESLPGPYPRTSAGSQFSAHAVMEDKLYMLGSKFCLVYEPKRNGEWDASVGATPLKDLWDKTCCVVDDMLYTTDPRRTLGHPIVVYHPKDKTWRPVKGESLWSLPSYFFSKSEMANFGGKLVILGSNKSYVTGDCIGEKGIWCVMIELEKREGGEIWGKVESLDCVLGDINFLSVRLCQTLTI

SEQ ID NO: 72891 - protein, 566 aa, Buchnera aphidicola (Schizaphis graminum)
MKKDYKKVFLKNTKEERIKENSNYLRGTIIDDLKDEITNGFTGDNFSLIRFHGMYQDDRDLRLERNEQKLEPRYAMMLRCRLPRGIIKAKKWLKIDHFASKNTLYGTIRLNNLQTFQFHGILKKTLKDAHKMLNKIGLDSLGTANDVNRNVLCTSNPMESLIHQQCYEWVSKISNFLLPQTKAYAEIWLNQKKIATTDQEPILGKTYLPRKFKTTVVVPPYNDVDLYANDMNFIAITKNNKIVGFNVLIGGGLSINHGNKNTWPFLAVELGYITLEKTLSVAESIVTTQRDWGNRTDRKNAKTRYTIAKVGLSVFKKEVEKRANMTFETIKPYYFISRGDRFGWTKNINNDWSLTVFIQNGRIYDNDKQLVKSGLLKIANLHTGNFRLTANQNIVISEILDKNKKKIEEIAISHGLIKKVSSLRENSMACVSFPTCPLAIAESERILSFFITKVENIMLKYGIEKEIIILRISGCPNGCGRSLLAEIGLIGKSLGRYNLYIGGNRIGSRIPKIYKENITEQEILIHLDFLIKIWSIERQKKEHFGDFVIRRNVVKKVVNPIYDFWN

SEQ ID NO: 72892 - protein, 288 aa, Thiocapsa roseopersicina
MDPTTRIEQALAAALESVTTSACPPRLAEAVRHAVFPGGARVRPRLCLAVAAACGSRDVEAADAAGASIELLHCASLVHDDLPCFDDSPLRRGLPSVHRAYGEPLAVLAGDALIVLAFENLARVLGNSPERLAPLLMTVSRAVGMPSGIVAGQAWECEPKVSVADYHRAKTGALFAAATAAGAQVAGADADAWRVVGDKIGEAYQVADDLRDVAASAQEVGKPVGRDAVLNRPSAAGELGVDGAVALLRGLVKGAIDAIPPCPGSAQLAEVLMSESRHIMPKGLADRA

SEQ ID NO: 72893 - protein, 139 aa, Oryza sativa Indica Group
MAATALSSQVRLPMSLRVATAPAPARVSVLPANNKLGNRLRMQATYNVKLITPDGEVELQVPDNVFILDQAEEEGIDLPYSCRAGSCSSCAGKVVSGEINQSDQNFLHNNQVAAGWVLTCHANPKSDVVIETHKEDDLT

SEQ ID NO: 72894 - protein, 467 aa, Aphanothece halophytica
MIFDQLISRSVITDIIPFSLLATAEEETAQADGSLILASVLLSLVAIYIASKIGGELCSRINLPPVLGELVGGVVIGVSVLGLLVFPETGATAEDSLIMTFLEKTTDLEPGTAEAVFEAQGEVITILSELGVVILLFEIGLESDLKELLRVGPQAAAVAVTGVIAPFVGGTAGLYYGFGVPAIPAVFAGAALTATSIGITAKVLAELGRLNSKEGQIIIGAAVIDDVLGIIVLAVVASLIKTGNIEVSNIIYLVVSAGAFLVGTILVGRFISPFLVGMVNEMKTRGELLLTSLVFAFALAYIATAINLEAILGAFAAGLVLAETEKRKELEEQVVPVADILVPVFFVCVGARTDLGVLNPTVPSNREGLILAAFLIVVAIIGKIIAGFTIFGRPDINKLAIGVGMIPRGEVGLVFAGVGSASGALSPATEAAIIVMVILTTFVAPPFLRVVLPEAAETEAETSKQEG

SEQ ID NO: 72895 - protein, 549 aa, Mesembryanthemum crystallinum
MSILGFDTSRLAPSSLHDASPTETSVVVSISVFFSLICLCIVIGHLLEKNRWANESIASLLLGLVSGAIVLVLSKGQSSRILVFNEELFFIYLLPPIIFNAGFQVKKKQFFKNFSFILMFGVLGTIISFCLISSGAVLLLKKIGLTQLNLNDYLALGAIFSATDSVCTLQVLNQDETPLLYSIVFGEGVVNDATSIVLFNAVQSLDLSNLSSMTALALLGTFLYLFFTSTILGILVGLLSAYVIKKLYMGRHSTDREIALMMLMAYLSYMIAELMNLSGILTVFFCGIVMSHYTWHNVTESSRITAQHAFATMSFISETFIFLYVGMDTLDIDKWKGSNSSAGTFLAVSSTLMLLVLIGRAAFVFPLANILNFIKKKEEHKIGFRKQFIIWWAGLMRGAVTVALSYNAFSSSGETSNERSLMITCTIIVVRFSTVLFGSVTKHLIGALVGVQNRMHSDLSDVNIESLENLNIPFLEVPGYGNDNDDDDADSSQRRPWLLRLLMRYPHPTVHYIWRKFDDKFMRPVFGGRGFVTYEPATPTGAADPIIEQ

SEQ ID NO: 72896 - protein, 151 aa, uncultured crenarchaeote
IFYHNQLASGVIPQITASIGPSAGGAVYSPAMTDFVIMVDKLGTMFVTGPDVVKTVLGEEVSFDELGGAMTHGTKSGVAHFVVKNEYECMDYIKTLLSYIPQNNTEEPSTVQNDDDPNRLDHNLINLLPEDTLKPYDMKGVIQSIVDNHNF

SEQ ID NO: 72897 - protein, 467 aa, Aphanothece halophytica
MTALQTIFQHSLSLNLESGLPLLATASETTASEADTTIILAGVLLSLVFIYFASKLGGELSKLVDLPPVLGELVAGVIVGISALHLVIFPETGAMASDSVVITILQQVVGLQPENASAVFASQSEVISVLAELGVIILLFEIGLESDLRELQKVGTRAAIVAVIGVVAPFIGGTAGLMLLFGMPTIPAVFAGAALTATSIGITSKVLSELGQLKSKEGQIIVGAAVIDDVLGIIVLAVVASLAKTGEVDVLNLVYLIVSASAFLLGSIFLGKFFNKSFVAIAQKLQTRGNLVIPALIFAFLMAFLANAIQLEAILGAFAAGLVLDETDKRKELDQQIIPIADILVPIFFVSVGARVDLSVLNPTSAENRQGLIIAAFLIVVAIIGKIISGWAIFGKEKVNRLAIGIGMIPRGEVGLVFAGIGAASGILDKPLQAAVIIMVILTTFIAPPLLRFAFKEEAEIVEETGS

SEQ ID NO: 72898 - protein, 407 aa, Zea mays
MAAALQATPLKTLSISRRRVGGAGARPRPMAASFRCSAAARSYNITLLPGDGIGPEVVAVAKDVLSLAGALEGVELRFQEKLVGGSALDATGVPLPDETLDAAKGSDAVLLGAIGGYKWDNNEKHLKPETGLLQLRAGLGVFANLRPAAVLPQLVDASTLKKEVAEGVDIMVVRELTGGIYFGKPRGFGTNDNGDDIGFNTEVYSASEIDRIARVAFEVARKRRGRLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAANRIEAAVTETLNHGFRTGDIYSPGTTLVGCKRMGEEVLKTVNSLKEVAAVN

SEQ ID NO: 72899 - protein, 151 aa, uncultured crenarchaeote
IFYHNQLASGVVPQITVSIGPSAGGAVYSPAMTDFVIMVDKLGTMFVTGPDVVRTVLGEEVSFDELGGAMTHGTKSGVAHFVVKNEYECMDYIKTLLSYIPQNNTEDPLTVQNDDDPNRLDHNLINLLPDDSLKPYDMKEIINSIVDNHNF

SEQ ID NO: 72900 - protein, 283 aa, Bacillus licheniformis ATCC 14580
MLKIFNQKNVAFIGAGSMAEGMISGIVQSKKLPASQIYVTNHTNHRRLEELQQKYGIQGVKKEQLDYQNIDCFILAMKPKDAEGALNSMKPHIKPHQLIVSVLAGISISFIENTLHDMQPVIRIMPNTSSAIGASATAMAEGSHVTADLSKTAKQLLQCMGEVYSIEESKMDIFTGIAGSGPAYFYYLMEHIEKAGAEAGLSQKLTREIGAQTLLGAAKMLLESPEDTAVLKDNITSPNGTTAAGLKALEESGGGEAIEQAVKQAAKRSKTISLELEQLVAAK

SEQ ID NO: 72901 - protein, 151 aa, uncultured crenarchaeote
IFYHNQLASGVVPQITASIGPSAGGAVYSPAMTDFVIMVDKLGTMFVTGPDVVKTVLGEDVSFDELGGAMTHGTKSGVAHFVVKNEYECMDYIKTLLSYIPQNNTEEPLTVQNDDDPNRLDHNLINIIPEDSLKPYDMKEIIHSMVDNHNF

SEQ ID NO: 72902 - protein, 380 aa, Vitis vinifera
  misc_feature (235)..(235): Xaa can be any naturally occurring amino acid
MSGTAGQVICCKAAVAWEAGKPLVIEEVEVAPPQAMEVRLKILYTSLCHTDVYFWEAKGQTPLFPRIFGHEAGGIVESVGEGVTDLKPGDHVLPIFTGECKDCAHCKSEESNLCDLLRINTDRGVMIHDGKSRFTIKGKPVYHFLGTSTFSEYTVVHVGCVAKINPLAPLDKVCVLSCGISTGLGATLNVAKPTKGSTVAVFGLGAVGLAAAEGARIAGASRIIGVDLNPKRYEXAKKFGVTDFVNPKDHEKSVQEVIVEMTGGGVDRSLECTGNVNAMISAFECVHDGWGVAVIVGVPNKDDVFKTHPINLLNERTLKGTFFGNYKPRSDIPAVVEKYMNKELEVEKFITHSVPFSEINKAFEYMLNGEGLRCIIHMEP

SEQ ID NO: 72903 - protein, 151 aa, uncultured crenarchaeote
IFYHNQLASGVVPQITASIGPSAGGAVYSPAMTDFVIMVDKLATMFVTGPDVVKTVLGEEVSFDELGGAMTHGTKSGVAHFVAQNEYECMDYIKTLLSYIPQNNTEEPSIVSNDDDPNRLDHNLISMIPEDSLKPYDMKDIIHSIVDNHNF

SEQ ID NO: 72904 - protein, 144 aa, Nicotiana tabacum
MASISGTMVSTSFLPRKPVVTSLKAIPNVGQALFGLKSERGGRITCMASYKVKLITPEGTVEFDCPDDVYILDQAEEEGHELPYSCRAGSCSSCAGKVTGGNVDQSDGNFLDDDQMADGFVLTCVAYPQSDVTIETHKEEELTG

SEQ ID NO: 72905 - protein, 279 aa, Oryza sativa Japonica Group
MGYAQLVIGPAGSGKSTYCSSLYQHCETVGRTIHMVNLDPAAEHFSYPVSTDIRELISLDDVMEELGMGPNGGLIYCMELLKLLTDPSENHRHLEDNLDDWLDEQLEGYLDDDYLVFDCPGQIELFTHVPVLRNFVEHLKRKNFNVCAVYLLDSQFVSDVTKYISGCMASLSAMIQLELPHINILSKMDLVSNKKDVEEYLNPEAQVLLSQLNRQMAPNFGKLNKSLAELVDDYSMVNFIPLDLRKESSIQYVLSHIDNCIQYGEDADVKVRDFDPEED

SEQ ID NO: 72906 - protein, 108 aa, Frankia sp. CcI3
MAGSTTPVTDSTFVTEVLESDKPVLVDFWAEWCGPCKMVAPVLEEIAKEHGEKLRVVKLNIDENPETARNYQIMSIPTMAVFVKGVIDKSIVGAKPKAALLRDLSVYI

SEQ ID NO: 72907 - protein, 276 aa, Vitis vinifera
  misc_feature (58)..(58): Xaa can be any naturally occurring amino acid
MAGAIEVDWRDFFPYLSWIPNKSMEMKIQRMDFRRGALMKALIGEQKKRIGSGEEKNXYIDFLLSEATTLTEKQIAMLIWETIIEISDTTLVTSEWAMYELAKDPNRQEILYREIRKFCGSNKVTEENLSKLPYLNSVFHETLRKYSPAPIVPVRYAHEDTQLGGYHIPAGSQIAINIYGCNMNKKQWENPEEWKPERFLDEKYDLMDLHKTMAFGGGKRVCAGALQAMLIACTSIGRFVQEFEWKLMGGEEENVDTVALTSQKLHPMQAIIKARE

SEQ ID NO: 72908 - protein, 439 aa, Oryza sativa Japonica Group
MRVLPLALAAAIFSGVTAILVYLSGLSSYGGARVSDADLAALGALQSGFSKCVDANGLGLKAIPGEDYCRVVIQYPSDTDSKWKDPKTGEPEGLSFEFNLCEAVASWEQVRNSTTILTKEYIDALPNGWEEYAWRRINKGIHLNKCQNRTLCMEKLSLVLPETPPYVPRQFGRCAVVGNSGDLLKTKFGDEIDSYDVVIRENGAPIQNYTEYVGTKSTFRLLNRGSAKALDKVVELDETKKEALIVKTTIHDIMNQMIREIPITNPVYLMLGTSFGSSAKGTGLKALEFALSMCDSVDMYGFTVDPGYKEWTRYFSESRKGHTPLHGRAYYQMMECLGLVKIHSPMRGDPGRVVKWAPTKDTIEAARVASEKLLKRPGAGSEGPLSSCTMIKKREKGKTPKRSVVRHAALKHLEYMRGATRYPLERNAGGGYLCMINER

SEQ ID NO: 72909 - protein, 418 aa, Zea mays
  misc_feature (196)..(196): Xaa can be any naturally occurring amino acid
FFWGSIQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPXIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 72910 - protein, 138 aa, Glycine max
SAYFDRYGGGANSLACGYSRGTGLGAEIIGTFELGYTGFSATDPKRNARDSHVPVVAPLPIGFGGFMVHLATIPVTGTGINPARSLGAVVIYNKDKPWDDHWILWVGPIVGAGIGGFYHQYMLRAGASKAHGYFKSNA

SEQ ID NO: 72911 - protein, 144 aa, Arabidopsis thaliana
MIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 72912 - protein, 167 aa, Escherichia coli O157:H7 EDL933
MAHIEKQAGELQEKLIAVNRVSKTVKGGRIFSFTALTVVGDGNGRVGFGYGKAREVPAAIQKAMEKARRNMINVALNNGTLQHPVKGVHTGSRVFMQPASEGTGIIAGGAMRAVLEVAGVHNVLAKAYGSTNPINVVRATIDGLENMNSPEMVAAKRGKSVEEILGK

SEQ ID NO: 72913 - protein, 150 aa, Brassica napus
  misc_feature (148)..(148): Xaa can be any naturally occurring amino acid
MNALAATNRNFKLASRLLGLDSKLEQSLLIPFREIKVECTIPKDDGTLASFVGFRVQHDNARGPMKGGIRYHPEVEPDEVNALAQLMTWKTAVAKIPYGGAKGGIGCDTSELSISELERLTRVFTQKIHDLIGIHTDVPAPDMGTGSXTM

SEQ ID NO: 72914 - protein, 81 aa, Brassica napus
MPFYELTYFADRDSSQNAENTQKQEEKKKENNNMKHKKASSHVWDCGSSLYDSFELNSFKRQLDSAISAFSGRTMVMSHFP

SEQ ID NO: 72915 - protein, 587 aa, Rhodopirellula baltica SH 1
MPATGITLPSPSGPPLPCSAAIFVLDHRSRLPWPFPVSPLLFYTAALAFPAISGKNTMTSSANTTSPAIAETTWLTDQRILVLDFGSQYAQLIARRVREQNVYCQIVRHDISAERIAELAPKGIILSGGPNSVYEEGAPKCDEGLFDLGIPVLGICYGMQLACQALGGKVDNTPSREYGRAMCEFTDRDSIFRGMQESEQVWMSHGDQVSQIADQFTAMAKTSTCPYAAIRHNERPVFGMQFHPEVTHTPHGGQILRNFVIDVCGCDGSWKLGDFADAAIESIRKQVGNKRVICGLSGGVDSSVVAALLYKAIGPQLSCILVDNGLLRKNEQQIVLEEFSNHFKTDLHIVEAEDRFLADLAGIDEPQEKRRRIGHAFIECFKDEAAKIEDAHFLAQGTLYPDVIESGADKDGPAATIKLHHNVGGLPEELGFELIEPLRDLFKDEVRRLGLELGLPEQLVWRHPFPGPGLAVRCLGEITRDKLVVLREADAIVVEEIENAGLYRETSQAFAVLLPVQSVGVMGDARTYDNAVAVRCVNTDDFMTADWSHLPYELLARISTRIINEVKGVNRVCYDISSKPPATIEWE

SEQ ID NO: 72916 - protein, 346 aa, Mesorhizobium loti MAFF303099
MKAVVFEKFGEAPTIQTVPDPKPAADGVVIKVEATGLCRSDWHGWMGHDDGITLPHVPGHELAGVVVAAGKQVSRWKAGDRVTVPFAVGCGRCFECSSGNHQVCEHQTQPGFTGWGSFAEYVGIEHADTNLVRLPDEMEYATAASLGCRFVTSFRAIVDQGRVKPGEWVAVHGCGGVGLSAIMIASSMGANVIAIDLTDEKLEFARKIGAVATINASTTPNVVKAVKQIANGGAHMSMDALGHPTTSFNSIANLRRRGRHVQVGLMLGEHARPQVPMDKIIAFELEILGSHGMQAYRYQAMMDMIRNGKLKPELLVGKKISLDEAPAALMAMGGFEGIGIGVVTKF

SEQ ID NO: 72917 - protein, 792 aa, Escherichia coli K12
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 72918 - protein, 518 aa, Magnaporthe grisea 70-15
MSHTEPGQKTADAHLLWVAGKEKIGGGDICHTASAQDVDQCIEQANDAFIAGTWSKAPRHFRADVLDQAATLLSEQLSELIDLEVLQTGRAVREMKAQVPSLVKWFRYYAARLRVDERHVLPTTGSLHNWVDRVPLGVCALITPFNHPLLIAVKKVAPALAAGNSVVLKPSELTPITSLQLGRILRDAGLPEGVFSVLPGLGVETGKQLVSHRLVRKVDVTGSTAAGRAIGAIAGGNLARFNAELGGKAPLVVFETSDLDAAVNGIVFGAFVASGQTCVAVTRVLVHKSILGALTEKLSEKCNSIVRRIGDPKNPLSMMGPLISSKQLSGVQRLVDAAVASGNARLLCGGQRMSGVSPLDGFDLSKGYFFPPTVLCGTNPDGSNVCATDLWYEEAFGPVVVVASFQDEGHAVRLANDTSFGLGAGIWTRDLSQAFRVSEQIEAGIVWVNTHHRNDPSSPWGAHGTRSDSGLGTENGAEAYMAYTAPKSVVINYASTETALREEDWFREDQSGGAVRYG

SEQ ID NO: 72919 - protein, 628 aa, Triticum aestivum
  misc_feature (178)..(178): Xaa can be any naturally occurring amino acid
  misc_feature (183)..(183): Xaa can be any naturally occurring amino acid
  misc_feature (240)..(240): Xaa can be any naturally occurring amino acid
  misc_feature (451)..(451): Xaa can be any naturally occurring amino acid
MANASSISRSLRRSLAPDALHRLLLQRSRAFVTAECHRPVVLHKRGPDILHDPWFNRGTAFSMTERDRLGLRGLLPPSVVSSQQQIDRFMGDLKRLEQNARDGPSDTYQLAKWRILNRLHDRNETMYYKVLIDNIEEYAPIVYTPTVGAVCQNYSGLFRRPRGMYFSAEDRGEMMSMXVYNWXPADQVDMIVGDWMEARILGLGDLGVQGIGIAIGKLDLYVAAAGINPQRVLPVMIDVXGTNNEKLLKDPLYLGLQEHRLEGEEYVEIIDEFMEAVFSRWPNVIVQFEDFQSKWAFRLLQRYRKTYRMFNDDVQGTAGVAIAGLLGAVRAQGRPMIDFPKQKIVVAGAGSAGIGVVNAASRTMARMLGNNEVAFESARSQFWIVDAHGLITEERVDIDPDARPFARRKSELTHQGLNEGASLIEVVKKVKPDVILGLSAVGGLFSKEVLXALKDSSSSQTSNFLRCQIPTKNAECTPEEAFSIIGEKVVFSSGSPFDDVDLGDGKIGHSNQGNNMYLFPGIGLGTLLSGARIVSDGMLQAAAERLASYMKEEEVLQGIIYPPTSRIRDITKEVAAAVVREAVAEDLAEGYRDMDARELARLSEEETVDYVKNNMWNPVYPTVVYKKD

SEQ ID NO: 72920 - protein, 305 aa, Photorhabdus luminescens subsp. laumondii TTO1
MSEQNSTQFKEQLKICQQRVNNVLISTLSSVAFANNPLVHAMQHGTLLGGKRLRPFLVYAVGEMFGLSANNLDAPAAAVECIHAFSLIHDDLPAMDNDDLRRGQPTCHIKFGEAHAILAGDALQALAFEILSKREMPDVTTADRLEMVAELATASGIAGMCGGQALDLAAEGRHIDLHMLEQIHRHKTGALIRCAVRMGAYGAGQSGHDALPELDQYAQAIGLAFQVQDDILDVIGDTEMIGKRQGSDQQLGKSTYPALLGLEQAQKKAYELYQEALKALNKLEDKSYNTTMLRALASFIIERNN

SEQ ID NO: 72921 - protein, 621 aa, Photorhabdus luminescens subsp. laumondii TTO1
MSIDIAKYPTLALAENPEELRMLPKESLPKLCDELRQFLLNSVSRSSGHFASGLGTVELTVALHYVYKTPFDKLVWDVGHQAYPHKILTGRRDRIDTIRQKNGLHPFPWRDESEYDTLCVGHSSTSISAGLGMAIAAQREGKGRRTVCVIGDGAITAGMAFEAMNHAGDIDPDILVILNDNEMSISENVGALNNHLAQLLSGKLYTTLREGGKKVFSNLPPIKELLKKTEEHIKGMVVPGTLFEELGFNYIGPIDGHDVLTLTQTLKNMRELKGPQLLHIMTKKGRGYAPAEKDPISWHAVPKFDPTTGALPKSSDNRPTFSKIFGDWLCEEAANDKKLMAITPAMREGSGMVRFSREYPDQYFDVAIAEQHAVTFAAGLAIGGYRPIVAIYSTFLQRAYDQVIHDIAIQNLPVLFAIDRGGIVGADGQTHQGAFDLSFLRCIPNMVIMAPSDENECRQMLHTGYHYQQGPVAVRYPRGTGTGAEPQPFEQLPIGKGVIRRQGNKVAILNFGTLLPDAITAAESLDATVVDMRFVKPLDKELILDMADNHDLLVTLEENAIMGGAGSGVNELLMQKGRLVQILNIGLPDQFVPQGSQEEIKADLGLDAAGIQNSINKRLFS

SEQ ID NO: 72922 - protein, 454 aa, Streptomyces avermitilis MA-4680
MADRTPPLGVEELHALVAGGEIDTVVLAFPDMQGRLQGKRFAARFFLDEVLEHGTEGCNYLLAVDTDMNTVDGYDMSSWDRGYGDFAMHPDLSTLRQVPWNAGTALLIADLAWNDGSPVVAAPRQILRRQLDRLAALGYTAQVGTELEFIVFKDTYEQAWDAGYKGLTPANQYNIDYSVLGTGRIEPLLRRIRNEMQAAGLTVESAKGECNPGQHEIVFRYDEALVTCDQHAVYKTGAKEIAAQEGVSITFMAKYNEREGNSCHIHLSLADADGTNAMAGDGPGGMSDVMRHFLAGQLAALRDFSLLYAPNINSYKRFQPGSFAPTAVAWGYDNRTCALRVVGHGRSMRFENRLPGGDVNPHLAVAGLVAAGLYGIEHKLELPEACAGNAYAAEYEHVPTTLREAAELWENSPIAKAAFGDDVVAHYRNMARVELKAFDAAVTDWELRRSFERL

SEQ ID NO: 72923 - protein, 463 aa, Streptomyces avermitilis MA-4680
MRPHVSHPHELVVLDPATEEVVATVPAATPQDVDAAVVRASKAQVRWAALAPGERARLLRRFAVVVDEHLEELARLEVREAGHVIGNARWEAGNVRDLLDYAAGGVERLTGRQIPVPGGLDITILEPLGVVGVIAPWNFPMPIAAWGTAPALAAGNAVILKPAETTPLTALRLAELALEAGLPEHLFQVLPGAGPVAGNALVEHPGVAKIVFTGSTAVGKQVWAKGSALLKRVTLELGGKSPNIVFADADVEAAAAAAPMAFLDNSGQDCCARTRILVQRSVYDRFLALLAPAVESVAVGDPLDERTAMGPLISKVQLERVRSYVPAGAPALRGKAPEGPGFWFPPTVLTDVDPHAPVAVEEVFGPVAVVLPFEDEADAVRLANATEYGLAGSIWTRDVGRALRVSGAVRAGNLSVNSHSSVRYWTPFGGFKQSGIGRELGPDALTAFTETKNVFISTEGPAQ

SEQ ID NO: 72924 - protein, 151 aa, uncultured crenarchaeote
IFYHNQLASGVVPQITASIGPSAGGAVYSPAMTDFVIMVDKLGTMFVTGPDVVKTVLGEEVSFDELGGAMTHGTKSGVAHFVAQNEYECMDYIKTLLSYIPQNNTEEPSIVSNDDDPNRLDHNLISMVPEDALKPYDMKEIIHSIVDNHNF

SEQ ID NO: 72925 - protein, 151 aa, uncultured crenarchaeote
  misc_feature (104)..(104): Xaa can be any naturally occurring amino acid
IFYHNQLASGVVPQITASIGPSAGGAVYSPAMTDFVIMVDKLGTMFVTGPDVVKTVLGEEVSFDELGGAMTHGTKSGVAHFVVKNEYECMDYIKTLLSYIPQNXTEEPSTVQNDDDPNRLDHNLINVLPEDSLKPYDMKEIIHSMVDNHNF

SEQ ID NO: 72926 - protein, 320 aa, Candida albicans SC5314
MSTNSIKLLASDVHRGLAELVSKRLGLRLTPSELKRESTGEVQFSIGESVRDEDIFIICQIGSGEVNDRVFELMIMINACKTASARRITVILPNFPYARQDRKDKSRAPITAKLMADMLTTAGCDHVITMDLHASQIQGFFDVPVDNLYAEPSVVRYIKETIDYSEAIIISPDAGGAKRAAGLADRLDLNFALIHKERARANEVSRMVLVGDVTDKICVIVDDMADTCGTLAKAAEVLLDNNAKDVIAIVTHGILSGNAIKNINNSKLKKVVCTNTVPFEDKLKLCPKLDTIDISAVIAESIRRLHNGESISYLFKNAPL

SEQ ID NO: 72927 - protein, 120 aa, uncultured crenarchaeote
AMTDFVIMVDKLGTMFVTGPDVVKTVLGEEVSFDELGGAMTHGTKSGVAHFVVKNECECMDYIKTLLSYIPQNNTEDPLTVQNDDDPNRLDHNLINLLPDDSLKPYDMKEIINSIVDNHN

SEQ ID NO: 72928 - protein, 121 aa, uncultured crenarchaeote
AMTDFVIMVDKLGTMFVTGPDVVKTVLGEEVSFDELGGAMTHGTKSGVAHFVVKNEYECMDYIKTILSSIPQNNTEEPSTVQNGDDPNRLDHNLINLLPEDTLKPYDMKGIIHSIVDNHNF

SEQ ID NO: 72929 - protein, 132 aa, uncultured crenarchaeote
AMTDFVIMVDKLGTMFVTGPDVVKTVLGEEVSFDELGGAMTHGTKSGVAHFVAQNEYECMDYIKTLLSYIPQNNTEEPSIVSNDDDPNRLDHNLISMIPEDSLKPYDMKEIIHSIVDNHNFFEVHELFAQNI

SEQ ID NO: 72930 - protein, 134 aa, Zea mays
  misc_feature (32)..(32): Xaa can be any naturally occurring amino acid
GGAGSQAVFNQAISLPGGRVPGEEATKYARIXQKLGFPAKFKDFKIQNINIVRSCDVKSPIRLEGLAYSHGAFSSYETELFSGLIYRMKRQKIMLLIFVSGKIVLTRAKVRDETYTAFENIYPVLTKFRKVRQC

SEQ ID NO: 72931 - protein, 479 aa, Anaplasma phagocytophilum HZ
MNQDSGCEGVGEVVRVMPAVVDVEFAHGGLPDILHALKSEKDYQGKQLVLEVAQHLGDGVVRCVAMGSTDGLSRGDKFINTGSPISVPVGRKTLGRVFDVLGEPIDGVGDVGADVEYHSIHAHAPKLSEQKVATEVLVTGIKVIDLLAPYLKGGKVGLFGGAGVGKTVLIMELISNIARAHKGFSVFAGVGERTREGNDLYREMVESGVINEDEREKSQAVLVYGQMNEPPGARMRVALSALTMAEYFRDAEGQDVLFFVDNVFRFTQSGSEVSALLGRVPSAVGYQPTLASEMGAMQERITSTHKGSITSVQAIYVPADDLTDPAPSTSFLHLDSTTVLSRQISELGIYPAVDPLDSTSQALSVDVVGAEHYEVAREVQRILQTYKSLQDIIAILGMDELSQEDKILVARARKIQRFLSQPFHVAEVFTGNPGVFVSLEDTVRSFKGLVEGQYDDLPEAAFYMVGGIDAAVEKAKALK

SEQ ID NO: 72932 - protein, 1722 aa, Candida albicans SC5314
MSDTSKSVLSNKEFSFPRGGSKPLSALEVKEISNEATKDVLFEQAESNKRSNSNKSDQPKKKHKKSSKNKSKNDKNDNDEETTQSVTIETFNFKNLVSGSTVLGQIKTINKLDIGLALGDNLTGYIPITSICPQVTELIEKFEQEESEEEEEEEESDSEETKSATFKSKTEKEFPDLFKIFKLGSWLKAKITTSHEDYKNKKRIELTIEPESVNENLEVDDLIVNNILQCSVKSIEDHGIILDTGKQEYSGFISNKELTNAQIDVNTIVPGLVILCSIASKPSGRTINLKPTTATVSAKKTTVSTISSIDSIQPGVIVDALINDVTENGLVTKVYGLVDGTIALSQIQNFELKELKHKYAIGSTVKARVLAVLLKNGTKKLILSILPHVLQLGDDSSQTEALEAFPIGHVFDQVKVIGNDKHYVYVSFGSSSLFGQIHQSKFDDNKSLLDYSIGSTHKSRVIGFNEVDNLLILTFESKVIDAEYLNVRDVPIGKLLPNVEILKVLEDGVGINVKFFDEFKGFVPGNQMSDIKLVYPERKFRVGTKTKGRLLNYNGKRALVTFRKALVNLEDDEILSDIDQAEIGFKTNAIVEKFVPNGCIVSFFGNLKAFLPKTEISETFVQDASSYLKIGQIVKVRILDVNKEQKRLVVTLKQSSELSNAQKNEISKLVSGKSIVKTVVVEKTKDSVLVELEGSHLRGVIYDGQLSDGNYEQNRALAKRLAIGETLEVLILDKDLKARTVIATAKKSLIDASKSKSFPVEFSDIAVNDVVRGYVKSVTSLGLFVTFTGRLTGLILAKYVTKNANEDLSKKFHKYQSINCRVLSVDKENERFLLTLNNSSSFTKDDEQLIKPIDATKKIVADYQPGETTKVVIKAVKGTQLNVQLADNLQGRVDITQCFKSIKDIKNLHQPLASSFQKGETLDVKVIGIHDAKNHTFLPITHRKSNRTTILELSLNNPQINNKLLTDLKLADFKQGDEVLAFVNNITNGMVWVSISPTIKGRIPMLDLTEDGSIFQDIDNKLPIGNAINVKVKQVDLQHQILVLTARKNFIEKFEDVRQDQTYPARIIKIKPNHVLVELGNNVIASSFVTDALNDYSDKLDHVFNVNDYVSAKVLDIDSTNKRISVSLRTDKAGSDKVINSISDLTRGQVIKGFVKNISNNGVYVSLGRSIYALVRVSDLSDSYLKDWQNFFKPNQPVIGKIVNCKQEGRILMTLKESEVNGELKIMKTFDDLQIGDIFEGTVTSTTDFGVFVKLDGTVNVSGLCHHSEISENDVDNVKSLFGTGDRVKVKILKIDSEKRQLSLGMKASYFITDSGKEDNDDEDVEMEDASEVGEEEEEGEDHEESESEEEKEEEDDDDDDIMDVDDNDENDSEDEEQSADESQEKSLSTGLSTNGFDWTASILDQADEDEESSDDDTDFTESSKKKSKKKSKSAVEDKTGDLNTRAPQSTADFERLLIGNPNSSILWMNYMSFQLQLSEVDKAREIGERALKTINYREEQEKLNIWIALLNLENTFGTDESLEDTFKKSIQYMDSFTMHEKLVNIYKMSEKFDQAKQLFNRMTKKFGKVLNTWVLYGSFLLDQNSQDEMHEILAKALNILPKREHIELVKKFAQLEFQKGDPEQGRSLFEGLVADAPKRIDLWNVYIDQEIKQDNKTSDEDDTDIKSKVEDLFERVLSKKITRKQAKFFFNKWLNYEEDKQDENMIARVKSKAAEYVQNNS

SEQ ID NO: 72933 - protein, 199 aa, Anabaena variabilis ATCC 29413
MIIVIDNYDSFTYNLVQYLGELASDFPVASDIQVFRNDKITLDEIRGLNPDAIVISPGPGRPEDAGISLNLIQELGTNLPILGVCLGHQSIGQVFGGNIVSAPELMHGKTSQVTHTGVGVFQGLENPMIATRYHSLVIDRPTCPEVLEITAWVDDGTIMGVRHRNYPHIQGVQFHPESVLTSLGKQLLRNFLEQLQLRE

SEQ ID NO: 72934 - protein, 316 aa, Pediococcus pentosaceus ATCC 25745
MQNIYFNHDGNVDDLVSLLLLLEFPDTKLIGVGAVGADSYVEPAVSASRKIIDLFGQDTTLEVAKSNSRPVNQFPKEWRLSAFSFDDFPILNEHLDNNNQPKTKLASQPAHLDMLEKIKASQQKVTLIMTGPLTDLARAIEIDPTIVDNIDELFWMGGSMNGVGNVAEPEHDGTAEWNAYWDPQAVETVFDTDLKITIVSLDSTNQVPLTKALRIRWAKQRQFPALDLIGQGYSLVHSFEANSTYYLWDVLTTLVSKYPELVDSKPIKAAVITDGPSAGKTFVTDNGRPLTFVTQVNSALFFDKFDELAQAAKTNY

SEQ ID NO: 72935 - protein, 346 aa, Oryza sativa Japonica Group
MAAAGSIGVYRAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGDLSERKSSFVIIGRIIFSILGAMMAAVVIYTVITDGLPFRKDLLTPWMAATLIDFYINVFAISVNYILWFLEIVPSMGCSQGVKLDIYCHLDMLVNMLWKESFEMPIVDVSCRLNSFTARLPEANHACPAMMSDRVWPRRWQAKEPPLGSSSAHRRSLPLPSPHQQHISIPFSVLLTSHRNNSLEPIMKEGNEKIELMAGKWEPMDEKDKKNNLVVEPTNVRESTFMFF

SEQ ID NO: 72936 - protein, 473 aa, Buchnera aphidicola str. Sg (Schizaphis graminum)
MLKQQVGVIGMAVMGRNLALNIESKKYTVSIFNRTQSVTEEVINNNKEKKIFPYFSIKDFVNSLRKPRCILLMVKSGQPTDETIQFILPYLNKGDILIDGGNTFYKDSIRRSNDLMKCGINFIGMGVSGGELGALNGPSIMPGGSREAYDLVSSMLKKISAKFKNEPCVSYIGPNGAGHYVKMIHNGIEYGDMQLISESYFILKNVLNMKNEELSNTFSQWNKGELNSYLIEITKNIFLKKEKDGIHYLIDSILDHAEDKGTGKWISQDALELHEPLSLITESVFARYLSSLKDQRLIASKILKGPILKCISSQNKELFVEEVRRALYLGKIISYAQGFSQLKKASEKYSWNLQYGKIAKIFRAGCIIRADFLERITDAFKSNNVTNLLLTPYFSEISNKYEKSLRYITSYAIKYGIPVPTFASAISYYDNYRTMSSSANLIQAQRDYFGAHTYRRTDKKGYFHTNWLTKKEL

SEQ ID NO: 72937 - protein, 332 aa, Medicago truncatula
MASQQQQVREWSGINTFAPATQTKLLELLGKLKQEDVNSLTILVMGKGGVGKSSTVNSIIGERVVAISPFQSEGPRPVMVSRARAGFTLNIIDTPGLIEGGYINDMALDIIKRFLLDKTIDVLLYVDRLDAYRVDNLDKLVAKAITDSFGKGIWNKAIVALTHAQFSPPDALAYDEFFSKRSESLLQIIKSGASLKKDDAQASAIPVVLIENSGRCNKNETDEKVLPNGIAWIPHLVHTITEIALNKSESIFVDKNLIEGPNPNQRGKLWIPVLFALEFLLIMKPIEGLIKNDVANEKKPSWETRDVGVKKETREVGQKDMRKERRGGAVRR

SEQ ID NO: 72938 - protein, 603 aa, Ustilago maydis 521
MAGTNTEYEAVIIGAGPSGIAAACELQRRIGLTKIKIFERGSKFGGTWFHNRYPGAACDVPSRLYSFSFYQKKSWNEFMARQPEMESYLQDTARTFGLDRFAHFNADVYSAEWVEQQTHWRVKYRSVDGHEHGVVTTRVLVNGSGALSVPRECDVDGWQSFKGPLFHSAKWDTSVDLKDKHVVVLGNGCSATQIVPSIAKQVKSVTQIARAKHWYAPTPVNPFSGPAFRWLERNIPGFILLERTIFTLFLDIHFIQAWNREGKAARDRFAASSQLYVSTVAPERYHHLLIPTQQELSVACKRRVFDDAYIPCLNRDNVELVTDQAVKITENEVVLQSGRRLKADVIILASGFKTGETAVQMKVRGRNGKELNEVWRKGGAPQAYRSTLCHDFPNLALLWGPNATTGHFSAIFSIESSVRFMCTIFKPIFLAGPSKLSPLQRSAGHTVDVKQEAQDKEDAMIRHQMKDLIYTSGCKGWYTNADGRVSTLYPGFQLTFAWRSDHPIANDFIYTGLPASTRPSSYWSYFQQIASFFRLGDVPEYRAAKLGQKNWIAKYLLTPLSMFLYRSSLRLLLSIVWIVDNVLFYTRGARDFEKVKQQYLLSK

SEQ ID NO: 72939 - protein, 290 aa, Physcomitrella patens subsp. patens
VELCPFLRNIGVTTSFAFSNLNFPVPAPRRAGRGPIFEDGPGFENSFRLFHGKDGVVPLARASGEQQSSEPLVNSTEASNLSFHPLSARAAAISLSPFGPAGPFGFDIFMAKQNVKKPSKKQPKKEPQPDKEHKSSLESHMHEAMSSEWLATGQCPIAKSFRAVSGVLPLVSKLLPQLPKGMKYRCPPAIVAARAALAKTSAVKALRPQALPTKVLAIGMLGMALNVPLGAWREHTKKFSPQWFLAVHATIPFIAMLRKAVVMPKYAVAFTIASAVLGQAVGARAEKFRI

SEQ ID NO: 72940 - protein, 319 aa, Medicago truncatula
MERKNKRLAVLVGCNYPNTPNELRGCINDVLAMKDTLVKRFGFDHANIQLLTDDDPKNSSSTMPTGANIKQALSSMVDKAEAGDVLYFHYSGHGTRIPSKIHGHPFRHEEAIVPCDFNLITDLDFRQLVNRIPKGASLTILSDSCHSGGLIDKEKEQIGPSSFDDKNATLKLSDHKPKTIPYESIFQHVSSLTNINTTDIGTHLLEFFGSDASLRFRLTSRDLEEGVLLKPDEGILLSGCQSDETSADMSPNMSNGKAYGAFSNAVQIVLKENKGKLSNREVVVKARDVLKGQGFVQHPCLYCSDENADDVFLLQMLEL

SEQ ID NO: 72941 - protein, 478 aa, Escherichia coli K12
MTLSFVTRWRDELPETYTALSPTPLNNARLIWHNTELANTLSIPSSLFKNGAGVWGGEALLPGMSPLAQVYSGHQFGVWAGQLGDGRGILLGEQLLADGTTMDWHLKGAGLTPYSRMGDGRAVLRSTIRESLASEAMHYLGIPTTRALSIVTSDSPVYRETAEPGAMLMRVAPSHLRFGHFEHFYYRRESEKVRQLADFAIRHYWSHLADDEDKYRLWFSDVVARTASLIAQWQTVGFAHGVMNTDNMSLLGLTLDYGPFGFLDDYEPGFICNHSDHQGRYSFDNQPAVALWNLQRLAQTLSPFVAVDALNEALDSYQQVLLTHYGERMRQKLGFMTEQKEDNALLNELFSLMARERSDYTRTFRMLSLTEQHSAASPLRDEFIDRAAFDDWFARYRGRLQQDEVSDSERQQLMQSVNPALVLRNWLAQRAIEAAEKGDMTELHRLHEALRNPFSDRDDDYVSRPPDWGKRLEVSCSS

SEQ ID NO: 72942 - protein, 386 aa, Magnaporthe grisea 70-15
MLGTSRSAQCLVRAARKPQLFQASKQASRTFATVQSDIFKPSKYGGKYTVTLIPGDGIGAEVAESVKTIFKADNVPIEWEQVEVSGIADSAAPSGRTEDLFKESVASLRRNKLGLKGILHTPISRSGHQSFNVAMRQELDIYASISLIKNIPGYETRHKDVDLCIIRENTEGEYSGLEHQSVPGVVESLKIITRAKSERISKFAFSFALANNRKKVTCIHKANIMKLADGLFRSTFHQTAKEYPTLEANDMIVDNASMQCVSRPQQFDVLVMPNLYGGILSNIGAALVGGPGIVPGCNMGRDVAVFEPGCRHVGLDIKGKDQANPTALILSGSMLLRHLGLDDHANRISKAVYAVIAEGKTRTRDMGGEATTNQFTKAILDKMETF

SEQ ID NO: 72943 - protein, 349 aa, Bacillus fordii
SVVRSVMPLIGLSKMNRHYSKQGKEMKKRLPYVGSGPAGLSTARELGRLGYEVTTFERKQGAGGLDTHGIVPFRLPKNISLWEVEQVESLGVQIRTNTEIGKDMSADDLISDFDAVILAVGMWKVPMLQIEGEDLAGVYDAIDLIEETKNKNYPTNFSGKRVAVIGAGNTAIDGATTSIRLGADNVKILYRRTQAEMTAYDFEYEFAKQDGVEFRWLTAPKRLIGDDRGQLKQMECVRMELKETGNDGRPQPVEIKGSEFLIDVDIVVKAIGQTRHRHLIDEFGLEHNGGVVKVDKETFLTSNPKVYAAGDVIFGKGLGEAMVVTAAQQGKEAAYAIHQQLKKPMIEKV

SEQ ID NO: 72944 - protein, 401 aa, Rhizobium leguminosarum bv. viciae 3841
MTATAPWTIEKPTALLVLADGTVIEGKGIGATGKVPAEVVFNTALTGYEEILTDPSYLGQIVTFTFPHIGNIGTNDEDIEDLTPAARHGAVGVIFKADITEPSNYRAAKHLDQWLKARGVIGLCGIDTRALTAWIRENGAPNAVIAHDPNGVFDIETLKAEAKAWSGLEGLDLAKIASSGQSSQWTETPWVWNEGYGELKATDAKYHVVCLDYGVKRNILRLFAGLDCKVTVVPAATSAEDVLAMQPDGIFLSNGPGDPAATGDYAVPVIKTLIKTDIPVFGICLGHQMLGLALGAKTEKMHQGHHGANHPVKDHTTGKVEIVSMNHGFAVDSKSLPDGVEETHISLFDGTNCGLRVLGKQVFSVQHHPEASPGPQDSHYLFRRFINMVREKKGEPALAER

SEQ ID NO: 72945 - protein, 610 aa, Arabidopsis thaliana
MTKPLKKGKRDAEEDLDMQVTKKQKKELIDVVQKEKAEKTVPKKVESSSSDASDSDEEEKDESSSEEEDDSSSDEEIAPAKKRPEPIKKAKVESSSSDDDSTSDEETAPVKKQPAVLEKAKVESSSSDDDSSSDEETVPVKKQPAVLEKAKIESSSSDDDSSSDEETVPMKKQTAVLEKAKAESSSSDDGSSSDEEPTPAKKEPIVVKKDSSDESSSDEETPVVKKKPTTVVKDAKAESSSSEEESSSDDEPTPAKKPTVVKNAKPAAKDSSSSEEDSDEEESDDEKPPTKKAKVSSKTSKQESSSDESSDESDKEESKDEKVTPKKKDSDVEMVDAEQKSNAKQPKTPTNQTQGGSKTLFAGNLSYQIARSDIENFFKEAGEVVDVRLSSFDDGSFKGYGHIEFASPEEAQKALEMNGKLLLGRDVRLDLANERGTPRNSNPGRKGEGSQSRTIYVRGFSSSLGEDEIKKELRSHFSKCGEVTRVHVPTDRETGASRGFAYIDLTSGFDEALQLSGSEIGGGNIHVEESRPRDSDEGRSSNRAPARGAPRGRHSDRAPRGGRFSDRAPRGRHSDRGAPRGRFSTRGRGPSKPSVMESSKGTKTVFNDEE

SEQ ID NO: 72946 - protein, 209 aa, Rhizobium leguminosarum bv. viciae 3841
MRNPVDTAMALVPMVVEQTNRGERSYDIYSRLLKERIIFLTGAVEDHMATLVCAQLLFLEAENPKKEIALYINSPGGVVTAGMAIYDTMQFIKPAVSTLCIGQAASMGSLLLAAGHKDMRFATPNSRIMVHQPSGGFQGQASDIERHARDILKMKRRLNEVYVKHTGRTYEEVEKTLDRDHFMDADEAQSWGVIDKVLTSRLEMEGEQA

SEQ ID NO: 72947 - protein, 350 aa, Arabidopsis thaliana
MATPMENENPNFARTATSFRNFVSKDPDSQFPAESGRYHLYISYACPWASRCLAILKLKGLDKAISFSSVQPLWRNTKENDEHMGWVFPDSDTEVLGAERDHINGAKSVRELYDIASSNYTGKYTVPVLWDKKLKTIVNNESSEILRMFNTEFNHVAENPSLDLYPPNLRAIIDETNEWIHDGINNGVYKCGFATNQETYDVEVKRLYEALDRCEDILRKQRFLCGNTLTESDIRLFVTVIRFDEAYAVIFKCDKRLVREYYHLFNYTKDIYQIAGMSSTVKMDHIKQNYYGSFPSINPLEIIAHGPNIDYSLPHDRHRFSLESDYTRLELFESASFVCELKLIEIFDSL

SEQ ID NO: 72948 - protein, 315 aa, Arabidopsis thaliana
MEEPCETLDSGEAYQISRYHNYNQHSSRSSSPWLDLRVFYVRISNFVVEDSTPEVLTINHIPLDPDTLLEINGVRMGMYSEGGSSQLRRDRVDKKSEEATYVSTDNIRLTGSVKFEVYDKNELVLSGTLEMSGSNGFTGESKNRWKMNCEAEVTAGSGFLKEKSINGQELSSPLPTIEVYVTGCFSGTPIILTKTLQLGLKKKQSRRMALDAIPEYETAEPQKDTSYALDLQATTEYGNYKEEYEGDMYWRSECIDGEMSWFNAGVRVGVGIGLGVCVGLGIGVGLLNLADENLHTRQFYKLSFDFLNFSAVLER

SEQ ID NO: 72949 - protein, 200 aa, Oryza sativa
MDSEHWISRLAAAKRFYAAQLGHADRAGMEEVDMDEEVRPEFACPYCYEDHDVVSLCAHLEEEHPFEPHAANRRRLRRFVIPGSQALSLLSRDLREAHLQVLLGGGGHTSNDSSNTTNISADPLLSSFGLSFPTSDTEETSKPPISIPDDASVIKETPAQPWDSSIDSSLTREEREQKRNQASTRATFVQDLLLTTLFGD

SEQ ID NO: 72950 - protein, 638 aa, Moritella sp. PE36
MAKINLSALAIYPLKSAKAINLTHSQVSEMGLEHDRRFIISDMQGQFITGRTEPKISTIKIEVSAQGIMLSAPHMPPIAFIFKELQQDYTDVTVWGTAIQGQRCSDDMNRWLTKFLGVDCQLLYFGEKSSRQVANVDKQVGFADGYPLLLISQASLDELNRSTSRPIDMRQFRTNLVVTGCEPFAEDTWKRIKIGDAEFELVKACERCIFTTLSPGQTRFADDKEPLKTLNLFRKDNDGRIDFGQNLISHNTAEIKLGDSIEVLEYHQPKFYADNRPKQKSVVSAPKAIVKHPAVEQAKTLWGKGETRQLCCVAVIDETPDTKTFRFRVEPAALLNYKPGQFITLNLKIGQDLVMRNYTLSSSPSRPDLLAITVKRVPEGKASNWLNDNLTVGSRLGASSPRGAFHAFTATTQKLLLLSAGSGITPMLSMARYYADTECDKDIVFFYSAKTSADLIALDELQLLTRQHTNMRLILTLTAESTHSDWSGLRGRIDQQMLADVVRDISERSAYVCGPEAFMTTMATALTALNVPADQQFQESFGDHKHSDTPGKPVNILLDSWDTSFVGDNKTTLLEQAEKNGVNIPYNCRAGYCGVCRVTLESGEVRVLADHALTDDGKKAKKILACSCIPQTDVVISA

SEQ ID NO: 72951 - protein, 804 aa, Arabidopsis thaliana
MRCDNNYSFSILFSLLLILILDSKVVSLSTSCQSKSVCGNINIPYPFGIEKGCYLNEWYKIECKNATYPFLFKMGMAVVNISLPGDDGYNNPVSYGSIRVKIPITSIGCSRDGKESGSVLNFTDSPFYFGIGNSLVAVGCNSKASLTNINPSKVGCELNCTASKETLPSKSIPFFDKTGCSNNKLPYYSSLCTKNNGEDERSCDGNGCCIAGLLDSEAPQVIGINIESFDHGNSTKLECRVAFLTDDVSPFSNASEPKRLFAKRYATVSLGWVIQTKNLSFVNSLSCKNTKEYDNSTYNIKLVTSCICNNVTISGTDYANCGCSQGYEGNPYLPGGCKDINECLRNSYGQRQNCRESDTCVNLPGTFNCIGNKTRVTMIGVGSAFGILVLVVGIWWLRKFLKKRRMSKRKRKFFKRNGGLLLQQQLNTNKGNVEKTRIFSSRELEKATDNFSESRILGQGGQGTVYKGMLVDGRTVAVKKSKVVDEDKLEEFINEVVILSQINHRHVVKLLGCCLETEVPTLVYEFIPNGNLFQHIHEESDDYTKTWGMRLRIAVDIAGALSYLHSAASSPIYHRDIKSTNILLDEKYRTKVSDFGTSRSVTIDHTHWTTVISGTVGYVDPEYYGSSQYTDKSDVYSFGVVLVELITGEKPVITVSNSQEIRGLADHFRVAMKENRFFEIMDARIRDGCKPEQVMAVANLARRCLNSKGKKRPCMRKVFTDLEKILASQEDSLVNIENDDGADDEEEGMTMINIDDSQTIYVTAPAPKYTNYKEIGVCVCLGIGVGLLVRTYQSTTRTFRRRLL

SEQ ID NO: 72952 - protein, 156 aa, Photorhabdus luminescens subsp. laumondii TTO1
MNVIKGVVAAPQARVAIAIARFNNFINDSLLGGAVDALERIGQVASENITVVWVPGAYELPLTVKTLVETQKYDAVVALGTVIRGGTAHFEYVAGECSSGLSSVAMASEIPVAFGVLTTESIEQAIERAGTKAGNKGAEAALTALEMVNVINAIKG

SEQ ID NO: 72953 - protein, 155 aa, Glycine max
KLGLMSCFVKAAVSGLQNQPIVNAVIDGDDIIYRDYVDVSVAVGTSKGLVVPVIRDADTMNFADIEKGINNLAKKATEGALSIDEMAGGTFTISNGGVYGSLISTPIINPPQSAILGMHSIVQRPVVVDGSILARPMMYLALTYDHRLIDGREAS

SEQ ID NO: 72954 - protein, 305 aa, Physcomitrella patens subsp. patens
VELCPFLRNIGVTTSFAFSNLKFPVPAPTRAGRGPIFEDGPGFENSFRLFHGKDGVVPLKRASGEQNARSFTETLDAEDLSFHPLSARAATISLSSFGAGGPFGFDGFMARQNAKKPKEKKPKKETEPEKKRRSKLESHMHEAMGSEWLATGQCPIAKSFRAVSGVLPLVSKLLPKLPQGMKYRCPPAIVAARAALARTEAVKALRPQALPTKVLAIGMVGMALNVPLGVWREHTKKFSPQWFLAVHATIPFIAMLRKAVVMPKYAIAFTIGSAILGQAVGARAERIRLAKLKSLDEQPQETSMD

SEQ ID NO: 72955 - protein, 466 aa, Mycobacterium sp. MCS
MIDARTAPTASEVLARLHAEDIATVILGGTDTHGVMRGKRVPISQLPRMLEHGMPMCDVFWVMHVDESDLVARPDGYRGYFPTERQGYPDILAVPDLTTLRIVPWHNDTALLLCDWELPADHRPVPIAPRSVLRRVVERADAMGYQPLSALELEFYLLREKAGTTHRKRADELVPLQEAPSTYGVVMGSLQEDIGALIRRHMLDYGLPVEACNPETGPGQFEITLRYGNSLKSADDAFLFKSAVKEVAAQNDLLATFMAKPVTDWAGNSCHVHLSLRDIAGGGVFFDQDAPDQLSTALRHFAGGILHTMREFTALMAPTPNSYRRFVPYSWAGTTATWGVDNRSVGLRVIREGDHGTRVEHRQPGGDANPYLATAAALAGGLHGLLNEIEPRELSTTDIYSQPSEDLPVLPATLAEAVDLLADSAAAREWFGDDFVDHYVLMKRAEIAAQSVAVTDWEVARYLEAM

SEQ ID NO: 72956 - protein, 301 aa, Physcomitrella patens subsp. patens
VELCPFLRNIGVSTSFVFSKLKLPTPAPTRAGRGPIFEDGPGFENSFRLFHGKDGVVPLKRASGEQNARSFTETLDAEDLSFHPLSARAATISLSSFGAGGPFGFDGFMARQNAKKPKEKKPKKETEPEKKRRSKLESHMHEAMGSEWLATGQCPIAKSFRAVSGVLPLVSKLLPKLPQGMKYRCPPAIVAARAALARTEAVKALRPQALPTKVLAIGMVGMALNVPLGVWREHTKKFSPQWFLAVHATIPFIAMLRKAVVMPKYAIAFTIGSAILGQAVGARAERIRLAKLKSSITPDQT

SEQ ID NO: 72957 - protein, 331 aa, Vitis vinifera
MTGMDTQEHQIDLGHLMAFDPLHHFPSPPTSREELVKECLQKGTVLVQLIADALFNLPSTEDIDGPLVKLPPPMTRLPREKHLPKPKPPTKWELFAKAKGIKNRKKDKIVYDEQTGTWKRRHGYDRVNDDKDIPIIEAKMTDEPGEDPFVKRQAEKKKRVEKHEKNRLQNLKQAAKVGALPSHIQLAATALPITGTQAAPKKASKNELQDIASMAAAATASGGKFDKKLVGEKPEKHKGKYRKFLPVVEGTGIGSQEKQQTEKVLNRLISKNSHEILNVDKAINMYNVKKEKKRKNQRGKDSSTSSKLKPKKQLQKKSLKKGGSSKKGKSK

SEQ ID NO: 72958 - protein, 108 aa, uncultured crenarchaeote
IMVDKLGTMFVTGPDVVKTVLGKEVSFDELGGAMTHGTKSGVAHFVAQNEYECMDYIKTLLSYIPQNNTEEPSIVSNDDDPNRLDHNLISMVPEDALKPYDMKEIIHS

SEQ ID NO: 72959 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKTHGVANVMKTQPEITIFTASRSLFGDEMRRIFDRSFAQLKIREYILNYFVTDESFKLKEYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFKSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 72960 - protein, 518 aa, Rhodobacter sphaeroides 2.4.1
MLMTKFSDLALDPRVLKAVQEAGYETPTPIQAQAIPHALEGKDVLGIAQTGTGKTASFTLPMITILGKGRARARMPRSLVLCPTRELAAQVAENFDIYAKHSKLSKALLIGGVSFTEQDKLIDRGVDVLIATPGRLLDHFERGKLLLTGVQIMVVDEADRMLDMGFIPDIERIFSLTPFTRQTLFYSATMAPEIERITNTFLTGAVKIEVARQATTSETIEQKLIQVTPTRKERSFADKRAVLRALIRAEGEACTNAIIFCNRKMDVDVVAKSLKQHGFNASPIHGDLEQSQRMKTLDGFRDGSLHLLVASDVAARGLDIPAVSHVFNFDVPTHPEDYVHRIGRTGRAGRKGKAYTIAVPSDEKHVTAIESLVKQAIPRGELPEGFSLEDRPDRPERDNARGERSERPARGRRGRDRDRREEPRVEAVEAPAAAVPEVREVREERPPRREERRDERREGGNNRRERDRDRREERVVGMGDHVPDFLLRSFRIPSLTASDEEEPVPEAAEEMLAGDGEA

SEQ ID NO: 72961 - protein, 81 aa, Zea mays
APLPSPLRVPVPCSSHPPPPAAAASSPSRPPPPAAARHGLRRRPRLVLEELPWDHSFVRELPGDPRSDTIPREVLHACYSR

SEQ ID NO: 72962 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKTHGVANVMKTQPEITIFTASRSLFGDEMRRIFDRSFAQLKIREYILNYFVTDESFKLKEYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSISFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 72963 - protein, 483 aa, Pediococcus pentosaceus ATCC 25745
MAEQGGSQVKRALKTRHISMISLGGSIGTGLFVASGSAISTAGPGGALLAYVGMGVMVYFLMTSLGEMATYMPVSGSFSTYATKYVDPAFGFAMGWNYWFNWAITVAVDISTIALIMKFWFPHAPGWIWSLLALVLVFLVNALTVKAFGETEYWIALIKLVTVIIFLVVGVLTIVGIMGGKATYLENFVYHKAPFVGGIPAILSVFVVAGFSFQGTELIGITAGESETPETSVPKAISQVFWRILLFYILAIFVIACIIPYTSPNLLGSSARDVSISPFTLVFRRAGLAGAAGVMNAVILTSVLSSANSGMYASTRMLYSLSKQGFAAKIFGKTSKRGIPYLALLGTTIVGLLTFISSIMGPKIYIWLVAASGLTGFVAWVGIAIAHWRFRRAFIKQGHDVSELRYRAKWFPFGPLFAFVLSIIVIAGQDIHSIANFDWQAIGITYMAIPLFIVLYTYYKIRYKTKLIPLEEIDLSRPDITKE

SEQ ID NO: 72964 - protein, 332 aa, Rhizobium leguminosarum bv. viciae 3841
MAQKIIIDTDPGQDDALAILLALASPEIEVLGIVGAAGNVPLLLTSKNIRKICELAGRPDIKVFAGCDRPMTGPLVTAEHVHGATGMDGADLPEPSMPMQEQHGVDFIIDTLQSEPAGAVTVCTLGPLTNLGKALTRAPEIAGRIKQLVLMGGGLFEGGNITPAAEFNIYVDPPAAAVVFGSGVPIVMMPLDVTHKTLTTRVRVAAIQALGTPLSDAVVGWLHYFERFDVAKYGSDGGPLHDPNVIAYLLKPELYSGRFCNVEIETESELTKGMTVADWWDVSGRPKNALFMRDVDADGFYALLTERLSWLGRADTAAEAAPGLLVTSSRAR

SEQ ID NO: 72965 - protein, 490 aa, Acinetobacter sp. ADP1
MFFIYDFAMIMQFNSRYSDLNAKLYHQQAPVPLKGAKAGHFNEAIADELQWTSQEKQSWVDICSGQKTFDAFKPLAMVYAGHQFGQWAGQLGDGRGLLIGQVLHRSGQTIDLHLKGAGLTPYSRMGDGRAVLRSVIREYLAGHALNSLRVASSNAIGFTTSEQGVQRETLEQGAMLLRTSDCHIRLGHFEWINQYAPELLAEFTQKCIEWHYPEALQAEHPILAFAEGVIKNTAKMIADWQLVGFAHGVMNTDNLNITGSTLDFGPYGFMERFRPNWINNHSDHQGRYAYQNQPSIAHWNLWIWLNNLIPLSKPEDKETFKKQLADCLEHFEPTFLTAYTEGLCKKLGLPDFHKDSFDCGMAFLKVLQSEQLDYTQSFLRLQNHDYKALRDDCLDTRQFDDFLNLYHQIREHQDITALDQTMCDVNPVYILRNHMAQQAIEQAERGDFSEVERLFTLLAKPFTRQPALEKEQDLAPLPSDVPEIMVSCSS

SEQ ID NO: 72966 - protein, 294 aa, Glycine max
MAKKPVKYFVVDAFTESAFKGNPAAVCLLEEEKEDSWMQGVATEFNLSETCYLTPIAESERSDISLNRFRLRWFTPATEVELCGHATLASAHVLFSSGLVKSDIIEFVTLSGVLTAKKVSGINDGEGASEDGLFIELDFPADTVTEFNSADISQISAALNDAPIIDIKRTTVGDHLLVELASGKDVVELQPDIGAIAKCPGGGILVSGTAPPESGFDYYCRTFFPKVGINEDPITGSAQCALAPYWAKKMGKCDLSVYAASPRGGVVHVHFDDQSKRILMRGKAVTVMNGCVMI

SEQ ID NO: 72967 - protein, 475 aa, Enkianthus chinensis
INPTTTPSGPGASVLEKKNLGRIVQIIGPVLDVAFPPGKMPNIYNALVVKGRDTVGQPINVTCEVQQLLGNNRVRAVAMSATDGLTRGMEVIDTGAPLSVPVGGATLGRIFNVLGEPVDNLGPVDTCTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNKQDVLLFIDNIFRFVQAGSEVSALLGRMPSAVGYQPTLSTEMGTLQERITSTKNGSITSIQAVYVPADDLTDPAPATTFAHLDATTVLSRGLAAKGIYPAVDPLDSTSTMLQPRIVGDEHYKIAQRVKQTLQRYKELQDIIAILGLDELSEEDRLTVARARKIERFLSQPFFVAEVFTGSRGKYVSRAETIRGFELILSGELDGLPEQAFY

SEQ ID NO: 72968 - protein, 171 aa, Solanum lycopersicum
MANPKVFFDLTIGGAPAGRVVMELFADTTPKTAENFRALCTGEKGVGKMGKPLHYKGSTFHRVIPGFMCQGGDFTAGNGTGGESIYGAKFNDENFVKKHTGPGILSMANAGPGTNGSQFFICTAKTEWLNGKHVVFGQVVEGMDVIKKAEAVGSSSGRCSKPVVIADCGQL

SEQ ID NO: 72969 - protein, 239 aa, Medicago truncatula
MCSLEKRGNLWILTITGDDQNRLNPNLISSLLSTLTTLSSQSTPGSVLITTATGTRFFSNGFDLLWARSATSPSAATERLHSMVQSLKPVAAALMSLPMPTIAAINGHASAAGFLLAICHDYVLMRSDQGVLYMPEVNLGLPLPDYFAAVFGEKIKSPVVLRDVLLGGVKIKGKEAVKLGIVDSAHDSVESTVEAALRLGEEFAKRKWAGEVYAEIRKSLYPQACLVLGLTPKSLVSKI

SEQ ID NO: 72970 - protein, 300 aa, Neurospora crassa
MSSASPSRERRRLVGVSTKMYFSHARTTNFITSFLDLMQHHTSTKTEQSNDNRNNLAAALASKIDIFIIPDHLSLQSAINRTANHPSQSGPTDPKILFGAQNCHWEDSGPFTGEVSPAVLAEVGCSIVELNHAERRRHFAETDAITCLKAQAVIRNGMIPLICVGEGSPGQIPALSEVAIMKAAAEVVDQVELCLEGVDPTKEVWLAYEPVWAIGAKEPAGVEHVRGVVRTIRKSEVVRGREERGGVTRILYGGSAGPGLFGQLKEVDGVDGLFLGRFAHEEGQFWKTICEVAEVEWEGR

SEQ ID NO: 72971 - protein, 253 aa, Picea abies
MPVRRIALGRAEEATHPDSIRAALAEFFSTLIFVFAGEGSVMAYAKLTGGDSTTPSGLVAVALAHALGLFVAVAVAINISGGHVNPAVTFGALMGGHISILRGILYWIAQLLGAVVASLLLKFTTNGRSTSPFAVSSGVGSWNAVVLEIVMTFGLVYTVYATAIDAKRGSLGTIAPLAIGFIVGANILAGGAFDGASMNPARAFGPALVSGKWRYHWIYWVGPLIGGGFAGLLYEWLMVPSEPLHQPLQPEDY

SEQ ID NO: 72972 - protein, 200 aa, Photorhabdus luminescens subsp. laumondii TTO1
MVLVTRQAPDFTAAAVLGNGEIVGNFNLKKHLNGKPAVIFFWPMDFTFVCPSELIAFDHRYEEFKKRGVEVIGVSFDSEFVHNAWRKTPVDQGGIGEVKYAMVADTKREIQKSYGIEHPEAGVALRGSFLIDKNGVVRHQVVNDLPLGRNIDEMLRMVDALQFHEEHGDVCPAQWEKGKEGMSASPDGVAKYLSQNAAKL

SEQ ID NO: 72973 - protein, 306 aa, Mesorhizobium loti MAFF303099
MAGNGVASIGECMLELSGQTGPNWCMGFAGDTFNTLWALHALSEDRPATYVSAFGDDPFSQGQIGFFAENGIGIGSSPVIPGARPGLYAITLTGAERSFTYWRGDAAARQLASDPAALSKNLENQALVYFSGITLAILDDASRKTLLEAVTKARAAGSLIAFDPNYRPRLWRNRESAQAAIVEALGVTDVALPTFPDEQMLFGDETPRATAERLGQWVGEVIVKNGEQPALIAESGTLHDVPAIHVAAPVDTTGAGDSFNGGYLAARLAGHGPQEAASRAHRVAAAVVQVRGALAPFETLRAAFDS

SEQ ID NO: 72974 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 72975 - protein, 586 aa, Photorhabdus luminescens subsp. laumondii TTO1
MLKTWKTPLVIISLLVSSHLYAASEPAVEAKNGMVVSSQHLASQVGVDILKMGGNAVDAAVAVGYAQAVVNPCCGNIGGGGFMTIHLTDGTDTFINFRETAPSAASADMYLDKEGNVIKGASLYGYRAAGVPGTVMGLDSTLKKYGKLSREQVMAPAIKLAREGFILARADTDILDTTIKRFRKDPEAARIFLRKDGSPYQPGDRLIQTDLANTLELIAKKGQDAFYHGNIPKLVAEAAKKSGGIITEADFANYKISETTPVTCHYRGYKFISSPPPSSGGVTMCEILNILEGYNLKEMGFNSADYIHTLTEAMRHAYMDRNTYLGDPEFIKNPIDHLLSKHYAESLRKKIEPGKATLSENIQPGIGPHEKPETTHYSIVDKEGNAVSTTYTINGLFGAVVIAPGTGFFLNDEMDDFTTKIGEKNLYGLIQGATNSIAPGKRPLSSMSPTLVTKDNKTFLVLGSPGGSRIISITLQTALNIIDHGMSPQEAVNSPRIHHQWLPDEVYYEQRGISKDSLNLLEKMGYKMVEQIPWGAAEVIMVGLPKTTSTSAKSSGNDATVSGQVRENHLYGANDVRRPAGAAIGY

SEQ ID NO: 72976 - protein, 485 aa, Mesorhizobium loti MAFF303099
MLQKTSHFMRQANLINGEWVQADSGQTVDVNNPATGLKIGTVPKSGKAETRRAIEAADAAFKTWRKTTALERSKLLRKLHDAMMDNQDVLAELLTIEQGKSLFESKGEIGSAAAYILWFAEEGRRTYGDVVPSPWADRRILVTKEPVGVIAAITPWNFPSSMLARKLGPALAAGCTAVVKPASQTPYSGLAWGALAEEVGFPKGVVNILTGSASEIGDEICANPLVSKITFTGSTEVGKLLIQKSSVTVKKVSMELGGNAPFIVFDDADIERAVAGAITAKYRNSGQTCVCTNRFLVQAGVYDKFVEKLAAASNGLKVGSGLEEGVQQGPLIDEKAVEKVEELIADATSKGGKIVAGGKRHALGGSFFQPTVIANATPKMRFMKEEIFGPVAPVFKFETEAEAIALANDTEFGLACYFYTGDLGRAFRVMEGLKYGMVGVNEGLITTPEAPFGGVKESGLGKEGGHQGIEDYLDTKYVCIGGLGL

SEQ ID NO: 72977 - protein, 614 aa, Cryptococcus neoformans var. neoformans B-3501A
MATPPVAFLNSQPNTTLSANENHSSGEQPSSKTPLQRQDSLQNTRNFYGVQPDLPLGGSAHLPSSIASRLRGKVIRAQSSSHLSALSQSTSPSSGPLPTASPQRSSIPLPTPRGFLTPKKPAAAQRLEKSKARPLMPAGVSSGASTFDAKISGNSEVEGNDALRAPSPIEQHSAFDLPLSQGLRTNSSPAERDSPLHSTLMASETGLTIASHNVRPAIAATSSPQGGGDRSLRHSLTTASSPPRGAPMELSSDNLVRREAGEKPSLTNLKRQSHSRTTFERIRHQNNSSKPNRQRKYMSFENPLSTFILGGHVLIGGDTWYSMGLVLAVLLGISGVWLGTTGVWMWLHGAEYGLAKGGGVAATIIFVYLFGITTTSFVVTAFRDPGIIPRKLDPDPPMAQVDDWWEAYPRELTVQNGRVSVKYCETCATYRPPRCSHCRLCGNCVDGIDHHCSYLHTCVGKRNYFSFIVLLITTSISDIYIVILSAIHFSLLCHHDNVSFKSALSDSPGAAVSFLLGIIAIIPVLFLLQYHVRLLLFNITTIEQIRANTSKSLFAMPKRPDNPFSSPSLVSNVLLASLARPQFPSWIDASGWKQEDRRKINPALKDWRFGREWA

SEQ ID NO: 72978 - protein, 203 aa, Physcomitrella patens subsp. patens
MTAQAAEDLATELEQQKIHSDEPTIEDAKDDDDDDDDDEDEDDVLDGADGQGAGGKSKQSRGEKKSRKAMQKLGMKPVTDVTRVTIKKSKNILFVISAPDVFKSPASDTYIIFGEAKIEDLSSQLQSQAAEQFKVPEAANVEAKAAPSAAVEAEDEGDVDETGVEPKDIELVMTQAGVSRAKAVKALKTTGGDIVSAIMDLTG

SEQ ID NO: 72979 - protein, 552 aa, Solanum lycopersicum
MASINISFPSTTFHSRSQANFKLFSGLHSGDVVSLNGVSSGSFIRLNARPHLTIKSDFKITSALLSGEGDIRFQSRGEKTLFSSLSTGTETQPDAVTFATLEADGVQTTSGFLSDDDECDLDRPTEGFSSVPEAIEDIRQGKMVLVTDDEDRENEGDLVMAASKATPEAMAFFVKYGTGIVCVSMTEEHLERLQLPLMVNDKKNEEKLCTAFTVSVDAKHGTTTGVSAHDRATTVLALASGDSKPEDFNRPGHIFPLKYREGGVLKRAGHTEASVDLAVLAGLDPVGVICEVVDDDGSMARLPMLRQFAKEHNLKIISVADLIRYRRKTDQLVEHASAARIPTMWGPFTAHCFKSIIDGIEHIAMVKGDIGDGQDILVRVHSECLTGDIFGSARCDCGSQLATAMKQIEAAGRGVLVYLRGHDGRGIGLGHKLRAYNLQDAGRDTVEANEDLGLPVDSRNYGVGAQILRDLGVPTMKFITNNPAQYSWLKGYGLAISGMVPVVTPFTNHYDTYLETTRAKMGHVYGLNLIRPATSTSTTNGKPNSENTSTIR

SEQ ID NO: 72980 - protein, 124 aa, Physcomitrella patens subsp. patens
YHVLAVDDSSIDQRVIERLLKTSSYRVTTVNSAVRALDVLGLSESRSASSTRLDINLIMTDYCMPEMTGYDLLKRVKAQTSALKEIPVVLMSSENDSNRIERCLAEGAEEFIIKPVKMADVKRL

SEQ ID NO: 72981 - protein, 370 aa, Candida albicans SC5314
MNSDSISQVFEYLNKRDECPTDNDYNGNIGTRISSIFVIMVTSAIGTLLPLLSSKYSFIRLPPMVYFICKYFGSGVIVATAFIHLLEPAADSLGNECLTGPITEYPWAFGICLMTLFFLFFFELLAYQGIDRKIAKESQLDNQGPHTHSHFGDASMYVKKDDEEEDLENQNEKQADANPYPSHFAHAQEHQDPDVMGTTVNDQSKEQYYGQLLGVFVLEFGVMFHSVFIGLALAVSGDEFKSLYIVLVFHQMFEGLGLGTRIATTNWARHRYTPWILAICYTLCTPIAIAVGLGVRKSYPPGSRRALITNGVFDSISAGILLYTGIVELMAHEFLYSGEFKGPGGFKNMLLAYFVMCWGAGLMALLGKWA

SEQ ID NO: 72982 - protein, 520 aa, Streptococcus pyogenes M1 GAS
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 72983 - protein, 517 aa, Zea mays
MEPAYVVTLSFLFLFLLHHLLGRHRRRTNGKNKRTQLPPSPPAIPVLGHLHLLRKPIHAALARLAERYGPVFFLRLGSRQAVVVSSAACATECFTENDVCFANRPRFPTLLLVSFGGATLPMCRYGSYWRNLRRVATVQLLSAHRVSCMLPVISAEVRAMARRMYQSAAAAPAGAARVELKRRLFELSHSALMETIARTKTSRAVADDDTDMSPEAQEFMKALDVFLPLLSGANAWDYLPVLRWLDVFGVRNKILRAVSARDAFLRRLIDAERRRLEEGGENNDKKSMIGVLLSLQKSEPEVYTDTMIMALCSSMFAGGSETTATTAEWAMSLLLSHPDVLKKAQAEIDASVGHSRLLGADDLPRLGYLHCIISETLRLYPVVPTLVPHESTADCTVGGHRVPSGTMLLVNVYAIHRDPAIWADPAAFRPERFEDGRADGLFVMPFGMGRRKCPGEALALRTLGLVLGTLIQCFDWDTVGGAEVDMAEGGGITLPRAVPLEAICKPRHAMLGVLKGL

SEQ ID NO: 72984 - protein, 223 aa, Zea mays
  misc_feature (123)..(123): Xaa can be any naturally occurring amino acid
  misc_feature (174)..(174): Xaa can be any naturally occurring amino acid
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGXLTAFGERCKKYYEAGARFAKWRAVLKIGENEPSELSIHENAYGLARYAVIXQENGLVPIVEPEILVDGPMTSTRCAAGDRACSLEKRFFPPGKKIFGRAP

SEQ ID NO: 72985 - protein, 830 aa, Arabidopsis thaliana
MTTAMMIFAVLVTVVEVEAQTECVSKIVPCFRFLNTTTKPSTDCCNSIKEAMEKDFSCLCTIYNTPGLLAQFNITTDQALGLNLRCGVNTDLSACSGSGAPPPPPDLFPPPSAQMLPPPPAKGACKSRNFSLGSFQQSQHLVWSDMYLRSVSSSPAPPSPPSSSRPRPLPRPSMSRSFTIENKCQYTIWPATYGYRRSLETTGFVLEKGETRTIKAPSSWIGRFWGRTLCSTNSTGGFSCATGDCTSGKIKCLGIPIDPTTVVEFNLASYGVDYYVVNVFNGYNLPLLVTPENKNCRSIECVIDMNETCPSELMVNSSGLGSHHPIACMTTCQRYQLPELCCIGLSSGVVVPPGICKRTIYSRTFNNVCPSAYSYAYDVDNSSFTCPNFSNFVITFCPSSSTVPEAGNINSSTVPEAGNIKTGTEAKGNIPLRLKLILGVSSVLATMIIIVIVGKVRANNMRKSDLNEKNMEAVVMLKRFSYVQVKKMTKSFENVLGKGGFGTVYKGKLPDGSRDVAVKILKESNEDGEDFINEIASMSRTSHANIVSLLGFCYEGRKKAIIYELMPNGSLDKFISKNMSAKMEWKTLYNIAVGVSHGLEYLHSHCVSRIVHFDIKPQNILIDGDLCPKISDFGLAKLCKNNESIISMLHARGTIGYIAPEVFSQNFGGVSHKSDVYSYGMVVLEMIGARNIGRAQNAGSSNTSMYFPDWIYKDLEKGEIMSFLADQITEEEDEKIVKKMVLVGLWCIQTNPYDRPPMSKVVEMLEGSLEALQIPPKPLLCLPAITAPITVDEDIQETSSFLKPSQDTSYYSEQIVQDIVEENQDSSRSS

SEQ ID NO: 72986 - protein, 468 aa, Salmonella enterica subsp. enterica serovar Paratyphi A str.
MIHGPLELILNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDSFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 72987 - protein, 495 aa, Bacillus cereus G9241
MKMLTVENLSKSYGEKPLFDGLSFSIAEGQRAGIIGVNGTGKSTLLKIIAGAEIADTGDMTHSRGYTISYLSQQPEFDEQLTVLEQVFHGDTPLIRLLRDYEKALLHIEKDPSNEKVQEQLFAVQQRMDAMSAWEANANAKSLLTKLGITDFTATVGNLSGGQKKRIAMAQCFIETPDLLILDEPTNHLDHETVEWLEEYLARYTGAVLLVTHDRYFLDRVTNRIFELDNGKLYSYEGNYSTFLEAKALREEQELAQESKRQNLYRRELAWIRRGAKARSTKQKARIQRFDELKGQEGPAAKQSVDIALSGSRLGKKVLELKDVTKKFGNKTVLNNFNHIVKPGDRIGIIGANGSGKSSLLNMLAGKISPDSGEIEVGQTVKIAYYTQENEEMNLNQRMIEYIKEIAEVIHTTDGKVIGASQMLERFLFPPHSHGTPLGKLSGGERRRLYLLRILMGEPNILLLDEPTNDLDTQTLTVLEDYLEDFPRCRFNCIA

SEQ ID NO: 72988 - protein, 173 aa, Triticum aestivum
  misc_feature (13)..(13): Xaa can be any naturally occurring amino acid
  misc_feature (22)..(22): Xaa can be any naturally occurring amino acid
  misc_feature (28)..(28): Xaa can be any naturally occurring amino acid
  misc_feature (42)..(42): Xaa can be any naturally occurring amino acid
VRCCHPGVPWVFXGHFERRSLXGESGEXVGEKVAYALAQGLXKVIACVGEIFEQREAGSTMEVVADQTKAISGKIKDWTKVVVAYEPVWAIGPGKVATPVQAQEVHAILRDWFKTNVTPEVVASPGIFYGGFVIGASCKELPGQPDVDGFFVGGVFLNPEFLDIINAAPVKFP

SEQ ID NO: 72989 - protein, 592 aa, Escherichia coli O157:H7 EDL933
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTDFAWQAAVVGGIGLAMSSTAMALQLMREKGMNRSESGQLGFSVLLFQDLAVIPALALVPLLAGSADEHFDWMKIGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERR

SEQ ID NO: 72990 - protein, 310 aa, Clostridium perfringens str. 13
MNKICVLGSMNMDLVLKVKDMPKVGETILSKSFQKIAGGKGANQAVAAKRSGAEVFMISKIGKDENGRELRDKLVEDNIDVKYVFEDRIEPTGMALIMVNDNGNNSIIVNAGSNMTLTKEEIHSAENLIKESDIIISQFETPENITIEAFKIAKENGKVTILNPAPAKKIKDELLNYTDIIVPNETEAELLTGIEIKDIEDAKKAGDIFLGKGVKFAIITLGEKGAALIGKDFCEIVPAYRVNAIDTTAAGDSFIGGLSSKLDTKNLGKETLISSIRFGNKVSSIAVQRKGAQPSIPYLKEVLEIYKGEE

SEQ ID NO: 72991 - protein, 424 aa, Rhodopirellula baltica SH 1
MSFATLAGMKLPKFFRRFGPGLLVTAAFIGPGTVTKATTAGANFGHTLLWAIGFSVIATIVFQEMASRLGIVTGRGLGEAIRPTIPNALARGLAIVLVVSAIIVGNAAYQAGNIAGAAVGVAAATGMQHQTLVSIVIGLTAWCILMIGHYRSLQRILVALVVTMSCVFLLTALSVPIDWRSIALGWIQPTIPDGGLKEVLAIIGTTVVPYNLFLHATASAEKWSSDKKEPVSDENIRDAIQHSRGDTILSVGLGGLVTAAVMATATAAFFQSNTGFTNLADAARQLEPLLGNHARWLFGVGLFAAGLTSTITAPLAAAYAAAGCFGWPIDLKDWRLRTVFTTVIVFGTSFAASGSKPTDIITFAQIANGLLLPLLAIFLLAVMNNAALLGKHRNHWIANTLGVLTVVVVSVLGLRSLVSVSFAG

SEQ ID NO: 72992 - protein, 637 aa, Escherichia coli O157:H7 EDL933
  misc_feature (583)..(583): Xaa can be any naturally occurring amino acid
MIVFSSLQIRRGVRVLLDNATATINPGQKVGLVGKNGCGKSTLLALLKNEISADGGSYTFPGSWQLAWVNQETPALPQAALEYVIDGDREYRQLEAQLHDANERNDGHAIATIHGKLDAIDAWSIRSRAASLLHGLGFSNEQLERPVSDFSGGWRMRLNLAQALICRSDLLLLDEPTNHLDLDAVIWLEKWLKSYQGTLILISHDRDFLDPIVDKIIHIEQQSMFEYTGNYSSFEVQRATRLAQQQAMYESQQERVAHLQSYIDRFRAKATKAKQAQSRIKMLERMELIAPAHVDNPFRFSFRAPESLPNPLLKMEKVSAGYGDRIILDSIKLNLVPGSRIGLLGRNGAGKSTLIKLLAGELAPVSGEIGLAKGIKLGYFAQHQLEYLRADESPIQHLARLAPQELEQKLRDYLGGFGFQGDKVTEETRRFSGGEKARLVLALIVWQRPNLLLLDEPTNHLDLDMRQALTEALIEFEGALVVVSHDRHLLRSTTDDLYLVHDRKVEPFDGDLEDYQQWLSDVQKQENQTDEAPKENANSAQARKDQKRREAELRAQTQPLRKEIARLEKEMEKLNAQLAQAEXKLGDSELYDQSRKAELTACLQQQASAKSGLEECEMAWLEAQEQLEQMLLEGQSN

SEQ ID NO: 72993 - protein, 257 aa, Vitis vinifera
  misc_feature (39)..(39): Xaa can be any naturally occurring amino acid
MDWDRTLFHNSLIALYLIAPPTFISLRFLQAPYGKHHRXGWGPTVPPSLAWFLMESPTVWLTLLIYPLGDRSSNPRSLILISIYLFHYIHRTLIYPLHLRNSTAAKRNGFPVSVALMAFGFNLLNAYLQARWVSHYANYEDDGWFWWRFWVGLVIFLDGMLVNVRSDLALVGLKSQGGGYKVPRGGWFELVSCANYFGEVVEWLGWAVMTWSWVGLGFLLYTCANLVPRARANHKWYLEKFGEDYPKGRKAVIPFLY

SEQ ID NO: 72994 - protein, 289 aa, Escherichia coli O157:H7 EDL933
  misc_feature (23)..(23): Xaa can be any naturally occurring amino acid
MSAKHPVIAVTGSSGAGTTTTSXAFRKIFAQLNLHAAEVEGDSFHRYTRPEMDMAIRKARDAGRHISYFGPEANDFGLLEQTFIEYGQSGKGKSRKYLHTYDEAVPWNQVPGTFTPWQPLPEPTDVLFYEGLHGGVVTPQHNVAQHVDLLVGVVPIVNLEWIQKLIRDTSERGHSREAVMDSVVRSMEDYINYITPQFSRTHLNFQRVPTVDTSNPFAAKGIPSLDESFVVIHFRNLEGIDFPWLLAMLQGSFISHINTLVVPGGKMGLAIELIMLPLVQRLMEGKKIE

SEQ ID NO: 72995 - protein, 483 aa, Moritella sp. PE36
MNAKMVKGVNSPVLPTISFDELPGPKQQAILGNFTQISAESFHTHLEQWAKEYGSAYQMRLLNKPYLVISDPKIGLEIIKQRPKLFNRTERLEWLFEDLGIHGVFSSNGDKWKRQRRLIMPAFSYNTLANFVPQLKSLSINLQVAIDKKIATGEAFNVHKLLQHFTIDITTSLVFGYQTNMLSGSSDTHLRDNIDRLFRALNKRSKYPFPWWRYIRTPETRRIDKAREEVYQLAVSMITKAKVVLAENSALAEEPETILQAMIVASDSEENKLTDDELVANILTLLLAGEDTTSNMLAWTLFYLAQNPSLQQQVIDEVSRVCDGDIENVDLTALEQFEFIDAILREGLRLKGTAPLISAEPTEDTVLSNGIKLPKGTAIFILTRPGGLDEKVVACPEKFNPERWLSTPEKPVCPHLQSSHIPFGAGARHCPGERLAMMEGKAVIARLCWYYVISQPEQAPEVGEEFAFTMRPTNLALTLTPRK

SEQ ID NO: 72996 - protein, 408 aa, Oryza sativa Japonica Group
MAVQVQRTPLPRSTYTGHRVYLLRAPPAVTRCTVDRAFPRSHGPPLPPLLYKTSRPDASSSNSTSRHFPRRSKDCCCFAVRSIPDGIMGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGAGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 72997 - protein, 342 aa, Mesorhizobium loti MAFF303099
MRALQLIEDRRLETVDLPPPPPPALGEVTLRIRAVALNHIDVWGWRGMAFAKRKLPLVVGAEASGEVEAVGPGVSSLLPGQLVSIYGARTCGLCRACREGRDNLCEHVSGVHGFHLDGFAQEKINLPARLLVPAPPGVSDIGAAVAPVTFGTVEHMLFDNARLQPGETILVHAGGSGIGSAAIQLAKRMGCTIITTVGSNDKIDKAKALGADHVINYREDRFEGVVRKLTKKKGVDVVFEHVGADTFAGSMLCLKRGGRLVTCGSTSGVSTQINLMQLFQQQLKLLGSFGCRMENMANAMQKMAAGQVAPVIDTEVGFDDIDAALKRMEGRDVFGKIILRVA

SEQ ID NO: 72998 - protein, 324 aa, Cryptococcus neoformans var. neoformans B-3501A
MFRAPSQILRRAYHPGPSRFGSYPLLPSSSAITSYPEPLPVPDHIRRPQYVPINFFTAPWGEHNIPEMGVDNETEGARIALGSKEEWGVRMACRVAADILKRAGHRIVKPGITTAQVDKAIHEMIIEHGAYPSPLGYSNYPKSCTTSINNVIVHGIPDNRPLHPQDIINIDLTIYLDGYHGDTSATFVLPEVDKLGRELVSATQEALDLGIRVCKPGVQISEIGKVIGEFSKRHGFSVNSQISGHGIGKVFHQPPWIFHDVNSEPGKMMPGDCFTIEPCLVQGVNSRGDIWDDGWTLATRTGARAAQFEHQVLITDDGVEILSI

SEQ ID NO: 72999 - protein, 325 aa, Pseudomonas putida KT2440
MFQELTMGLLIDGRWHDQWYENGKDGTFKRENAQRRNQLPAPEAGRYHLYVSLACPWAHRTLIFRALKGLEPLIDVSVVSWLMQDHGWTFDQQQGSSGDHLDALQYLHQRYTQDDPHYTGRVTVPVLWDKKEKRIVNNESAEIIRIFNSAFNELTGNTLDLYPASLRPTIEALNERIYPAVNNGVYRAGFATTQDAYEAAFEDVFNELDYLEALLGRNRYLAGEYLTEADVRLFTTLVRFDAVYHGHFKCNLRRLSDYHNLSNWLRELYQWPGVAGTVNMEHIQKHYYMSHKTINPNGIVPKGPLQDFGLPHDRERLAGKGIWQA

SEQ ID NO: 73000 - protein, 403 aa, Pyrococcus furiosus DSM 3638
MFTNLVKMGKKLKNLTKKYQLNKEKIEKFITVRKRLTFLGERPSVVEKPVVVKFGGTSVRYAFEEALELVANLNENTRTIVVVSALAGVTDCLLRLANGDMSALLEIEEIHEELSQELDVQLDHLMYQLHKTLNSKSSFPSKEAFVDEIASFGERFSAELFSEGLKILGINAKAVDSKDILFAKGDYGNAEVDFKKSVYGAGILYRMLRRGIVPVVTGYYGNLNGFRATFGRGGSDYSATSIARLVNAKATLIMSDVEGIYTADPKLVPSAKLIHYISYREAKIAAKLGMKALHHRAIDPVEGRIPVILGKTRDLKFGTLISHKSQGIPVVVHKLIEDHAEVSVVSTRRSFSLPYEVYEEGDFYFKIKIPKEQFLEVLKDIHRRVVENESLRPSYDSELWAWV

SEQ ID NO: 73001 - protein, 521 aa, Streptococcus pyogenes M1 GAS
MTVKEETMSILEVKQLSHGFGDRAIFENVSFRLLKGEHIGLVGANGEGKSTFMSIVTGHLQPDEGKVEWSKYVTAGYLDQHTVLESGQTVRDVLRTAFDELFKTENRINEIYASMADDKADIAVLMEEVGELQDRLESRDFYTLDAKIDEVARALGVMDFGMESDVTSLSGGQRTKVLLAKLLLEKPDILLLDEPTNHLDAEHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 73002 - protein, 130 aa, Brassica napus
  misc_feature (52)..(52): Xaa can be any naturally occurring amino acid
  misc_feature (108)..(108): Xaa can be any naturally occurring amino acid
KRVLLNLRSIYVFAERCTYGERILGSSSEYVQSNITRYFSDPQYYFQVNDQXNKLKVVLFPFLHRASFKTSSCFASNDQGHWARISEPVGGRLSYKPPIYDINASDLXIPFMAFGTYVVLAGLSLGLNGK

SEQ ID NO: 73003 - protein, 347 aa, Arabidopsis thaliana
MSARHGQSSYRDRSDEFFKIVETLRRSIAPAPAANNVPYGNNRNDGARREDLINKSEFNKRASHIGLAINQTSQKLSKLAKLAKRTSVFDDPTQEIQELTVVIKQEISALNSALVDLQLFRSSQNDEGNNSRDRDKSTHSATVVDDLKYRLMDTTKEFKDVLTMRTENMKVHESRRQLFSSNASKESTNPFVRQRPLAAKAAASESVPLPWANGSSSSSSQLVPWKPGEGESSPLLQQSQQQQQQQQQQMVPLQDTYMQGRAEALHTVESTIHELSSIFTQLATMVSQQGEIAIRIDQNMEDTLANVEGAQSQLARYLNSISSNRWLMMKIFFVLIAFLMIFLFFVA

SEQ ID NO: 73004 - protein, 473 aa, Brucella melitensis 16M
MRIGKMEMQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINQLRSGPAGSALRRDQRFRLWNGRRCRRA

SEQ ID NO: 73005 - protein, 486 aa, Mycobacterium leprae
MQDMSAPESKTAIAQIGVTGLAVMGSNIARNFARHGYTVALHNRSIAKTDTLLKEHGSEGNFVRTETIPEFLAALQTPRRVLIMVKAGDATDAVINELADVMEPSDIIIDGGNSLFTDTIRREKAMRERGLHFVGAGISGGEEGALNGPSIMPGGPAESYTSLGPLLEEISAHVDGVSCCTHIGPGGSGHFVKMVHNGIEYSDMQLIGEAYQLLRDGLGMSAPQIADVFTEWNRGDLNSYLVEITAEVLRQTDIKTGRPLVDVILDKAEQKGTGRWTVQSALDLGVPITGIAEAVFARALSGSVLQRKAAIGLASGKLGNKPTDRETFIEDVRQALYASKIVAYAQGFNHIQTGSTEFGWNITPGDLATIWRGGCIIRAKFLNRIKEAFDAAPDLASLIVAPYFRSAVESAIDSWRRVVSTATQLGIPNPGFSSALSYYDALRTERLPAALTQAQRDFFGAHSYGRVDARGKFHTLWSEDRSEVTV

SEQ ID NO: 73006 - protein, 1411 aa, Arabidopsis thaliana
MGKSKKKVLNKSLITHPSTSDDTLQLFDPTSSPTKEKVNWNNVLGISDYLSKQATRVKTLWTGETPKAESVKETMESYFKALLGFLLCCHGSTLGAGPTLSSIVHGSVKQIVDSSFRLFQGSVSLYDGSYEKGEKPSISQLSGAVLEACSSFKKVPTTNLIAIGSAISQVSVIMKDVLNEMKKVKPACPSSEGEASGDDFSPEQIEVAKMVADIVYEAMTVIIVIRVITRMMEKENSNENSVFVESLEKLLKLCQRSGVVIEELGTCVYHPPLKIDKITQTVKILEGNLDEVEAQVEYMKRSSNAFPGVCRKLRDAIKLMEVGLEKRKDLNQILISRQNTLYNALQLFDGTASPTVERVNWNDVLQMSDHLSKQATIVGMLWTGESPKADSLKETMESYFNALQGFLLCCHGSTLGAGPTLSSIIHVSVKQIVDSSFRLLQGSVSLYEGSYEKDKKPSIPQLSGVVWEACSSFKKVPATNITAIGRAITQVAVSMKDVLREMKEVKPACPLSECEASGDNMSSDDDDDDDLGDDLSPEEMEVATMVTEIVSETIMVIKELIRVITGMIKMENPKDNSGFVESLEKLLKLCQGTGVQIDELGACVYPPQEMNKMKQTVKVIQGNLDEFETEVERLKSSSDGFSGACGKLRNSLKHMETELDKRCEAELVVEMQNVTLDKRKVEQRTEFNGFNRGFYEIESRLNRASRSFFSISTTNNNNNLSRFLFRFSTLPHCAASSSSSSSNLESYYANLILSSHGDSNKPNRKWSSHQFRLLLTDPNLLIRVLNMIRVKPEIAFRFFNWIQRQSDVKQSRQAFAAMLEILAENDLMSEAYLVAERSIDLGMHEIDDLLIDGSFDKLIALKLLDLLLWVYTKKSMAEKFLLSFEKMIRKGFLPSVRNCNIVLKVLRDSRMMNKASAVYETMIEHGIMPTVITFNTMLDSCFKAGDLERVDKIWLEMKRRNIEFSEVTYNILINGFSKNGKMEEARRFHGDMRRSGFAVTPYSFNPLIEGYCKQGLFDDAWGVTDEMLNAGIYPTTSTYNIYICALCDFGRIDDARELLSSMAAPDVVSYNTLMHGYIKMGKFVEASLLFDDLRAGDIHPSIVTYNTLIDGLCESGNLEGAQRLKEEMTTQLIFPDVITYTTLVKGFVKNGNLSMATEVYDEMLRKGIKPDGYAYTTRAVGELRLGDSDKAFRLHEEMVATDHHAPDLTIYNVRIDGLCKVGNLVKAIEFQRKIFRVGLVPDHVTYTTVIRGYLENGQFKMARNLYDEMLRKRLYPSVITYFVLIYGHAKAGRLEQAFQYSTEMKKRGVRPNVMTHNALLYGMCKAGNIDEAYRYLCKMEEEGIPPNKYSYTMLISKNCDFEKWEEVVKLYKEMLDKEIEPDGYTHRALFKHLEKDHESREVEFLERLLLS

SEQ ID NO: 73007 - protein, 90 aa, Brassica napus
METQKTQAENQPKPAMSSCRKMVKDDANFLEDVKDHIDEFINASMDDHKNCFNKTIKKMFGLSKAVAEKQQAEEAKGVESYLPLQTTLSD

SEQ ID NO: 73008 - protein, 550 aa, Chromobacterium violaceum ATCC 12472
MTGDSPLQQQHSRHIGPIALMLTGLGSIIGSGWLFGAAHAAQIAGPAAIVAWIVGMVIILSIALSYAELGAMFPESGGMVRYARYSHGSLLGFIAAWANWIAIVSVIPIEAEASVQYMSTWPYPWAQNLYHNGELSTVGLSFAAVLVIAYFLLNYWGVKLFAKANSAITIFKVIVPAVTVGALIYSGFHSENLNNPAMGGFAPFGWASVMTAVATSGIVFSFNGFQSPINLAGEARNPGKSVPFGVVGSILLAAVIYVALQVAFLGALSPSELAHGWKGLDFSSPFAQLAMALGLNWLMMTLYFDAFVSPSGTGATYMASTSRMIYGMQRNGTMPEIFGRIHPLYRIPRPAMWFNLAVSFVFLFFFRGWGTLAAVISVATVISYLTGPISAAALRRCAPDLPRPLRLAGLSVVAPFAFVCASLVLYWARWPLTGQILFLIVAALPVYIWYQAKAGWPEFARELKGALWMVLYLPAMALLSYIGSVDFGGIGLLPYGVDMAVVAAASLGFYFWGVNSGWYTRYLRDEHDPKLVEAMQQEAKASGKLAEQRG

SEQ ID NO: 73009 - protein, 583 aa, Rhizobium leguminosarum bv. viciae 3841
MSMTPDLQQRFSNLGENDIDVLIIGAGINGAGLFRDLSLQGVNCLIVDKADFGSGTSAAPSRLIHGGLKYLETGEFGLVAQSTLERNLLLKNAPHCVEPLPTFIPVFSWTRGIWAAIRTLFGSKTAPRSRGAVLIKIGLRLYDFFGSRDQVMPRHRLILKKQARREMPHITPAIVAGGIYYDAKISRPERLVYELVNDGLDTNAGSLAANFATLAAVSEGRLTFRQPDGREFSVAPKLVVNAAGPWIDQVNTLLGAPSRLIGGTKGSHILLDHPELVRSLNGHMIYFEADDGRICLVYDYLGLALVGSTDIPAGDPDNVSCEEPETEYFLESIRSLLPTLRFDRDQIVYSYSGIRPLPASDATAPGLISRDHSAPVKEPEDGRPFPVVSLVGGKWTTFRGFAEEVADTVLSRLQRSRSQSTRYLAIGGGKAFPADAEQRNAWISDTAARGGVAAERAGELLGRYGTTAVALLSSPSGYSDEQRLTGAPRYSLREIDWVARNELVIHLSDIVMRRTTLAIEGRLTLEGLREIAGVAEAALGWDGERTASEIQDVVSQLSRFHGQALTGKPAAAEPEKAPRPALG

SEQ ID NO: 73010 - protein, 466 aa, Salmonella enterica subsp. enterica serovar Paratyphi A str.
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALCKVIAILAFIALGATAISGFYPYAEVSGISRLWDHGGFMPNGFGAVLSAMLITMFSFMGAEIVTIAAAESDTLDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 73011 - protein, 810 aa, Arabidopsis thaliana
MSNEPESSDSKTKKDFSTAILERKKSPNRLVVDEAINDDNSVVSLHPTTMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSAGDAGGAADRVLNQLLTEMDGMNAKKTVFIIGATNRPDIIDSALLRPGRLDQLIYIPLPDEDSRLNIFKACLRKSPVAKDVDVTALAKYTQGFSGADITEICQRACKYAIRENIEKDIENERRRSQNPEAMEEDMVDDEVSEIRAAHFEESMKYARRSVSDADIRKYQAFAQTLQQSRGFGSEFRFDSTAGVGRTTGVAAADPFATSAAAADDDDLYS

SEQ ID NO: 73012 - protein, 209 aa, Oryza sativa
MTTAAIAKRISIVGSGNWGSTIAKIIGRNVETNPKFENQVKMYVYEEMVHGRKLTEIINTDHENVKYLPGHKLPENVVAIPDVVEAAHDADIIIFVLPHQFIATTCKPLVGKIKSDAFGVSLCKGFYVNDKGRVDLISNMVRNLLGIECGVVMGANIANEVAAELFCEATIGSKDLEKGNLLKEALETSYFRIAVCKDAESVEACGALK

SEQ ID NO: 73013 - protein, 328 aa, Populus trichocarpa
MRGFGYFVVMFFCLLVFMGSTEGQLQMGFYSRSCPNAEKIVQDYVNRHVHNAPSVAATILRMHFHDCFVRGCDASLLLNTTSSGNQTEKLATPNVTLRGFDFIDRVKSLLEAACPGVVSCADVIALVARDAVVATGGPFWKVPTGRRDGTISRSSEASNNIPPPTSNFTSLQRLFANQGLDLKDLVVLSGAHTIGVSHCSSFSNRLYNFTGVLGTQDPALDSEYAANLKARKCRSLNDNTTIVEMDPGSFRTFDLSYYGHLLKRRGLFQSDSALTTNSTTLSFVNQLLQGSLENFFAEFADSMEKMGRINVKTGTVGEIRKQCAVVNS

SEQ ID NO: 73014 - protein, 271 aa, Zea mays
MGGALLLTLLLAAVPLSLGGGGGAHPGYSDDDESACTVDAGAELLRRMEERGPDRRIIDITHAVVPDLPAFATGAVAGPMLRLRESMADGSEYNLSELRMECHTGTHVDAPGHINQAHFAAGLDVDTLDLHVLNGPALLVDVPRNTNITAEAMEFLNIPRGVRRVLFRTLNTDRKLMWRKGGDMSYVGFTEDGAQWLVDNTDIKLVGVDGLSVASFDHLISAHVVFFKTPDIIPVESLNLDDIEAGIYMLHCLPLRLVGAEGAPTRCILIK

SEQ ID NO: 73015 - protein, 396 aa, Bacillus cereus G9241
MKQFELSRAAESLQPSGIRKFFDLAANMKGVISLGVGEPDFVTPWNVRQACIRSLEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEVYTSFASIKNMRDHTILISGFSKGFAMTGWRLGMIAAPVHFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKHNTFCP

SEQ ID NO: 73016 - protein, 360 aa, Magnaporthe grisea 70-15
MATARALRIGLIAGDGIGKDVVPAGRRVLEALPASLGLRFSFVDLQAGFQTFEETGSALPDRTVETLKGECDGALFGAVSSPTKPVKGYSSPIVGLRKKLDLYANVRPVKTVVSAPRPIDMVIVRENTEDLYVKDERTFDAPDGSGPVAEAIKRISYRASHRIASMAGEIALRRQKIRAAGAPSIHSSPLVTITHKSNVLSQTDGLFRSTAKEALADPKYAGSVAVEEQIVDSMVYKLFRQPEDYDVIVAPNLYGDILSDGAAALVGSLGLVPSANVGDGFVMGEPCHGSAPDIMGKNIANPIATLRSAALMLEFLNEEEAAAKIYAAVDANLVEGKVLSPDLGGKATTDQVLEDILRRL

SEQ ID NO: 73017 - protein, 416 aa, Helicobacter pylori 26695
MENSTLYIVIAGLWLAVGFGIFLKKLDMPVIIGYICTGTVLAAFFKINDFDLLSDIGEFGIVFLMFMIGIEFNFDKLKSIKQEVLVFGLLQVVLCALIAFLLGYFVLGLSPIFSLVLGMGLSLSSTAIVLKFFEDSKQLSTPMGKSAVGILIFQDIAAIPMLLILTILGSKDSNVNLLILKTFISAGIILVLLLLPGKKGANLILEQAKDTRLPEIFIGTILVIVCSAAGLSHFFGFSMSLGAFIVGMAISKSRYKINVQEEFAQLKNLFLALFFITIGMQINVSFFMEKFFVVIFLLILVMGFKTAIIYALLRFFRDAKTAIKTALSLAQIGEFSFVIFLNSGSHQLFNLQEKKGILGFLHQKNILNIAQNDIHQLLILMVVFSMLATPFILKYLESIAQFILHQKSQENEPAKK

SEQ ID NO: 73018 - protein, 349 aa, Aspergillus flavus
MSIPEMQWAQVAEQKGGPLIYKQIPVPKPGPDEILVKVRYSGVCHTDLHALKGDWPLPVKMPLVGGHEGAGVVVARGDLVTEFEIGDHAGLKWLNGSCLACEFCKQADEPLCPNASLSGYTVDGTFQQYAIGKATHASKLPKNVPLDAVAPVLCAGITVYKGLKESGVRPGQTVAIVGAGGGLGSLALQYAKAMGIRVVAIDGGEEKQAMCEQLGAEAYVDFTKTQDLVADVKAATPEGLGAHAVILLAVAEKPFQQAAEYVSRGTVVAIGLPAGAFLRAPVFNTVVRMINIKGSYVGNRQDGVEAVDFFARGLIKAPFKTAPLQDLPKIFELMEQGKIAGRYVLEIPE

SEQ ID NO: 73019 - protein, 314 aa, Leptospira interrogans serovar Lai str. 56601
MKEFKNSVDLLSKLQYKVRNKNRSQTMESNLLTTVFLPIALGIIMLGMGMSLTVEDFKRIFVLPKAVITGLILQLFLLPLTGWFIANVFKLPSELSVGLMILAICPGGATSNLITHLAKGDVALSITLTAITSCITVLSIPFLLNISMHHFLGSGQMIKLNIPQTILQIFMITVLPVSIGMILNSKKPELSRKFEKTVKVLSGIFLVLIILGAIVRERQNIIPYFIQVGPASLALNLITMFLGYLGATLMKVTHPQRTSITIEVGIQNGTLGITIASAILNNPTMAIPSAIYSLIMFATGAIFSIWTNKSSNPT

SEQ ID NO: 73020 - protein, 186 aa, Triticum aestivum
PGSTILCADGTITLTALSCDPEKGLVRCRCENSALLGERKNVNLPGVIVDLPTLTEKDKVDILQWGVPNKIDMIALSFVRKGSDLQMVRSVLGEHAKSIILMSKVENQEGVANFDDILANSDAFMVARGDLGMEIPIEKIFFAQKVMIFKCNQQGKPVVTATQMLESMIKSPRPTRAEATDVANAV

SEQ ID NO: 73021 - protein, 350 aa, Candida albicans
MSEQIPKTQKAVVFDTNGGQLVYKDYPVPTPKPNELLIHVKYSGVCHTDLHARKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 73022 - protein, 497 aa, Zea mays
MFSHGADSAHDAGTVGVSSGVGATVPARFVWPYGGKRVFVSGSFTRWSEHLPMSPVEGCPTVFQAICSLSPGIHEYKFYVDGEWRHDERQPTISGEFGIVNTLYLTREFNQINALLNPSTPGSRMNMDVDNENFQHTVTLSDGTIPEGTVRVSEAAIQISRCRVSEYLNLHTCYDLLPDSGKVIALDINLPVKQSFHILHEQGIPVAPLWDSFRGQFVGLLSPLDFILILRELETHGSNLTEDQLETHTISAWKEAKRQTCGRNDGQWRAHQHLVHATPYESLRDIAVKLLQNDISTVPVIYSSSSDGSFPQLLHLASLSGILKCIFRYFKNSTGNLPILNQPVCSIPLGSWVPKIGDPNSRPLAMLRPNASLSSALNMLVQAGVSSIPIVDENDSLLDTYSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 73023 - protein, 327 aa, Pseudomonas syringae pv. phaseolicola
MKITSLKNRNLLTMNFFNQSELSHLIDRAIECKRLKKDRIFNLGLNHLNICGIFLKPSGRTSTSFVVASYDEGAHFQFFPADNIRFGHKESIKDFARVVGRLFDGIAFRGFEHEVAEELAKHSGIPVWNALTDTHHPTQVLADVMTVKEEFGRIEGVTIAYVGDGRNNMVTSLAIGALKFGYNIRIIAPNALHPTDAVLAGIYEQTPERNGSIEIFTEVAAGVHQADVIYTDVWISMGESVSVEERIALLKPYKVTEKMMALTGKADTIFMHCLPAFHDLDTEVARETPDLVEVEDSVFEGPQSRVFDQGENRMHTIKALMLETVVP

SEQ ID NO: 73024 - protein, 418 aa, Pseudomonas putida KT2440
MGYQKIKVPTDGTKITVNADHSLNVPDHPIIPYIEGDGIGVDVSPVMIKVVDAAVQKAYGGKRKIAWMEVYAGEKATQVYDQDTWLPQETLDAVRDYVVSIKGPLTTPVGGGIRSLNVALRQQLDLYVCLRPVLWFQGVPSPVKKPGDVDMVIFRENSEDIYAGIEWKAGSPEANKVIKFLKEEMGVTKIRFDQDCGIGVKPVSKEGTKRLVRKALQYVVDNDRESLTLVHKGNIMKFTEGAFKDWGYEVARDEFGAELLDGGPWMKFKNPKTGREVIVKDAIADAMLQQILLRPAEYDVIATLNLNGDYLSDALAAEVGGIGIAPGANLSDTVAMFEATHGTAPKYAGQDKVNPGSVILSAEMMLRHMGWTEAADLIIKGTNGAIAAKTVTYDFERLMEGAKLVSSSGFGDEMIKHM

SEQ ID NO: 73025 - protein, 470 aa, Moritella sp. PE36
MSNNVFQFVDVQRIDPDKKALKIRKVDFIEIYKPFTSNQAKMQSGRCLECGNPYCEWKCPVHNYIPNWLKLVEEGRIIEAAELCHETNSLPEVCGRVCPQDRLCEGSCTLNDDFGAVTIGNVEKYITDEAFKMGWRPDMSKVVRNNKKVAIIGAGPAGLGAADILVRNGVTPVVFDRNPEIGGLLTFGIPAFKLDKSVMSHRREVFTEMGIEFRLNTEIGKDIQFSELVAEYDAVFVGVGTYKYINGGFDNGSAQGVYDALPYLIANVNHELGFEKNADDYINLKGKTVVVLGGGDTAMDCVRTAIRQGAKDVYCAYRRDEISMPGSKREVKNAKEEGVKFLWNLQPLDIEVAGDKATGVNMVKTRLGNPDKKGRRRAEQVIGSEHVLKADAVIQAFGFQPNPAEWLLDEGVTTNSWNGIIAPEKSDFPFQTENPKIFAGGDAVRGSDLVVTAIDEGRRAAEAMLDYLEV

SEQ ID NO: 73026 - protein, 443 aa, Bacillus licheniformis ATCC 14580
MKRIAVIGTGYVGLVSGTCFAEVGNSVVCCDIDAEKIRGLSAGVMPIYENGLKELVDKNVNENRLFFSTDIPKAIEEAEIIYIAVGTPMSETGEADLTFVKSVAEMIGKHLNGYKVIVNKSTVPVGTGKLVQAIIERNSKGEFPFDVVSNPEFLREGTAIYDTMNMERAVIGATSEKAAAIIEELHKPFQTKIVKSNLESAEMIKYAANAFLATKISFINDIANICERVGADVSKVSEGVGLDSRIGSKFLKAGIGFGGSCFPKDTMALLQIAKSVGYPFKLIEAVIETNQKQRAHIVQKLLDVFGDLNGMTISVLGLAFKPNTNDMRSAPSLDVIPMLRSLGAKVKAFDPIAVPEAEKLLGDQAVYSEDLYETIQDTDACVILTEWPEVQNMDIAKLKSALKNPVLIDGRNIFEIEQMRNEGMIYHSIGRPEVQGEGILTNV

SEQ ID NO: 73027 - protein, 269 aa, Brucella melitensis 16M
MSQQNGNVNRVGAQDRVGASGGMEHSFGFKAVDENEKQGLVNDVFHKVAKRYDIMNDLMSAGMHRVWKDAMVAWLAPSKRPGWTSLDVAGGTGDIAFRIVEASGRQAHVTILDINGSMLGVGRERAIKKGLIDNLEFVEANAEELPFEDNSFDAYTIAFGIRNVPHIDKALSEAYRVLKPGGRFLCLEFSEVELPVLDKVYDEWSFRAIPRIGKMITGDADSYSYLVESIRKFPKQQDFAAMIEKAGFERVSYRNFTGGIAALHSGWKL

SEQ ID NO: 73028 - protein, 346 aa, Physcomitrella patens subsp. patens
MILEKLRIGINGFGRFGRLVARVALESDDVELVAVNDPFISTDYMAYMFTFDTVHGQKLAKSDIYAQDSHTLSFAGKKVAVYGQKDLAKIPWSKHRADYVVECTGNYTDKDRASAHLKGGAKKVIITGFSKDAPTFVVGVNEREYRPEHNVVSMGGCTTNCMTPLMKVLHERFGVAEALMTTVHSLTATKKSLDGPSLKEWRSGAAAGFNLIPSSTTASKAIGRLIPTLNGKVRSIAFRVPTPDASLVDLTVKLNRRVPYEEICAAIREEADGKMKGILGYNDNDPASCEFIGDSRSSIFDSKAGFALAENFVKLVAWYDNEWGYSHRVLDLIMHMSSVQHSRYHF

SEQ ID NO: 73029 - protein, 125 aa, Glycine max
  misc_feature (38)..(38): Xaa can be any naturally occurring amino acid
  misc_feature (79)..(79): Xaa can be any naturally occurring amino acid
  misc_feature (99)..(99): Xaa can be any naturally occurring amino acid
  misc_feature (104)..(104): Xaa can be any naturally occurring amino acid
  misc_feature (112)..(112): Xaa can be any naturally occurring amino acid
GRKFFVGGNWKCKGTTDEVKKMVTTLNDAKVPGQNVVXVVVSPSFVFLPVIKRLLRPDYHVSAQNSWVRIGGAYTVDSXTEMLVNLEIPLVIIGHLERXQAINXSNELLGNXVDYALQLGLNVIT

SEQ ID NO: 73030 - protein, 181 aa, Chromobacterium violaceum ATCC 12472
MKSNIRQYDGHHPEIADGCYIDPAAVVIGEVKLETGASVWPCAVIRGDVNRIHVGENSNVQDHAMLHVSHRSAADPEGAPLIIGRHVTIGHHVTLHGCTIGDEVLIGIGSIVLDRAVIEDRVLIGAGSLVPPGKRLQSGYLYLGNPVKQARPLTDKELAYFKYSAEHYLRVADKHKVNLED

SEQ ID NO: 73031 - protein, 92 aa, Zea mays
  misc_feature (32)..(32): Xaa can be any naturally occurring amino acid
FDENAKIGQATVASGIPAGWMGLDCGPESSKXYAEAVTRAKQIVWNGPVGVFEWEAFARGTKALMDEVVKATSRGCITIIGGGDTATCCAKW

SEQ ID NO: 73032 - protein, 445 aa, Bacillus licheniformis ATCC 14580
MKNETALKRSLTLGPLVVIGLAYMDPLVVFDSYGVVAQLTKGHVPAAYVFTVAALLLTALSYGSMVKAYPKAGSVYTYAYESIHPHAGFLAGWTIMLDYLFLPMVNFAIGSAYLTAAFPEVPHGFWVVLLALSITVVNVLGIRLTANITGLFVAFQVIVALTFAGFMIAGLAGGLGTGELISADPFFHSDIEPSLIVSGATILCFSFLGFDAISTMSEETVNPKKNIPLAIFLTVAIGGTLFTAISYLMQQIYPSYDNFRHADSASLEIALYTGGAFLKSFFLAGTMVAVISSSLSSHASASRLLYAMGRDSSLPKRFFGYVHPTLKTPVFNILFIGLISLTAMIGELEVIYSFISFGALIGFIFVHLSVIGHYYIRRQEKGFLKTLRYLVMPFLGASFCGWLLLSISKNALIIGAGWLIAGFIYFLFRIRSLPDVTFGFDRDPR

SEQ ID NO: 73033 - protein, 478 aa, Bacillus licheniformis ATCC 14580
MMKGKRSNAWLYFFGALGGVLYGYDTGVISGAILFMKDELGLNAFTEGLVVSAILIGAIFGSGLSGRLTDRFGRRRAIMSAAVLYCIGGLGTALAPSTEYMVAFRIVLGLAVGCSTTIVPLYLSELAPKESRGALSSLNQLMITIGILLSYLINYAFSDAGAWRWMLGLALIPSIGLLIGIFFMPESPRWLLTKGKEEKARRVLSKMRGGERVDQEVKEIKEAEKQDQGGLKELLEPWVRPALIAGVGLAFLQQFIGTNTIIYYAPKTFTNVGFEDSAAILGTVGIGTVNVLMTLVAIRFIDRIGRKPLLLFGNAGMVISLIVLSFSNLFFGNTSGAAWTTVICLGVFIVVFAVSWGPIVWVMLPELFPLHVRGIGTGVSTLMLHAGNLIVTLSFPVLMEAMGISYLFLCYAAIGIAAFLFVFFKVTETKGKVWKRSSRICGTSTAESRQLTHSRLNDRQKDGQGPILFCVKRPADHG

SEQ ID NO: 73034 - protein, 503 aa, Rhizobium leguminosarum bv. viciae 3841
MTEPELLDLFVIGGGINGAGIARDAAGRGLKVVLCEKDDLAQGTSSRSGKLVHGGLRYLEYYEFRLVREALIEREVLLNAAPHIIWPMRFVLPHSPEDRPAWLVRLGLFLYDHLGGRKKLPGTRTLNLLRDPEGTPILDQYTRGFEYSDCWVDDARLVTLNAVSAAENGALVLTRSPAVSARRENGGWTVVTKSNATGETRTFRAKCLVNCAGPWVMDIINRVAGSNSGRNVRLVKGSHIIVPKFWAGANAYLVQNHDKRVIFINPYEGDKALIGTTDIAYEGRAEDVAADETEIEYLLKAVNRYFKEKLRRHDVLHSFSGVRPLFDDGKGNPSAVTRDYVFDLDETGGAPLLNVFGGKITTFRELAERGMQRLKHIFPNMGGDWTEKAPLPGGEIPNADYESFANSLRDIYPWMPRKLVHHYGRLYGARARNVVAGATGIEGLGRHFGGQLYEAEARYLVATEWAETADDILYRRTKHYLHLNEAERAAFGEWFASTRLAAA

SEQ ID NO: 73035 - protein, 155 aa, Streptococcus pneumoniae TIGR4
MNTYEGNLVANNIKIGIVVARFNEFITSKLLSGALDNLKRENVNEKDIEVAWVPGAFEIPLIASKMAKSKKYDAIICLGAVIRGNTSHYDYVCSEVSKGIAQISLNSEIPVMFGVLTTDTIEQAIERAGTKAGNKGSECAQGAIEMVNLIRTLDA

SEQ ID NO: 73036 - protein, 487 aa, Skeletonema costatum
MSEVQSGQAEIKKYQTYALNVDPLQDDKATEIKLCNFSRPHMRAFHCSWFCFFTAFFIWFAIAPLMPEIKTTLGLTKQQIWTSNICSVAGTIFMRFVNGPICDKYGARIPMGFILVGASIPCAMTGLVTNAANLSVLRFFIGLGGSTFVMCQYWTSRMFTKEVVGTANALVGGWGNLGGGVTQLIMGSVLFPLFKLGMSAEMAWRTVCIVPAVVGIAVGFIILKISDDAPKGNYNEMKKNGTMAEVSAAASFRAGAMNFNTWLLFVQYACCFGVELTMNNAAALYFREKFLLTTETAAAIASLFGWMNLFARGVGGFVSDKANARMGMRGRIWWQTICLVCEGIMVLIFAHSNSLGAAIVLMVIFSSFVQAAEGSSYGIVPYINPPATGSIAGIVGAGGNTGAVAFGLGFRQLPYYDAFILMGSCIIASGVLSLFICIKGHAGLVTGQDSEEAIAAWKKLGSAPAATTLQVPEPDEDAAAEIEEDKA

SEQ ID NO: 73037 - protein, 256 aa, Rhizobium leguminosarum bv. viciae 3841
MTEKPRFWIGTSWKMNKTLTEAEQFARGLEAADGARDPRIHRFVIPPFTAVREVKAMLAKTSVKVGAQNMHWADQGAWTGEVSPVMLKDCNLDLVELGHSERREHFGETDETVGLKTEAAVRHGLIPLICIGETLSDRESGKAADILATQVRGALSKLSGAQKSAEILLAYEPVWAIGEKGIPATADYADARQSEIIAVAEAVLGRKIPCLYGGSVNPQNCEELISSPHIDGLFIGRSAWNVEGYLDILARCAAKL

SEQ ID NO: 73038 - protein, 401 aa, Streptococcus pneumoniae TIGR4
MEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLREYHIGAKMLKDLGLQSLHLLTNNPDKVEQLEKYGITISSRISIEIEANPYDSFYLETKKNRMGHILNMEEK

SEQ ID NO: 73039 - protein, 445 aa, Thalassiosira weissflogii
KPHMRTFHCSWICFFTAFFIWFAIAPLLPEVKETLGLSKQQVWTSNICSVAGTIFMRFVNGPLCDKYGARILMGAMLFLASIPCALTGLVQNSAQLCVLRFFIGLGGSTFVMCQYWSSRMFTKEVAGTANAIVGGWGNLGGGVTQLIMGSVLFPLFKTGMSAEQAWRTVCIVPAVVGMTLGILVTKISDDAPKGNYSEMKKNGTMPEVSAAASFRTGTLNVNTWLLFIQYACCFGVELTMNNAAASYFKSTFELTTESAAAIASIFGWMNLFARGLGGFFSDKLNSKMGMRGRLIVQTICLVAEGVLVFVFANTPQLWAAILVMVFFSMFVQAAEGSTYGIVPYVNPPATGSIAGIVGAGGNTGAVCFGLGFRQLEAKPAFYLMGGCIVASGVLSLFICIKGHAGLVTGQDNPEVIAAYKKTAGAASATIQVPEPDAEAAEEMEK

SEQ ID NO: 73040 - protein, 365 aa, Rhodopseudomonas palustris CGA009
MGFKCGIVGLPNVGKSTLFNALTETAAAQAANYPFCTIEPNVGEVAVPDPRLDKLAEVGKSQQIIPTRLTFVDIAGLVKGASKGEGLGNQFLATIREVDAIAHVVRCFEDGDITHVEGRVAPLADIETIETELMLSDLESLEKRVDNLTKKAKGGDKDSKEQLELVTRALTLLRDGKPARFLERKPEEERAFRMLGLLTSKPVLYVCNVEEGSAAEGNKFSEQVMARAKEEGAVAVVISAKIESEIATLSKEERTDFLDTLGLHEAGLDRLIRAGYELLHLITYFTVGPKEARAWTITKGTKAPQAAAVIHTDFEKGFIRAETIAYDDYIRLGGEAGARDGGKLRLEGKEYVVADGDVMHFRFNT

SEQ ID NO: 73041 - protein, 236 aa, Zea mays
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQGLKEVQECKTEYPNAFIRIIGFENNRQAQGISFIASKTHRLPRGFNLRWNENFQHKKTPGLQFHLPNGLGSFSPFGFSLFPKNFKIRNCKNWVKEETRN

SEQ ID NO: 73042 - protein, 316 aa, Yarrowia lipolytica CLIB122
MSKPIDIPDTSEEVSQIDLVSPTFTPTESQVGTPDAIPVTEEESGAPVLKLSATLPEVECLVRARIPTTNGTEIFLHLYTNNVDKKEHLAIVFGNHIRSKSLDRPREGETEMDRMTRGAYTGRLFPGRQSSKEGVPSTRTPEPASKAPDTTLVRIHSECYTGETAWSARCDCGEQLDEAARLMGNKNSGVIVYLRQEGRGIGLGEKLKAYNLQDLGADTVQANLMLKHPADGRDFGLATAILQDLDQTKIQLLTNNPDKIAAVEGPNKEVTVVERVPMVPLAWKDKSKGIHSDEVDGYLRTKIERMGHLLSEPMAK

SEQ ID NO: 73043 - protein, 308 aa, Myxococcus xanthus DK 1622
MPLSPDPYSALRHAAKYVQQFRRKTFVVKLGGAMLSDPRLRRAACEQIALLWTFSIRPVVVHGGGPELDTLCDALHLPVEKVAGRRVTSAPVLDAAKMVLAGKLHTDLLADLQAAGVPAVGLSGVDAGLIKARKRPPVMVTEAGATEGKLVDYGLVGDIEQVDTRVVEHLRSADYVPVIAPLSGGTDGAVYNTNADTVAAALAVALSAEKLFFLVQVPGLLKNVSDPSSLVTLANLTDLATMESTGAIAGGMKPKAHAIRHALVGGVGSVHLVSGVQPNALLEEVFTNEGSGTMVVRENAQKPAGAVG

SEQ ID NO: 73044 - protein, 140 aa, Francisella tularensis subsp. tularensis SCHU S4
MTKQRTLSIIKPDAVEKNVIGEIYSRFEKAGLRIIAAKMKHLSKAEAERFYAVHKDRPFFSALVEFMISGPVMIQVLEGENAIAKNRELMGATNPKEAKAGTIRADFADSIDANAVHGSDAEDTAAQEIRYFFSDTEIFG

SEQ ID NO: 73045 - protein, 348 aa, Saccharomyces cerevisiae
MSIPETQKGVIFYESHGKLEHKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 73046 - protein, 167 aa, Clostridium perfringens str. 13
MLIEIRGKKPEIGEKTFIAHSSDIIGDVTIGRDCGIWFGSVIRGDDNLIKIGNETNVQDNAVLHVDKEHTIEIGSGVTIGHGAIIHGCKIEDECLIGMGAIILNGAKIGKNTMIAAGTLVSQNKEIPEGVLVMGVPGKVVRKLTEDEIESIKNSRREYVKMKNLYIK

SEQ ID NO: 73047 - protein, 462 aa, Escherichia coli O157:H7 EDL933
MTANSPLQRVGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPATTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTPLAIASSLILVASTFVWAPIPGLICAVIVIATGLPAYAFWAKRSRQLNALS

SEQ ID NO: 73048 - protein, 184 aa, Vitis vinifera
MSSPSKRREMDLMKLMMSDYKVEMINDGMQEFYVHFHGPSDSPYHGGVWRIRVELPDAYPYKSPSIGFVNKIYHPNVDEMSGSVCLDVINQTWSPMFDLVNVFEVFLPQLLLYPNPSDPLNGEAAALMMRDRTAYEQRVKEYCEKYAKPEDVGAAPEEKSSDEEELSEDDYDSSDEAVAGQADP

SEQ ID NO: 73049 - protein, 449 aa, Francisella tularensis subsp. tularensis SCHU S4
MNAQKYIDSVIAQVEKRDGHEKEFIQAVKEVFSTLKPALEHNPKYIEENILARMVEPERGISFRVPWVDKDGNIQVNRGYRYQFNGAIGPFKGGIRFHPSVYSGIIKFLGFEQVFKNSLTTLPMGGGKGGADFDPKGKTDAEIMNFCQSFMIELQRHIGPDIDVPAGDIGVGGKEIGYMYGQYRRIRACFENGVLTGKSLESGGSLIRPEATGYGAVFFLDEMLKHDGETLQGKTVVTSGYGNVAWGVCKKVAQLGGKVVTISGSKGFVHDPEGITTDEKIEFLLKIRNGEKTMQDYSKEFNASWHAGQKPWGIKADIAIPAATQNEIDVEDAQKLIDSGVKYVVEASNMPTTNEAIEFLMKKGIILAPGKAANAGGVAVSGLEMSQNSARLSWSAEEVESKLQQIMANIFHACKFASSKYNLGYNLVAGANLAGFEKVAEAMIQQGRY

SEQ ID NO: 73050 - protein, 310 aa, Rubrivivax gelatinosus
MNTMTRIEQALEAALVANEGAGCPPKLAAAIRHAVFPGGARIRPQLCIAVAMANGDTDPALADAAASAIELIHCASLVHDDLPCFDDAPTRRGQPSVHKAYGERLAVLAGDALIVTAFQTLGAAGGRHPERMAHVLQTVARGVGTPLGIIAGQAWECEPRVALSDYQRAKTGALFAAATAAGAQASGGDGETWRALGDWLGEAYQVADDVRDALADPEQLGKPVGRDVALGRPSAAIQHGLVGAVEHFERLVQGAIDAIPDCKGAGMLRQIVRMEAERLVPKAWCANIEALAERAAVRAAERSAAPTQTA

SEQ ID NO: 73051 - protein, 307 aa, Arabidopsis thaliana
MYARGIQASWSGGKGTSTEAPATRVAEFVFSGQVNVRNHISNIVPPPSRLCLLVAGFIDKTVRCLGYGASSEERTLAMIKPDGVSGNYTEEIKTIVVEAGFNIVKEMLTQLDKETASAFYEEHSSRSFFPHLVTYMTSVLAIILPQSLLCLHLLMCVNCIFETSGPVLVMVLEKRNAVSDWRDLIGPTDAEKAKISHPHRFDLLPNTILDFANSNVRAKMNIVVSCCSLILFTYNMAFSCFCSIRALCGKNSQKNCVHGSDSTSSAEREIKFFFKDVVSVLHNSGLAQVSGEYVKRPIRLVVYGSYS

SEQ ID NO: 73052 - protein, 505 aa, Triticum aestivum
MAARKDNAVLIACQAPNGRVTRAQAANRGRFGVPHPAPVPVRTERKPATKGKAKRGASDENTCASALTSAPPPKRRAALKDVTNISCANSFRNCTAVTKLQSRPTQKVGRNPSKNKQCTKKAPKPPLPAVSGTSFVVNDSHNVEESQKAELLPPKEEPTALLENKGSLSLWNIARNRESGVHEPFFQGRNTRDKSETADSNTGYYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAELTLTDYSFLKFHPSVVAASAVFLARWTLDQSDLPWNSTLEHYTSYKSSDIQGCVRDLWELQQGNTSGSPPLNAIREKYRQEKFECVANMLSPAMPGSLFHRQANGTSPLLINNS

SEQ ID NO: 73053 - protein, 225 aa, Escherichia coli O157:H7 EDL933
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAIFDQPDYKKVIDEMRSELAKVSHE

SEQ ID NO: 73054 - protein, 199 aa, Pyrodictium occultum
MESFVTPQRRSAAEQEPKPTANIENIVATVSLDQTLDLNLIERSILTVEYNPEQFPGLVYRLDSPKVTALIFKSGKMVVTGAKSTRDLIEAVKKIVRNLKKHGIQIYGRPKVQIQNIVASANLNVCVDLERAALTLENSMYEPEQFPGLIHRMDEPRVVLLIFSSGKMVITGAKREEEVYEAVNKIYEKLKKLRAIRPC

SEQ ID NO: 73055 - protein, 319 aa, Arabidopsis thaliana
MISDSITNASATSAPTARDFGKKKRTNRSAKLKQSKLGLRREQWLSQVAMINKGDKEEMESNRRIGSEKPDQRDLPRPVENLDEDNNGTHRHESFIESLSNSPNSILSGMNSIPNFSSSSSSGSGGSCSGNITEEEDADDDGCLDDWEAIADALAADDEKHEKENPPESCQEHEDIKQSALIGGADVVLRDAKADSQRRKQKSNQAWRPDDKLRPQGLPNLEKQRSFPVMNLHFSSVTVVPSSCPICYEDLDLTDSNFLPCPCGFRLCLFCHKTICDGDGRCPGCRKPYERNTIKFEASVQGGGLTIRLARSSSMFCRS

SEQ ID NO: 73056 - protein, 198 aa, Sulfolobus solfataricus
MSNSAVSYKPIVNIENIVATVTLEQSLDLYAMERSIPNIEYDPDQFPGLIFRLEQPKVTALIFKSGKMVVTGAKSTEELIKAVKRIIKTLKKYGIKIVGKPKIQIQNIVASANLHVNVNLDKAAFLLENNMYEPEQFPGLIFRMDDPRVVLLIFSSGKMVITGAKREDEVSKAVKRIFDKLAELDCVKPIEEEEELEL

SEQ ID NO: 73057 - protein, 228 aa, Brucella melitensis 16M
MKPKRRKAGWKMWPAKAEIRYVPLGVIGVIAPWNYPVNLALAPLVAAIAAGNHVFLKPSEHTPRTAAFLKSLLADVFPEDRVAVALGDAALSAQFSALPFDHLFFTGSTAVGRKVMAAAAQNLTPVTLELGGKSPAIISENVNLKRAARAIATGKFFNAGQTCIAPDYVLVHHSKRDEFVALLRAEMEARYSSPSAEKDRTTIINEAQEMRLAGLLADAGEKSEAIID

SEQ ID NO: 73058 - protein, 430 aa, Sulfitobacter sp. EE-36
MNTPTDAEIGAYIGAAGKAAWEVPDLPANTKQREIKSVGIIGAGTMGGGIAMNFATAGIPVTIVETTQEALDRGLKVVRGNYQRSADKGRFPQEEVEARMDRFDGKLELAALADCDLVIEAVFEDMELKRKIFTELDRVMKPGAILATNTSALNIDEIAAMTKRPEDVIGLHFFSPANVMKLLEIVRAKHTADDVVATSMDLAAKINKIAVLVGVCPGFVGNRILFARQKQANKLLQQGLMPWDVDAALNAFGFKMGPFQMSDLAGLDIGWSKGAKTENPIRDALCEMDRRGQKTQAGFYDYDESRRPIPSDVVAGVIKDITGAEANQMSQEEIIEICIYPMINEAVKILEENKAQRPSDIDVVWLNGYGWPADKGGPMFYGDMVGAQAVLDVMEKLGAEDPEFAPAELLRDLAKNGGKFTEIDTGGLKV

SEQ ID NO: 73059 - protein, 465 aa, Myxococcus xanthus DK 1622
MAETFDVVIIGSGPGGYVGAIRAGQLGLKTAIIEKDKRLGGTCLHRGCIPTKSLLWTAELFHHVREAADFGVDVSSPAINWPNAMKHKDKIVTKGANGIDFLMKKNKVTVVKGHGRIAGKGKVEVTAADGSKQVLEAKNIILATGSVPKSLPNVPVDHKRVLNSDSILQIDRVPKSIIVLGAGAVGCEFASVFNHVGSKTSIVEYMPALLPIEDADISKELEKIFKRRGIDVHTGSAVEKVEHTADGVRVTMKVGNETKTLEAEILLSAVGRSPVTEDVGLDKTNIQAERGYIKVDSMLRTSEPNVYAVGDIIPTPMLAHMASAECVVAVEHIAGKNPQPINYDLTPSATYCYPEVASVGLTEKKAKERGYDVKVGIAPMGAVTKASISNEATGMIKIVSDRKYDEVLGVHLIGPHATELLAEACVALKLEITTEELANTIHAHPTLSEIVHEGAEATLGHPRHF

SEQ ID NO: 73060 - protein, 384 aa, Thermosynechococcus elongatus BP-1
MQDKSMLMIPGPTPVPESVLLSLSKHPIGHRSGDFSEIMAAVTAGLKWLHQTTNDVLILTASGTGAMEAGIINFLSAGDRVLVGCNGKFGDRWGEVCDAYGLKTERITAPWGQPLNPDDFKAALEADTAKTIKAVIVTHSETSTGVINDLEAINRHVKAHGQALIIVDAVTSLGAVSVPIDEWGLDVVGSGSQKGYMIPPGLAFVSVSAKAWEAYKTATLPKFYLDLGKYRKDAAKNTTPFTPPVNLFFALKTALEMMQAEGLETIFARHRRLMQATRAAMKALNLPLYAPDECASPAITAVAPQGVEAEKIRNLMKKRFDIALAGGQDHLKGQIFRIGHLGFVSDRDILAAVSALEAVLGELGYNNFTPGAGVAAASRVLTAP

SEQ ID NO: 73061 - protein, 413 aa, Triticum aestivum
MAKHSATLCGLLVVVLCLASSLAQAQILFQGFNWESWKTQGGWYKFMQGKVEDIASTGATHVWLPPPSQSVSPEGYLPGQLYNLNSKYGSGADLKSLIQAFRSKNISCVADIVINHRCADKKDGRGVYCIFEGGTSDNRLDWGPDEICSDDTKYSNGRGHRDTGGGFDAAPDIDHLNPRVQRELSAWLNWLKTDLGFVGWRLDFAKGYSAAMAKIYVDNSKPSFVVGELYDRDRQLLANWVHGVSGPATAFDFPTKGVLQEAVQGNLGRMRGSDGKAPGPIGWMPERTVTFIDNHDTGSTQRLWPFPSDKVMQGYAYILTHPGIPCLFYDHVFDWKLKQEITALARVRSRNGIHPGSTLDILKAEGDLYVAKIGGKVITKIGSRYNIGNNVIPSGFKIAAKGNNYCVWEKSGL

SEQ ID NO: 73062 - protein, 110 aa, Glycine max
MASNRGQGGIQQLLAAEQEAQRIVNAAKNEKLARLKQAKEEAEKEIAEYRAQLEYEFQKKVSQSSGDSGANVKRLEQETEEKIHHLKTEAERISGDVVSMLLKHVTSVKN

SEQ ID NO: 73063 - protein, 337 aa, Thermosynechococcus elongatus BP-1
MVRVAINGFGRIGRNFMRCWLQRKANSKLEIVGINDTSDPRTNAHLLKYDSMLGIFQDAEITADDDCIYAGGHAVKCVSDRNPENLPWSAWGIDLVIEATGVFTSREGASKHLSAGAKKVLITAPGKGNIPTYVVGVNHHTYDPSEDIVSNASCTTNCLAPIVKVLHEAFGIQQGMMTTTHSYTGDQRLLDASHRDLRRARAAAMNIVPTSTGAAKAVGLVIPELQGKLNGIALRVPTPNVSVVDFVAQVEKPTIAEQVNQVIKEASETTMKGIIHYSELELVSSDYRGHNASSILDASLTMVLGGNLVKVVAWYDNEWGYSQRVLDLAEHMAAHWA

SEQ ID NO: 73064 - protein, 213 aa, Triticum aestivum
SKGIILAAIDNPSNAVEWALAEMVNNPELLAKAVEEMDRVVGRERLVQESDIMQLNYLKACIREAFRLHPIAPFNLPHVAIADTIVAGYHIPKGSNVILSRLALGRNPTVWDEPLHFKPERHMGDNINVVLTESELRFISFSTGRRGCIAASLGTTMSVMLFGRLLHGFTWTKPAGVSAINLSESKHDLFIEQPLVLHAEPRLPVHLYPLMHC

SEQ ID NO: 73065 - protein, 94 aa, Trifolium repens
LAVKEAAWGLARYAAISQDNGLVPIVEPEILLDGEHNIDRTFEVAQKVWAEVFFYLAENNVQFEGILLKPSMVTPGAESKEKASPATVADYTLK

SEQ ID NO: 73066 - protein, 603 aa, Populus trichocarpa
MKMVLLLWIFSVISSVTLLSTCSLALSEDGLTLLEIMSTWNDSRNILTNWQATDESPCKWTGISCHPQDQRVTSINLPYMELGGIISPSIGKLSRLQRLALHQNSLHGIIPYEISNCTELRAIYLMANYLQGGIPADIGNLSHLNILDLSSNLLKGAIPSSIGRLTRLRHLNLSTNSFSGEIPDFGSLSTFGNNSFIGNSDLCGRQVHKPCRTSLGFPAVLPHAASDEAAVPPKRSSHYIKGLLIGVMSTMAITLLVLLIFLWICLVSKKERAAKKYTEVKKQVDQEASAKLITFHGDLPYPSCEIIEKLESLDEEDVVGSGGFGTVFRMVMNDCGTFAVKRIDRSREGSDQVFERELEILGSINHINLVNLRGYCRLPMSKLLIYDYLAMGSLDDFLHEHGQEERLLNWSARLRIALGSARGLAYLHHDCCPKIVHRDIKSSNILLDENLEPHVSDFGLAKLLVDEDAHVTTVVAGTFGYLAPEYLQSGIATEKSDVYSFGVLLLELVTGKRPTDPAFVKRGLNVVGWMNTLLRENRLEDVVDTRCKDTDMETLEVILEIATRCTDANPDDRPTMNQALQLLEQEVMSPCPSDFYESHSDYC

SEQ ID NO: 73067 - protein, 499 aa, Arabidopsis thaliana
MTMISDLSKDLVEEILSKAPITSLGAVRSTHKQWNALSKGRLLYKAEAKDQFLGFMVMDHRFLSMIFHLNGILKGDGEGFDRPSIREVGDIVNQIDISKVFQCDGLVLCVPSDNSSVVVWNPYLGQTKWIEAREPHDESDMFALGYDKDKNHKILRLYDECYYYYEVYNFKTESWGEEDHLPGWDIDSYNRGVSLNGNTYFLTQEQRAKDKYRVFLLCFNFTTEKFENFIAMPFKYHRKYVGTLSCVGNEKLAALYQRWDTGEMAIWVTTKIESNEVLWSNLFKVDMKPLVRFGFQQCKDEAGSFFIDEEKKLAVVFNLDKKRGKRNNKTRCYHTAYIIGEKGYLKKEVLGEAVEVRKDVYRSALVCSSSYVPSLEKINQIEEEEEDKCKSIKMVDTKRQLETSFGLDFELHEDSCFFIDEEKKLAVVFDLAESKRCKTANAYIIGVQIDDPIARRDKRERNRKWMSKRKEKKRKGTNKQQGLTPMKKKQEVHLLLINR

SEQ ID NO: 73068 - protein, 474 aa, Salmonella enterica subsp. enterica serovar Paratyphi A str.
MQYQLLINGVLVDGEGERQSVYNPATGEVILEIAEASPAQIDAAVQAAVNTFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWGNDSRYGLASSVWTQDVGRAHRLSARLQYGCTWINTHFMLVSEMPHGGQKQSGYGKDMSLYGLEDYTLVRHIMVKH

SEQ ID NO: 73069 - protein, 548 aa, Pseudomonas syringae pv. tomato str. DC3000
MSELIRVPDIGNGEGEVIELMVKVGDRIEADQSVLTLESDKASMEIPAPKAGVIKAMKVKLGDRLKEGDELFELEVEGEASAAPAPAAEPAAAAAPAAAEKPAEAAPAAAEPAPAAAATVQDIHVPDIGSSGKAKIIELMVKVGDSITADQSLITLESDKASMEIPSPAAGVIESIEVKLDQEVGTGDLILKLKVAGAAPAAAPAPAASAPAAAPAKAEAAAPAAAPAPKAEAAPAPAAPAKDGAKVHAGPAVRQLAREFGVELSAVSATGPHGRVLKEDVQVYVKAMMQKAKEAPAGGASGGSGIPPIPEVDFSRFGEIEEVPMTRLMQLGASGLHRSWLNIPHVTQFDQADITDLEAFRVAQKGAAEKAGVKLTVLPLLLKACAHLLKELPDFNASLAPSGKAVIRKKYVHIGFAVDTPDGLLVPVIRDVDQKSLLQLAAEAAVLAEKARSKKLTANDMQGACFTISSLGHIGGTGFTPIVNAPEVAILGVSKATIQPVWDGKAFQPKLMLPLSLSYDHRVINGAAAARFTKRLSELLTDIRTILL

SEQ ID NO: 73070 - protein, 317 aa, Rhodopseudomonas palustris CGA009
MSGKNGSVKLVAGNSNPALARDIAQWLNMPLTKASVRRFADNEVFVEIQENVRGSDVFIIQSTSFPANDHLMELLIITDALRRASARRITAVIPYFGYARQDRKVGSRSPISAKLVANLITHAGVDRVMTLDLHAGQIQGFFDIPTDNLYASPVMVRDIKERFDLSKVMVVSPDVGGVVRARGLAKRLNTPLAIIDKRRERAGESEVMNVIGEVAGYTCILLDDIVDSGGTLVNAAEALLANGATEVYAYITHGVLSGGACARITNSKLKELVITDSIQATEGVCKAPNIRTITIASLIAEAIGRTAAEESVSSLFD

SEQ ID NO: 73071 - protein, 459 aa, Pseudomonas syringae pv. tomato str. DC3000
MTNTAFNSLPLSAAMLANLESLGYAEMTPIQAQSLPVILKGMDLIAQAKTGSGKTAAFGIGLLNPINPRFFGCQALVMCPTRELADQVAKEIRRLARSEDNIKVLTLCGGVSFGPQIGSLEHGAHIIVGTPGRIQQHLRKGSLVLDGLNTLILDEADRMLDMGFYDSIADIIEQTPQRRQTLLFSATYPVGIKQLSSKFMRDPQTVKVEALHADSQIEQIFYEISPEQRLEAVVKVLGHFRPTSCVAFCFTKQQVQEVVDHLTAKGMSAVGLHGDLEQRDRDQVLAMFANRSTSVLVATDVAARGLDIDALDMVLNVELARDSEIHIHRVGRTGRAGETGIAVSLVAPSESQRARAIEELQKAPLNWQQYDSLSIKEGGKLLPAMTTLCIGSGRKDKLRPGDILGALTGEAGIAGTQVGKIAIFDFQAYVAVERSMAKQALERLNNGKIKGKSLRVRIL

SEQ ID NO: 73072 - protein, 136 aa, Zea mays
MELLRAFRLSRSGAQTWSGAGLHRYLAFQVQIQGGGIITDPCEHEWMQTVETTSRRLADRKTAKFQKNITRRGSVPETTVKKGNDYPVGPLVLGFFIFVVIGSSSGHQKLLRTVKRSVFEPAFIKFIGGKNHSKST

SEQ ID NO: 73073 - protein, 746 aa, Myxococcus xanthus DK 1622
MATKAEELEVKQGFSYQVEGGVAVITFDLPDSPVNTLSPETGEAFLRVMMRAEREPEVKAVVFTSGKKDSFVAGAKIDFLQTIKTAEEATAISRNGQEGFDKLADFPKPVVAAIHGACLGGGLEWALACDYRIATDSPKTSLGLPEVQLGLIPGAGGTQRLPALIGVQAALDLILTGKSLKPAKAKKLGVVDEVVPTPILRAIAVLRAKELADGKLKVDRRHGQGFKGVAANGKAKGLAGFIQGLANKELWAEVALEDNPLGRKVLFDQARKQLLKKTRGKFPAPEKALQVVRVGLESGHKAGQEAEAKAFGELVVSDVSKRLVEIFFATTALKKENGTSNPDAKPREVKKVAVLGGGLMGGGIAYVTSVLQGVPVRVKDKDDAGVGRAMKQVQSILDERVKRRSLTRREATAKSALVTAGTDYSGFKSADLVIEAVFEDLKLKHRIIAEVEAVTGDQTIFASNTSSIPITELAKGSRRPAQVIGMHYFSPVHKMPLLEIITHAGTADWVTATCVEVGRKQGKTVIVVNDGPGFYTSRILAPYMNEAAYLLAEGADIAELDRALVEFGFPVGPITLLDEVGIDVAQKVGPIMEAAFGKRMAAPKALEKVVADGRLGRKTQKGFYLYEDGKKQEVDSSIYALLPHGTERRSFDRAEMAERVVLQMVNEAIRCLGEGILRSARDGDVGAIFGLGFPPFLGGPFHYVDSRGPAEVLRKLEHYHDKLGERFAPAPHLVEMVKAGKTFYPR

SEQ ID NO: 73074 - protein, 340 aa, Yarrowia lipolytica CLIB122
MPSLVDPVANKTDEGNNRTDLKAPEPEHCPGTESEEAGKADACQGCPNQDICASAPKGPDPDLPLIKDRMKGVKHKILVLSGKGGVGKSTFSSLLGWGFASDLDREVGLMDIDICGPSLPKMMGSEGEQIHTSLSGWSPIYVSDNLGMMSVGFMLPNQDDAIIWRGAKKNGLIKQFLKDVDWGNLDYLVVDTPPGTSDEHLSVTQYLKESGVDGAVVITTPQEVALLDVRKELDFCRKSGIKIIGLVENMSGFVCPNCKGESFIFAPTTGGGKALAEEFNIPFLGSVPLDPRIGKSCDHGESFVEEYPDSPATTAILDVIRQIREAVGDPQEDEDDDMDE

SEQ ID NO: 73075 - protein, 280 aa, Rhodopseudomonas palustris CGA009
MFAMTSSAQSPLQQLGGTVVLAGAGKMGGALLTGWLAQGLDGGDVVVIEPHPTEEIAALSARGVRLNASAGDVGAVSTLVVAVKPQMFAEAAAALRGYVGPSTLVVSIMAGKPIAALSEQLGGHVVRAMPNTPAAIGRGITVAVAAGNVTAAQRGIADALLRATGGVEWVDDEALIDAVTAVSGSGPAYVFLLAEELARAGVEAGLPEGLAMTLARATVAGSGELLHRSDLDAATLRKNVTSPGGTTAAALEVLMANDGFRPLLTRAVAAATKRSKELAK

SEQ ID NO: 73076 - protein, 295 aa, Bacillus cereus G9241
MKRVRKAIIPAAGLGTRFLPATKAMPKEMLPIVDKPTIQYIVEEAVKSGIEDIIIVTGKTKRSIEDHFDNAFELEQNLLEKKKYELLEKVQASSKMVDIHYIRQKEPKGLGHAVWCARKFIGDEPFAVLLGDDIVQAEKPCLRQLIEEYDKTLSSVIGVQTVPEDETHRYGIIDPLEQEGRRYQVRNFVEKPAAGTAPSNLAIMGRYVLTPEIFMFLEQQHVGAGGEIQLTDAIQSLNEIQRVFAYDFEGKRYDVGEKLGFVQTTIEMALQHPELRDDMVVMMKKILEEHTNQES

SEQ ID NO: 73077 - protein, 288 aa, Vibrio vulnificus CMCP6
MWQAISQQLSETLMFSYDIVEKVHLSGGDINECYMISDGEQRYFVKINSKDFLSKFQVEAENLRLLRQTDSVTLPELVLIGNTKSNAFIILNFLPTKPLEDTENSYKFGQQLAYLHLWGEQKEYGCDQDNYLGATLQPNAWHKKWSTFFSEQRIGWQLQLLKEKGVTFGVIDEIVEVVARQLLNHNPRPSLIHGDLWHGNVALSAFGPICYDPACYWGDRECDIAMTELFGGFNAEFYRGYEDIAPLPFGYTQRKEIYNLYHILNHCNQFGGHYLEQAQKSIDKILSY

SEQ ID NO: 73078 - protein, 162 aa, Populus trichocarpa
MAPIAVGDVLPDGKLAYFDEQDQLQDVSVHSLAAGKKVILFGVPGAFTPTCSLKHVPGFVEKAEELKSKGVAEILCISVNDPFVMKAWAKTYPENKHVKFLADGSATYTHALGLELDLQEKGLGTRSRRFALLVDDLKVKAANIEGGGEFTVSSADDILKDL

SEQ ID NO: 73079 - protein, 520 aa, Rhizobium leguminosarum bv. viciae 3841
MTQTAHPDSVLIVDFGSQVTQLIARRVREAGVYCEIVPFQSAEEGFHRLQPKAVILSGSPASTVDEGSPRAPDIIFDSGLPVFGICYGQQTMCMQLGGKVESGHHREFGRAFLEVDRDCQLFEGLWSSGSRHQVWMSHGDRVTALPDGFEVVATSSNAPYAFIADEKRKYYGVQFHPEVVHTPDGAKLIGNFIHNIAGIKGDWSMSAYRQKAVEQIRAQVGDKRVICALSGGVDSSVAALLIHEAVGDQLTCILVDHGLMRKDEAAGVVAMFREHYNLHLLHVDAADRFIGELEGVSDPETKRKIIGRLFIETFEEEARKLGGADFLGQGTLYPDVIESVSFTGGPSVTIKSHHNVGGLPERMKMQLVEPLRELFKDEVRALGRELGLPDSFIGRHPFPGPGLAIRCPGGITREKLEILREADAIYLDEIRKAGLYDAIWQAFAVLLPVQTVGVMGDGRTYEFVCALRAVTSVDGMTADFYHYDMEFLGRAATRIINEVRGINRVVYDVTSKPPGTIEWE

SEQ ID NO: 73080 - protein, 459 aa, Mesorhizobium loti MAFF303099
MTYQNYSLKQLQQIDAAHHLHPFTDHKELREAGSRIITHANGPFIYDSEGTELLDGMAGLWCVNIGYGRDELAEAAYAQMKELPYYNSFFKCSTPTPVLLSKKLAEIAPKNVNQVFYGSSGSEANDTALRLVRHYWVIEGKPEKNRVISRKMAYHGSTIAGTSLGGMDAMHKQLNGAVPNIVHVMMPYAYELALPGESDHDFGLRAAKSVEDAILEAGVDKVAAFIGEPVMGAGGVKIPPASYWPEVQRICRKYDVLLMLDEVITGYGRTGEWFAAQTFGIEPDTITTAKALTSGYQPLSALLVGDRITSTLVEKGGEFNHGYTYSGHPVACAVALKNLEIIEQEGLVDRVRNDTGPYFAKALQECIAGHDLVGEVRSIGLMGAIEIVKDKATKERFLPSGSAAVTVRDHAIANGMMLRATGDTMILSPPLIWTRDTIDMACERIGKALDLAQADLRKR

SEQ ID NO: 73081 - protein, 145 aa, Triticum aestivum
  misc_feature (9)..(9): Xaa can be any naturally occurring amino acid
GTRLLRSPXKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLVRAKANSLAQLGSYTGEGESDEAKKGMFQKGYTY

SEQ ID NO: 73082 - protein, 181 aa, Methanothermococcus thermolithotrophicus
MEPEIKIVNVVVSTQIGTDIDLEYAADILDNAEYEPEQFPGLVCRLSDPKVALLIFRSGKLNCTGAKSKEDAEIAIKKIIKELKDAGMDIIDNPEVNVQNMVATADLGIEPNLDDISTLEGTEYEPEQFPGLVYRLSDPKVVVLIFGSGKVVITGLKKKDDAYLALDKILSTLKELEEEYY

SEQ ID NO: 73083 - protein, 388 aa, Moritella sp. PE36
MADLNDIRTRITTLDNNLLRLLSERRELAIEVAKSKQSTSKPVRDQDREQQLLVRLINQGRELGLDSNYIMNIYHTVLEDSVLLQQAFLQEIKNPNAAVPVARVAFLGDKGSYSNLACKKYFARQDDRLVELGFPTFQQIITAVEKGQADYGMLPIENTSSGSINDVYDLLQHTTLSIVGELTQPIEHSLITTCDTDLSKIKTIYAHPQPFAQCSLFLSAHPHIKIEFVDSSSAAMVKVKELNSEEAAAIGSITGGELYGLKPIRTGLANQTENYSRFIVVARKPVDVAVQIPAKTTFTMSTGQQAGCLVEALLVLREEGVTMTKLESRPIQGNPWEEMFYIDVAANLQSEKMKNVIKQLTRITHQIKILGCYPSEDVAATDVPEDLL

SEQ ID NO: 73084 - protein, 197 aa, Sulfolobus acidocaldarius
MIPDEIPYKAVVNIENIVATVTLDQTLDLYAMERSVPNVEYDPDQFPGLIFRLESPKITSLIFKSGKMVVTGAKSTDELIKAVKRIIKTLKKYGMQLTGKPKIQIQNIVASANLHVIVNLDKAAFLLENNMYEPEQFPGLIYRMDEPRVVLLIFSSGKMVITGAKREDEVHKAVKKIFDKLVELDCVKPVEEEELEF

SEQ ID NO: 73085 - protein, 224 aa, Triticum aestivum
MAPSQQVAATKEPSANGTAAPAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKDLPPHRLAEIRRFFEDYKKNENKEVAVNDFLPSEDAYEAIQHSMDLYATYIVEGLRR

SEQ ID NO: 73086 - protein, 567 aa, Cryphonectria parasitica
MALRAFLSLLPALSLVTAAPSVEPYQLSKRCVNSADDRSCWGDYDLSTNYYDEAPFTNVTREYWFNIVNTTASPDGVEKIVLAVNGSIPGPTIVADWGDTVVVHVTNSMQNNGSSIHFHGIRQNFTNQNDGVASITQCPTAPGDTTTYTWRALQYGTSWWHSHFYVQAWDGVYGGIQINGPATANYDEDLGVVSMMDWDHDTADNLVLQSAVTGPPTMANGLINGMNVYTLEDNSTVGSRYEMEFTSGQRYRLRLVNTAADTHFKFTIDNHTMEVIASDFVPIQPYTTDVVNIGIGQRYDVIVTADAPSDNYWMRAIAQLACSDNDNPDNIKAIIRYSDAANSTADPTSTATADASVDECVDEPAASLVPYLAIPAGGSADVTDNFAVAVEQLAGRVDWAMGNTTFINEWGYPSIQQVYDGNNTWGESQNVIQLPQANEWVYWIVQTTMGVTHPMHMHGHDFWVLGAGTGTFDSATASLSTVNVPRRDVTMLPASGWTVIAFITDNPGVWLTHCHIAWHTSEGLAVQMVERESEIVDLIDADLMNSTCGAWNDYANKVALVQDDSGI

SEQ ID NO: 73087 - protein, 217 aa, Brucella melitensis 16M
MTDSSHQRSTAMSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALEGLTPEQILKQELNTGVPIIYRLNADSTVASKEILSA

SEQ ID NO: 73088 - protein, 251 aa, Escherichia coli
  misc_feature (123)..(124): Xaa can be any naturally occurring amino acid
  misc_feature (191)..(191): Xaa can be any naturally occurring amino acid
MVDKSQETTHFGFQTVAKEQKADMVAHVFHSVASKYDVMNDLMSFGIHRLWKRFTIDCSGVRRGQTVLDLAGGTGDLTAKFSRLVGETGKVVLADINESMLKMGREKLRNIGVIGNVEYVQAXXEALPFPDNTFDCITISFGLRNVTDKDKALRSMYRVLKPGGRLLVLEFSKPIIEPLSKAYDAYSFHVXPRIGSLVANDADSYRYLAESIRMHPDQDTLKAMMQDAGFESVDYYNLTAGVVALHRGYKF

SEQ ID NO: 73089 - protein, 455 aa, Pseudomonas putida KT2440
MTNALNHLPRPRAGADQLAERFSDLAPPLTARQAALESARCLYCYDAPCVNACPSEIDIPSFIHRISDENLQGAAERILSANILGGSCARVCPTEILCQQACVRNNAQECAPVLIGQLQRYALDNAQFSAHPFKRSAATGKRIAVVGAGPAGLSCAHRLAMHGHDVVVFEACDKAGGLNEYGIARYKLVDDYAQREVDFLLGIGGIEVRHGQRLGGNLSLGELRDQYDAVFLGLGLNAVRQLGLPDEEAPGVVAATEYIRELRQADDLSQLPLADRCLVIGAGNTAIDMAVQMSRLGARDVNLVYRRGHADMGATGHEQDIAKANQVRLHTWARPDAVLLDDAGKVRGMRFARTELAEGRLRDTGETFELAADAIFKAIGQRFDDASLGDPVAAQLAREGERIRVDENLQTSLPGVYAGGDCTALGQDLTVQAVQHGKLAAEAIHAQLMLNVEAA

SEQ ID NO: 73090 - protein, 303 aa, Brucella melitensis 16M
MLQCRPNGQWRRTDMNIFLFGAGYSTQAFARRMAGEAGRIDGTTRHEQKFPLLEAAGIAPILFDGETPSPELLEKLVRSSHIVISISPNESGDPAVAVVEEALCRRDNTIRWIGYLSTVGVYGDHQGEWVNETTACKPVSRRSLERVKAEEAWTQLSKRHGTPLAILRLSGIYGPGRNAFINLERGTARRIVKAGQVFNRIHVEDIAGSLRLLAGTNADGIFNITDNEPAPPQDVVAYAAELMGVTPPPALPYEEADMTPMARSFYGENKRVSNERIKTLGYEFTYPDYKTAFSAMWAADNWR

SEQ ID NO: 73091 - protein, 376 aa, Paracoccus denitrificans
MLGNLKPQAPDKILALMGEFRADPRQGKIDLGVGVYKDATAHTPIMRAVHAAEQRMLETETTKTYAGLSGEPEFQKAMGELILGDGLKSETTATLATVGGTGALRQRGTGAHGNPDLRVFVSDPTWPNHVSIMNFMGLPVQTYRYFDAETRGVDFEGMKADLAAAKKGDMVLLHGCCHNPTGANLTLDQWAEIRSILEKTGALPLIDLAYQGFGDGLEEDAAGTRLIASRIPEVLIAASCSKNFGIYRERTGCLLALCADAATRELAQGAMAFLNRQTYSFPPFHGAKIVSSVKTKLRTRAELRWRAGSGCAAACCACASNGGELRDLSGSDRFGFVAEHRGIMFSRLGATPEQVKRIKEEFGIYMVGDSRINIAG

SEQ ID NO: 73092 - protein, 219 aa, Rhodococcus sp. RHA1
MTDAPRAPRRLILLRHGQTEYNADNRMQGQLDTELSELGRSQARAAASALVGRRPISIVSSDLRRAYDTAVEVGDNAGLPVQIDERLRETHLGDWQGLTHLDVDARAPGARATWRGDATWAPPGGESRIDVARRSKPVVAELVEKHEDWAEKPVVLVAHGGLIAALTAALLDLPVDRWPVLGGLGNTSWVQLSAYGNPDSLNWRLDVWNASASVASDVL

SEQ ID NO: 73093 - protein, 458 aa, Nostoc punctiforme PCC 73102
MTFDYDLFVIGAGSGGLAASKRAASYGAKVAIAEYDLVGGTCVIRGCVPKKLMVYASHFPALFSEASGYGWKVGNAELDWEYFITSIDKEVRRLSQLHINFLEKAGVELFSGRATLLDSHTVEVDGRKVTADKILIAVGGRPIKPDLPGMEYGITSNEIFHLKEQPKHIVILGAGYIGTEFACIMRGLGSEVTQITRGDKILNGFDEDVRTEIEEGMTNHGIRLIKNNVVKTVERVAEGFKLTLSGEDQEPIIADVFLVATGRTPNVDGLGLENAGVDVVASSIEGPGYPTTSAIAVNEYSQTNQPNIFAVGDVTDRINLTPVAIGEGRAFADSEFGNNRREFSHKTVPTAIFSNPEAATVGLTEAEAREKLGDAVTIYRTRFRPMYYTLTGKQEKTMMKLVVDSNTEKVLGAHMVGDSSAEIIQGVAIAVKMGATKKDFDATVGIHPSSAEEFVTMR

SEQ ID NO: 73094 - protein, 229 aa, Glycine max
  misc_feature (186)..(186): Xaa can be any naturally occurring amino acid
AEDVIEDIKAWGFSPNIVTYNTLIDGHCKKGSAGKMYRADAILKEMLANKICPNEITFNTLIDGFCKDENVLAAKNAFEEMQRQGLKPNIVTYNSLINGLSNNGKLHEAIALWDKMVGLGLKPNIVTFNALINGFCKKKMIKEARKLFDDIAEQDLVPNAITFNTMIDAFCKAGMMEEGFALPNSXLDEGIFPNVSTYNCLIAGVCRIHNVRTGKNLLIEWDTLNWKPV

SEQ ID NO: 73095 - protein, 487 aa, Salmonella enterica subsp. enterica serovar Paratyphi A str.
MCDCGEKKSQGVKWLPLILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMTRGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGVWWRTGFIISLFNQAVFLTVGLAWWKVLGLY

SEQ ID NO: 73096 - protein, 463 aa, Lentinus tigrinus
AVGPVADLTVTNANISPDGFERAAIVVNNVFPAPLITGNMGDNFQLNLVNQMTNHTMLKTTSIHWHGFFQKGTNWADGPAFINQCPIASGNSFLYDFQVPGQAGTFWYHSHLSTQYCDGLRGPFVVYDPNDPHANLYDVDDESTVITLADWYHVAAKLGPRFPLGADSTLINGLGRSTSTPTADLAVISVTKGKRYRFRLVSLSCDPNYTFSIDSHQLTVIEADGVSTQPVTVDSIQIFAAQRYSFVLNANQDVDNYWIRANPNFGTTGFADGVNSAILRYDDADPVEPVTNQTGTTLLLETDLHPLTSMPVPGNPTQGGADLNLNMAFNFDGTNFFINGESFTPPTVPVLLQIISGANTAQDLLPSGSVYSLPSNSSIEITFPATTAAPGAPHPFHLHGHVFAVVRSAGSTSYNYDDPVWRDVVSTGTPQAGDNVTIRFQTDNPGPWFLHCHIDFHLEAGFA

SEQ ID NO: 73097 - protein, 256 aa, Francisella tularensis subsp. tularensis SCHU S4
MSQIIIKTPQEIEKMRVAGRLAAEVLEMITPFVKEGVTTAELDKICHEYIVKEQDAYPAPLNYHGFPKSICASINHVVCHGIPADKKLKNGDILNIDITVKKDGYHGDTSKMFMIGEPSVMAKKLVEVTHECLWKGIEVVKPGNHFGDIGAAIEKHAKKFGYSIVDAFCGHGIGANFHEPPHVMHHGKAGTGAMFEEGMIFTIEPMINIGKRAVSVLKDGWTAVTKDRSLSAQWEHTILVTKDGYEVLTLREEEKN

SEQ ID NO: 73098 - protein, 347 aa, Oryza sativa Japonica Group
MPFWNKGPSRSSLGKKAKRLSAAPLPDTGQWLLLALNEKLPQSVVDLLRAHVITLHHYLMLFIMLGFSVLFGCIKAPGLGIATRYMFTMAIGRLLRTMTFVATILPSARPWCAAARYQIPGHPHPWAQKYYVPYASDSDAIRRVIRDDVAYAAVQSYPGEYRPDWGRMSFLVDILRPTPGEGPSWYHLLKKASGGCNDLMYSGHMLVAVLTAMAWTEAYGGWISVAIWLLVLHSAQREIRERHHYTVDCVVAIYVGILLWRMTRFIWSARDASRARRLAKLDEVHNRLIHAAKDSDVDEIRGLLKEVELAGQEKQGVSQRAILAFAAATIIFTLTCVVLALTLTSDG

SEQ ID NO: 73099 - protein, 289 aa, Rhizobium leguminosarum bv. viciae 3841
MHVMIFGCGYSGTAIAKAFAGDGVRVSGTTRSPDKMDMLRQKGIEAFLFDGESMEEGLRQALDSVTHLVQSIAPGKADPLLRLLGKDGARLLPKLEWIGYLSTVGVYGDHQGAWVTEETPCLPVSGRSTERLEAEEGWLAMGRERGVPAAVLRLSGIYGPGRNAFSNLDKGTARRLIKKDQVFNRIRVEDIGAAARFLSERGLGGIYNVTDDRPGPPQDVIVEAARLMGVEPPPEQAFETAELTPMARTFYGENKRVSNAKLKAAGFAFSFPNYPMSLAQLWRDGRWRG

SEQ ID NO: 73100 - protein, 114 aa, Oryza sativa Japonica Group
MARAARGKAPRPRPRPPRGLAASLRRLLAGAGGGLGVAAAAYVGVDYLRYLSPAWHGRLMPALWAALALAAAARTPFYRNWSAELRAALPFLGSIAFMLGAFSARPSPSASSPP

SEQ ID NO: 73101 - protein, 212 aa, Methanopyrus kandleri AV19
MSGKRNAARKAAEEVCRRGYEVIGVGAGTTVEAFLEELVKREADVLVFTTIPGTIDACRRIGLNVTTIPPEELPVAIDGADAVDPDGNLLKGGGACHSLEKAIDYTADEFWVVVDESKLVENLWELPVPVEVLRGCYELTVRTLEEFGEVRPRTCDEKYGPVVSDSGNPIVDLHVDDWDPAELERELNSVPGVVECGVFPGDKVDRIIVGRS

SEQ ID NO: 73102 - protein, 397 aa, Clostridium perfringens str. 13
MILSRKAQNIGASLTLALTAKAGELKKEGIDVVSFGVGEPDFNTPKNIIEAATRAMEEGKTKYTATSGIVELKEAIARKLHDDNGLNYGTKNIIISTGAKQSLANVFMAILNPGDEVIIPVPYWVSYPELVKLSDGVPVFIETKKENDFKVTYDELKSVLSENTKAIVINSPNNPTGTVYSKKDLEVIAKFAEENDLIIISDEIYEKLIYGKEEHISIASLSEDAFKRTVVINGFSKAYAMTGWRIGYAACYNEELIKVMNNVQSHMTSNTNSIAQFAALEALNGDQETIKNMVKEFSLRRELMIELISEIEDLTFIEPKGAFYVMIDVSKVLKKANIKGSMEFANLLLKEENVVVIPGIAFGEDNFIRLSYATSKEEIIKGLKRIKEFVNKLMNRD

SEQ ID NO: 73103 - protein, 291 aa, Methanopyrus kandleri AV19
MIVLATSEGVKLGRRLAEELDAELAPVEEDRFPDGEQIVRVPPELDGTVVVVHSMSPPQDENLVKAIITLDAARENGAEEVIAIVPYMAYSRQDRRFEPGEPVSFRAVARAVSANADALITVDLHEPGTLKYFDVPAENVSAAEELGKYLAERFEGEDLVVIGPDEGARELAREVASICGVEYDHLEKKRLSGDEVEIHPKELDVEGRTVVLVDDMIDTGGTMVEAARALRDQGAGTLYAACTHALLTRNAATRLLASGFEDIIATDTVPNPFEKVSVAPPVAEAVENLSG

SEQ ID NO: 73104 - protein, 196 aa, Clostridium perfringens str. 13
MNLANKLTLIRIILVPIFLVFIAYQDLPYGSVIATLIFIIASVTDQLDGYIARSRNQVTNFGKFMDPLADKLLVTAALISLVELQLVPAWAAIVIIAREFAVSGLRTIAASEGLVIAASWWGKIKTVIQIIAIVLLLLQVNIINSPGIKELVAGSSFLRNFFIYVPDIFLYLAVAITIISGVDYFRKNKNVINTYK

SEQ ID NO: 73105 - protein, 501 aa, Pseudomonas putida KT2440
MTKQTLAAAPPCTLFLFGANGDLVKRLLMPALYNLSRDGLLDRNLRIVGVDHNPASAEDFAARLHAFMVERDKGGEGSAKCLDEKLWARLAKRLDYQTGDFLDPATYQALARRIDKTRHGNAIFYLATSPRFFPEVAQRLGQAGLLDESAGGFRRVVVEKPFGTDLASAEALNACLLKVMGERQIYRIDHYLGKETVQNILVSRFSNGLFESFWNNHYIDHVQITAAETVGVETRGAFYDSTGALRDMVPNHLFQLLAMVAMEPPAAFGADAVRGEKAKVVGAIRPWSAKMAQKNSVRGQYRAGKQGRKPLPGYRQEPNVAPDSQTETYVALKVMIDNWRWAGVPFYLRTGKRMSVRDTEIAICFKPAPYAQFRESELERPKPNYLKIQIQPNEGMWFDLQAKRPGPELVMENVELGFAYKDFFKMTPATGYETLIYDCLTGDQTLFQRADNIENGWRAVQPFLDAWAQGGEVHEYSAGEDGPEAGNELLTRDKREWHRLG

SEQ ID NO: 73106 - protein, 454 aa, Oryza sativa
MVLRRFAWPYGGQRASFCGSFTGWRECPMGLVGAEFQVVFDLPPGVYQYRFLVDGVWRCDETKPCVRDEYGLISNEVLVDNTHPVVQPETSIRVVSMDEGTILTTMPPDQLSQNSGVGTRQIAIFRHRVSEILLHNTIYDVVPVSSKIAVLDARLPVKQAFKIMHDEGLSLVPLWDDQQQTVTGMLTASDFVLILRKLQRNIRTLGHEELEMHSVSAWKEAKLQFYGGPDVAAIQRRPLIHVKDSDNLRDVALAIIRNEISSVPIFKPSTDSSGMPLLGLATLPGIVKFICSKLQEQPEGYSFLQNQIVSMPIGTWSPHTGKASNRQLRTSRPSTPLNSCLDLLLEDRVSSIPIVDDNGALLDVYSLSDIMALGKNDVYTRIELEQVTVEHALELQYQVNGRRHCHTCLSTSTFLEVLEQLSAPGVRRVVVIEPRSRFVQGIISLRDAFTFLIG

SEQ ID NO: 73107 - protein, 246 aa, Glycine max
AMWTTLRSEDVWGPCLYMYLSLALSLDIREGMFYWYTDSKGGPSFSQESVGFIFSISSVGALLGAILYQYALKDYAFRNLLFWTQLIYGLSGMLDLILVSRLNLKFGIPDYFFVVIVESIAKMTNRLKWMPMLVLSSKLCPSGIEGTFFALLMSIDNVGLLSASWGGGFVLHMLRITRTKFDNIWLAILIRNILRIAPLWLLFLVPRADRSSSILPCKSMNSEVAIDPSDTKNVELVSLVHSVDGK

SEQ ID NO: 73108 - protein, 249 aa, Zea mays
EKKKTVSFLRLPPLPSSTPLPSPHHPQPRRRRLRFGSARLEQKKMQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 73109 - protein, 303 aa, Klebsiella pneumoniae subsp. pneumoniae MGH 78578
MNTLEQTIGNTPLVKLQRLGPDNGSEVWVKLEGNNPAGSVKDRAALSMIVEAEKRGEIQPGDVLIEATSGNTGIALAMIAALKGYRMKLLMPDNMSQERRAAMRAYGAELILVSKEQGMEGARDLALEMAQRGEGKLLDQFNNPDNPYAHYTTTGPEIWQQTAGRITHFVSSMGTTGTITGVSRFLREQSKPVTIVGLQPEEGSSIPGIRRWPAEYMPGIFNASLVDTVLDIHQQDAENTMRQLAVREGIFCGVSSGGAVAGALRIARENPGAVVVAIVCDRGDRYLSTGVFGEEHFSQGAGI

SEQ ID NO: 73110 - protein, 297 aa, Moritella sp. PE36
MELLDLIGNTPLINLSFLSPQPERVSLFAKAEWMNPGGSLKDRSVKLILTRAIEDGLLQPGKIILDSSSGNAGISYSMIGAALGYAVNIVIPDNASNERKMRLRAHGAQLIETDALEGYDQAIRHVHELYANSPDKYFFADQYSNQANVLAHYHGTGAELIEQVSGPITHFVCGVGTGGSLTGIARRLKAKYPAVVIVGIRPERWPGIEGLKPLGEKEDILPKIFDGSLVDRWLDVSANEAKSMCLTMARRGYFVGQSSGAYLAGCCKLMAELSEGVVTTLMCDSGERYFSTGLWQS

SEQ ID NO: 73111 - protein, 495 aa, Burkholderia vietnamiensis G4
MSMNPMAETPPSEYSCLPRSRGLFYAGDWHEPLSATYRETLNPANGLPVASVAHASADDAEAAIERAHEAWLDWRGTAPAKRQRMLHEAASLLREHAEEFAMIDAINTGNPVAEMVGDAMVAADSLDFFAGLVPMLKGETIPVDGNSLHYSLREPLGVVARIVAYNHPLMFAAGKVAAPLAAGNTVIVKPPEQAPLSCLRLAEVLRDVFPPGVLNILPGGRECGQTLASHPLVKKVTLIGSVNTGRAILRGAADTIKPTLLELGGKNALIAFPDADIKALIHGIARGMNFTWAGQSCGSTSRVFLHDSIHDQVLESVATYVRETYVPGVPTDAATTMGPLISAQRRDEVMDFIASATREGARLVTGGKAPDTPELRGGYYIEPTIFSDVTASMRIAREEIFGPVMSVFRWKDEEELFKVVNGTEFGLTASIWTSALSTAHRAASRVEAGYVWINQTSRHYLGVPFGGVKHSGLGREECLEELLDFTATKSINIQL

SEQ ID NO: 73112 - protein, 354 aa, Oryza sativa Indica Group
MARRRRGFPATLLVTLLRLVGCLLLVCLAAPPCAAQQVKTSHAQFAFHLPLPDGVTGAESLAFDSSNHGPYTGVSHGRVLRWGGAAAGWTTFAHHQDYRKIPMCTTPVAPPEETESMCRRPLGLAFHDRTGDLYIADALHMRVGPRGGEAEVLAAGEDGVPFNFVNGIDVDQATGDVYFTDSSTTYPRRFNSEIMMNADATSRLLKYDAATKQVTVLRSGLPYANGVAVSRDGSHAVVAHTVPCQAFRYWIKGPNAGEYELLADLPGYPDNVRRDARGGYWVALNQEKVRLDATAAAAVAPPAKHLVGVRLDGDGVEVEELTTAKGVTLSEVVERGGKLWLGSVELDFIGLIMQ

SEQ ID NO: 73113 - protein, 295 aa, Physcomitrella patens subsp. patens
PPPPPRKGSAIVTHAGIGLMIYLAVGVAIYAWKNGEFSGIETSSVVDALYFCVVTMCTIGYGDIVPVTAFAKLFCCLFVLIGFGFIDALVSGMVTYVLDKQEHLLLSAVEGSHYRTAKKYFLNAKHGNRMRIRMKVGLALGVPVLCIIIGTVMMVKFEGLALVDAFYCTIMSITTVGYGDHTFKTFYGRLFAGLWLLFSTLAVARCFLYLAEARVDKRHRLIAKWVLQRELTVGDLVQADLDHDGCISKAEFVLYKLKEMGQIGAHEIADISHQFEQLDVNNAGKITLARLQEGN

SEQ ID NO: 73114 - protein, 288 aa, Rhodococcus sp. RHA1
MSAPRVAVVGSINMDLLTATERLPAPGETILGTAFAATPGGKGANQAIAAARAGGDVTFIGAVGSDVFALDLRQALVDAEVDTRYLREVDGPSGIAAITVDAAGENSIVVVPGANSTVADLTPTELAAVADADVLLCQLEIPLRTVLAAAAHATAHGTVVMLNPSPAQALPDELVKLVDVLLVNQTEAAQLGAEVTGAISHVVTTLGSSGADYAGSDGTTLHADSSEVEVVDTTGAGDAFAGALAVSWRRGPAIAVPFACTAGALATTRRGASTSSPTLAEIEAALPG

SEQ ID NO: 73115 - protein, 434 aa, Vitis vinifera
MFFMIILFISFLFIFFELGEGGRHGNIARWLKKEGDKISPGEVLCEVETDKATVEMECMEEGYLAKIVLGDGAKEIKVGQVIAITVEEEDDIAKFKGYEAPKGGAADGGKKSSASPPPMKEVAEKPASSPQPNVSKAVESSKAGDRIFSSPLAKKLAEDHNVPLQSIKGTGPDGRIVKADIEDYLASYGKEATTPFSEAATLDYTDLPHTQIRKVTASRLLLSKQTIPHYYLTVDTCVDKLMELRSQLNTLQEASGGKRISVNDLVIKAAALALRKVPQCNSSWTNDYIRQYHNVNINVAVQTDNGLYVPVVRDADKKGLSKIAEEIKHLAQKAKDNSLKSEDYEGGTFTVSNLGGPFGVKQFCAIINPPQSGILAVGSAEKRVIPGVGPDQFKYASFMPVTLSCDHRVIDGAIGAEWLKAFKGYIENPESMLL

SEQ ID NO: 73116 - protein, 175 aa, Lactobacillus johnsonii NCC 533
MAIDFKEHIASVQDFPNKGIVFRDITPILQDGKLYRAATHELADYAKSRGAEVIVGPEARGFIVGCPVATELGVGFVPARKPHKLPREVESASYDLEYGSNVLEMHKDAIKPGQKVVICDDLMATAGTLHATKELIENLGGEVVGAAFYIELTDLKGREQFPDLDIYSLVKYSDA

SEQ ID NO: 73117 - protein, 94 aa, Trifolium repens
LAVKEAAWGLARYAAISQDNGLVPIVEPEILLDGEHNIERTFEVAQKVWAEVFFYLAENNVQFEGILLKPSMVTPGAESKEKASPATVADYTLK

SEQ ID NO: 73118 - protein, 241 aa, Haemophilus influenzae R2846
MSNMEGKKVPQVTFRTRQGDKWVDVTTSELFDNKTVIVFSLPGAFTPTCSSSHLPRYNELAPVFKKYGVDDILVVSVNDTFVMNAWKEDEKSENITFIPDGNGEFTEGMGMLVGKEDLGFGKRSWRYSMLVKNGVVEKMFIEPNEPGDPFKVSDADTMLKYLAPQHQVQESISIFTKPGCPFCAKAKQLLHDKGLSFEEIILGHDATIVSVRAVSGRATVPQVFIGGKHIGGSDDLEKYFA

SEQ ID NO: 73119 - protein, 487 aa, Pseudomonas syringae pv. tomato str. DC3000
MKALDELVFDNRFARLGDAFSTHVLPEPIDAPRLVVASESALALLDLAPEQSELPLFAEIFSGHKLWAEAEPRAMVYSGHQFGSYNPRLGDGRGLLLGEVYNDAGEHWDLHLKGAGRTPYSRMGDGRAVLRSSIREFLASEALHALGIPSSRAACVVSSNTPVWREKQEYAAMVLRLAQSHVRFGSLEYLFYTKQPEHLKTLAEHVLTMHYPHCQEQPEPYLAMFREIVERNAELIAKWQAYGFCHGVMNTDNMSILGITFDFGPFAFLDDFDEHFICNHSDHEGRYSFSNQVPIAQWNLSALGQALTPFVSVEALRETIGLFLPLYQAHYLDLMRRRLGLTVAQDQDDKLVSQLLQLMQNSGVDYTLFFRRLGDQPAAQALRALRDDFVDIKVFDDWAQAYQARIAAEENGTEQARKERMHAVNPLYILRNYLAQNAIEAAEKGDYEEVRRLHQVLCTPFTEQPGMEGYAQRPPDWGKHLEISCSS

SEQ ID NO: 73120 - protein, 1987 aa, Pseudomonas syringae pv. tomato str. DC3000
MADRHDYVALEWLKGEIAETLRQARHALDEFIEDPANGAAMAECLNLVHQVHGSLQMIEFYGAALLAEEIEQLALAVQQNRVSHPVESEQLLIQAMSQLPLYLERIHSARRDLPLVVLPLLNDLRSARGESLLSETSLFAPQLVVVPALDEEELARRNTPELPGLLRKLRQTLQAALAGLMREQGVQTQLGYMAKVFARLEQLCEDAPLGPLWRISSALVETMLNGNFTNSPALRSLLKDADKELKRLAEQGVAGINQPAPEELLKSLLFYIAKSDSLAPKMLDLKDQYALADALPGNDVVNEERARMAGPDRDAMRSVIVALCEGLVRVKERLDVFVRGDRQHVSELNALLPPLRQIADTLAVLGFGQPRKVIIDQLSVVLGLAQGQREPSDGALMDVAGALLYVESTLAGMAGNNEQSSREESRLPTTDLTQIHQLVIREARNVLQQAKDVILDYIDGEWDRQRLDPLCALIVQVRGALAMIPLARAASLLAACNEYIQEHLLVDETRPTGVQLDCLADTITGIEYYLERMLEDHEAPGDQVLDMAQQSLARLGYTPAADTLEVPLLDEIITQDELLELDDRKALVSPTQTIAQVLASPMSAVNPPARNVPTSLLPPSPDEEAVDEELREVFLEEADEVLDALREYLPRWFASLGSGGHWDSTALTEVRRAFHTLKGSGRMVRALILSELAWSVENLLNRVLEGDVLPGLEVQQLMGEVLALLPSVIRDFADDAQCQRNDVDLLAARAHALANGLEAPSLSVADSHAPGEVLDPQLLEIFRQEALGHLNTLSRFLDNAEQSASPSISDAVLRALHTLKGSAHMAGVLPIAELASPLDQLVREYKANLIDIGAPELDVLRRAEPLLRMGLEQLDTTPLGEIAGAAQLIDAAFSLLNERLTAVLRDSDSGLRIKRNPTLLAGFLAEGMDIVLDAENLLRRWRQHPGERQELSALLDELTTLGHGAHLADLPQVDELCEALLDLYGAVEESSLAVSERFFDVAEQAHEALINMLDQVAAGQNVEPRPECVRALNDLLDQALDPSATGLVKSDGHRTLSVTELNAATEQLAREAVPPEVFSPDDEIVEIFLEEAVDILDSAGQALQRWLADPENPAPLSSLQRDLHTLKGGARMAEVVEVGDLAHELENLYEGLIDRRFNHSPTLAELLHKSHDHLAILLEQLYQHAALSDPSALIEALRGCRTVESAVPEAPLSSQASADLPEHDTELREVFLEEGFDIIESSGAALARWQADPHNLLEVENLLRDLHTLKGGARMVEIAPIGDLAHELETLYEGLCAGSMQADPLMISLLQSGHDVLADMLDAVRSEKPLSDATLLIENIRRLASDGPTGGQFVAQAIESGPEPVVAVTPVVDGEGERSGPEMVKVPAEQLEGLVNLAGETSIFRGRIEQQIIDSQVTLVEMETTIERMRDQLRRLDMETQGRILSREQVQAERLGYEEFDPLEMDRHSQLQQLSRALFESASDLMDLKETLGARARDAETLLSQQARVNTQLQEGLMRTRMVPFERLVPRLRRVVRQVASELNKKVHFEVGNADGEMDRNVLERMVAPLEHMLRNAVDHGLESTEKRIAAGKPEQGRINLELMYEGGDMLIELSDDGSGVDLAAVRRKAIKRGMIHPDADLADHEVLPFILQAGFSTSEIITQISGRGVGMDVVHAEVKQLGGSMVIDSVPGKGTRFRIRLPISVSVNRALMVTCGEEQYAVPLNTVDGIVRVMANELDGYYQTSPPRYQYGGRSYELRYLGELLGNSPPRLVGQLQPLPVLLVHLQDQWVAVQVDALAGSREIVVKSLGAQFSRVQGISGATILGDGRVVLILDLMAQLRTLQGLPFRGFTPAAYNEIEHARPLLVMVVDDSVTVRKVTSRLLERHGMHVLTAKDGIDAMSLLQEHTPDIMLLDIEMPRMDGFEVASQIRQDEQLKELPIIMITSRSGQKHRDRAMALGVNEYLSKPYQENVLLESITYWSQVDV

SEQ ID NO: 73121 - protein, 370 aa, Yarrowia lipolytica CLIB122
MKFSATLLFCASTLIAAATIAPLAPRGNQTKIINGFQVTDLVNDAGDELLLFKDLTNSSWPGDTSTSTNGVTLYSGAIKAWTSSDVAAVSQTSYNYLEKQAKLANIAYCGGSSLLTAPFTCAYQCKEFPNMKLVSTWGDSRTLSALVAGYLSIDHTDKEIVVGFRGSHTLKDWIVDLMVLRKAVDDSYPGCDNCRVHHGFYSAYKATLARFDNDLKKLVAENPGYRVSVVGHSLGGAVALLAATDFKNRGYDTYLTTFGQPVVGNTGFANYVDDLWFGSETPNTLSGDSSRRYYRVTHKSDVVPRVPFWPGYTPNAGEVYISVAEINPPVSALRYCDGEVNDQCLHGNSLLSLINLTAHHNYFIYIGGDC

SEQ ID NO: 73122 - protein, 398 aa, Clostridium perfringens str. 13
MKIVVQKFGGTSVSTKERRTMVVEKVKGAINKGYLPVVVVSAMGRKGEPYATDTLLGLVSEEFKKENKLATDLLMGCGEIISTVVMSDELREAEIEAVPLTGGNAGILTDDNYSSADFIDINPKLILEVLKEGKVPVVAGFQGVDRNGFLTTLGRGGSDTTAAVLGVALKAEEIEIYTDVDGIMTADPRIVGDAELINKISYNEVFQLADQGAKVIHPRAVEIAMKGNVTLVIKNTMSTCIGTMIDSLGDVDNNKFITGITHQGNRIQVSIKSDDNKDNINYKTILESLANNKISLDLINIFPKEKVFTIDAGVKELFEDIMRKNNLKYSLVEDLSTIAIVGSRMRGIPGVMAKIVGALDNENIEVLQTADSHMTIWCLVESKNVREAIKALHRVFMK

SEQ ID NO: 73123 - protein, 368 aa, Ralstonia eutropha JMP134
MKTKAAIAWKAGAPLTIEDVDLEGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPEREAMARKFGMTHFINPKDVGNVVDHIIQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFELMRRGESIRSVVLY

SEQ ID NO: 73124 - protein, 436 aa, Aquifex aeolicus VF5
MDLYEYEAYDKIFKKYGIPTPKYMFVEHITDDVVEFVNQLGECVVKSQVLVGKRGKAGAVRVCSNPDEALEEIETLLRMTVYGEMPVGVLVVEKANILKELYASIVYSTDHRAPVLTLSLEGGMDIEEVPPDKVKSWPINPLKGLYPHMVRNYLLELGFPHEYMPVLRKLSEVIARMWDAFWGAEARLLEINPLAIVDRGGKPDVLALDAVVKIDDDASIPPAKIYGVRTALRRPPTEREIAAAEIDKDDHRGKAGSYVELDGDIAMMTFGGGGSTVTIETCYELGLKPANLTDIGGNPPAEKMYKITRIILSKPGIRAVLIAGGTANNTRIDVTLGEGVANALRDLKKEGKLDPNWIFVVRRNGPEAEKGLRMLYEAFKECGIKGEIYDSALPLTEAPVRLKELLDKCQAKKLEEEEQIKEGHTFTDEQASDLGM

SEQ ID NO: 73125 - protein, 711 aa, Haemophilus influenzae R2846
MKQLFATTSRGFEELLKVELTELGAQEAKVVQGGVHYQADDETLYRTLLWSRLASRILFPLIETKIYSDLDLYAAVSGFNWLAQFDERVTFFVDFNGTNQEIRHTQFGAMRVKDGIVDYFERQGKTRPDVDKIQPDVRIHAYLNRENLVISLDLSGETLHLRGYREDAGQAPLRETLAAAIVMRSGWQVGSPLVDPMCGSGTLLIEAAQMEAKIAPQLYRLHWGFDFWKAHNQSAWEKVKNEAIELAEEKQREIQPHFYGFDLDHRVLKKAQKNAKNAGVSHLIKWQQGDVAALKNPRLNEVGTVICNPPYGERLGTTPALIALYSVFGQRLKKEFCGWNVSVFSSESTLLDCLRMRASRQFKAKNGPLDCVQKNYQVSERKSDAITDEKELEFNRTSEVAPDFANRLQKNIKKISKWAKQQELDAYRLYDADLPEYNLAVDRYADYIVVQEYAAPKNIDENKARQRLLDAVTATLQVTGVETNKLILKVRQKQKGTNQYEKLANKGEYFYVNEYGAQLWVNLTDYLDTGLFLDHRLTRKMIGELAKGKDFLNLFAYTGSATVHAALGGAKSTTTVDMSNTYLNWAEQNLILNDIEGKQHKLIQADCLQWLEKCDRQFDLIFVDPPTFSNSKRMEESWDVQRDHVKLMSNLKRVLSNNGTIVFSNNKRGFKMNLVALEELGLSAIEISHKTLPLDFERNKQIHNCWMIQHI

SEQ ID NO: 73126 - protein, 310 aa, Thermosynechococcus elongatus BP-1
MMKTFWQRLKSITAIVVVGVFIAHLVLDSGTAWAARSGGRIGGGSFSRPAPSRSYRAPRTDYGYAQPVPVYGGGFGFPFLIPFFGFGGGFGGLFTIIMLGVLANSLISAFRNFRNSGDDSEIDQDNPVVSLHTLHVGLLAQARELQAELNQLALTADTQSPEGLTKVLQEATLALLRHPQYWVYAHASSQETKLLQAETAFNQLALAERSKLSAETLSNYRREIKQTAIAPVVSKDVGEYIVVTLVVAATGRLKLPAVNNDLELRQALQELGGIGSDRLLAVEVLWQPQAIGDTLTADELLVAYPQLKHL

SEQ ID NO: 73127 - protein, 313 aa, Physcomitrella patens subsp. patens
GPRKFSLRELNIATKNFSQSELIGRGGMGSVYKGTLRPSGTVVAVKRIRHESKGGEQGFLAEASSISQIRHRNLVQLKGWCIEDNKFLLVYDYMPNGSLDQWLYDGRSEASRRRQRTGKDQLPWSLRYSIVTGIAAALAYLHEDWQQCVLHRDIKSSNVLLDAEFNAHLGDFGLARLIDHQKVEKTTLMAGTLGYMAPEMPFTGKATKETDVYSFGVLMLEVVCGKKPVDSHSNDLDMEPQDVVLLHKVWRAHEAGDILAAVDPRLRKESDKDEKMRTLHLGLLCCLPYPNARPSMRLVHQILTGDVTAIPSL

SEQ ID NO: 73128 - protein, 761 aa, Chromobacterium violaceum ATCC 12472
MDEQLRQSALEFHQFPTPGKIQVAPTKPLTTQRDLALAYSPGVTAPCDAIVEDPLNAYKYTARGNLVAVISNGTAVLGLGNIGALASKPVMEGKGVLFKKFAGIDVFDIEVNELDPDKLVDIICSLEPTFGGINLEDIKAPECFYIEKKCRERMGIPVFHDDQHGTAIVAAAAVLNGLRLVKKEIGEVRVVASGAGAAAIACLDLLVALGVKRENITICDSKGVVFVGRDEKLDESKLRYAIQDNGWRKLADAMAGADIFMGLSGPRLVSQDMVKSMARDPLILAMANPEPEILPPLVKEVRPDAIIGTGRSDFPNQVNNVLCFPFIFRGALDVGATTINEEMKLATVRAIADLAMAEQNDVVASAYGDQELSFGPEYVIPKPFDPRLIVKIAPAVAKAAMDSGVATRPIQDFDAYADQLAQFVYKTNLFMKPVFAQAKKDPKRVVMTEGEDERVLHATQEIVTQGLAKPILVGRPSVIEKRIEKLGLKMRPGVDFELVNNESDPRFNDYWQDYYQLMKRKGVSQEQARRRVIGNTTLIGAMMVRRGDADALICGTYGPYRQHFDILENVLGYANKDKVAGAMNALILPTGNIFITDTYVNAEPSAEQLAAITKMAAQSIQRFGIQPKAALLSNSSFGALNTASAQKMRAAFDQIRAAQPELEIDGEMQGDAALVESIRQQAMPDSTLKGSANLLIMPNVEAANISYNLLRVSASDGVTIGPILMGMAKPAHILTPISSVRRIVNMVALASVDAQVAAQQG

SEQ ID NO: 73129 - protein, 475 aa, Vitis vinifera
MEPRVGNKFRLGRKIGSGSFGEIYLGTNIQTNEEVAIKLENVKTKHPQLLYESKLYRILQGGTGIPNVRWFGVEGEYNVLVMDLLGPSLEDLFNFCSRKLSLKSVLMLADQMINRVEFVHSKSFLHRDIKPDNFLMGLGRRANQVYIIDFGLAKKYRDTATHQHIPYRENKNLTGTARYASMNTHLGIEQSRRDDLESLGYVLMYFLRGSLPWQGLKAGTKKQKYEKISERKVSTSIEVLCRGYPTEFASYFHYCRSLRFDDKPDYAYLKRIFRDLFIREGFQFDYVFDWTILKYQQSQLATPPSRVLGPGAGTSSGLPPPAVANADRQSGREEGRPAGLSSMDPSRRRISGDGGGLSKQKSPVASDLAVSKDAMLSSSHFLGRSSGSSRRAAVSSSRDAAIMGSESDPSRAHTTEASPGAAVRRISSGQRSSPVGSSDPKRTSSGRNITNIKNYESTIRGIENLNFDNDERVHY

SEQ ID NO: 73130 - protein, 507 aa, Chlamydia trachomatis D/UW-3/CX
MEEIKDFGPTLPACPPCIVVIFGATGDLTSRKLFPALYNLTKEGRLSENFVCVGFARRPKSHEQFREEMKLAVQHFSHSSEIDIRVWESLENRIFYHQANFSDAEGYSVLKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFFSEEIKKEKIKILKKILPIREEDAVRGQYGEGIVQDVSVLGYREEENVDPNSSVETYVALKLFIDNPRWKGVPFYLQAGKRLPKRTTDIAVIFKKSSYNLFNAENCPLCPLENDLLIIRIQPDEGVALQFNCKVPGTNKLVRPVKMDFRYDSYFNTVTPEAYERLLCDCILGDRTLFTSNEEVLASWELFSPLLEKWSQVRPIFPNYMAGSLRPQEADELLSRDGKAWRPY

SEQ ID NO: 73131 - protein, 139 aa, Rhodococcus sp. RHA1
MTERTLVLIKPDAVARGYVGEILGRIERKGLTISALDLRTAPGDIAAAHYAEHEGRPFYPGLLEFITGGPLVAAVLEGPRAIAAFRQLAGGTDPVEKAVPGTIRGDFGLEAQENLVHGSDSVESAEREIALWFPHLAAN

SEQ ID NO: 73132 - protein, 498 aa, Bacillus licheniformis ATCC 14580
MTNMSSLTMQVSKKLESFLQGTKKLYINGEFVASASNKTFETPNPATGETLATLYEAGPEDVDKAVKAAREAFDRGEWRTMNPAERSRLMYKLADLMEEHKTELAQLETLDNGKPISETTAGDIPLSIEHMRYYAGWATKITGQTIPVNGPYFNYTRHEPVGVVGQIIPWNFPLLMAMWKMGAALAAGCTVVLKPAEQTPLSALYLAELIDEAGFPKGVINIIPGFGETAGEALTDHALVDKLAFTGSTEIGKKIMEKAAKSVKRVTLELGGKSPNIILPDADLKKAIPGALTGVMFNQGQVCCAGSRVFIHKDQYDKVVDEMAAYSKSLRQGAGLHEDTQMGPLVSKEQHERVLSYIEKGRQEGAKIAAGGTCPYEQGYFVSPTVFTNVEDEMTIAKEEIFGPVLAAIPYETVDEVIERANRSEYGLAAGVWTENLKNAHYIADRLQAGTVWVNCYNAFDAASPFGGYKQSGLGREMGSYALDNYTEVKSVWIHTGE

SEQ ID NO: 73133 - protein, 452 aa, Nostoc punctiforme PCC 73102
MAFDYNLFVIGAGPGGLAAAKKAASYGVRVAIAEQESIGGTCVNRGCIPKKLIVYAADFALQKQIAPSYGWSECQTYFDWTLFIKSVHQHLDTLNQSYFQQLHKAGIELISDRATFIDAHTVDINGLKVTADKILIAVGGQPLKPKIPGIEYAITSREMFQLPYLPKRLAIIGGGYIGVEFSSMMHAFGCQVTVIEKDEMILSGFDDEIRSAVEQGLRKRGIKLLTSSTVQEIKYSDESLLLTITGKKREIITADTILVATGYAPNTKNLGLENAHVELGEHGAIKVDEYSRTTQENIFAVGDCTSRVQLSPVAKAEGIAFANTVFGNKVQKLDYDYVPSAVFCRPEAAGVGMTEAKAREKFGESVQCYYTQFQPLLYQLTDQNEPTTMKLVLNGDSGQVLGAHLVGEHAADIIQSLGVAIRKGITKEDLDEIIGIHPTVGEEFFSLDRVQE

SEQ ID NO: 73134 - protein, 442 aa, Zea mays
RTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVARELRVGPLALSVFRLTWRSAFVCATTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 73135 - protein, 338 aa, Pseudozyma flocculosa
MSQVAIGINGFGRIGRIVFRNSVVHNTANVVAINDPFIDLEYMVYMLKYDSTHGVFKGEVSHKDGKLIVNGKSISVFAERDPTAIPWGKVGAHYVVESTGVFTTIDKASAHIKGGAKKVVISAPSADAPMYVCGVNLDSYDPKAEVVSNASCTTNCLAPLAKVINDKFGIVEGLMTTVHATTATQKTVDGPSAKDWRGGRAASANIIPSSTGAAKAVGKVIPSLNGKLTGMAFRVPTTNVSVVDLTCRLDKGASYDEIKKEIKRASENELKGILAYTEDAVVSQDFVGHPASSIFYAAAGIALNDNFVKLVSWYDNEWGYSNRCLDLLCFMAQKDGSA

SEQ ID NO: 73136 - protein, 343 aa, Acidovorax sp. JS42
MPAKTMKAAVVREFGKPLTIEEVPVPTPAADQILVKIEASGVCHTDLHAAEGDWPVKPNPPFIPGHEGVGFVAAVGANVKHVKEGDRVGVPWLHSACGRCTHCLGGWETLCESQSNTGYSVNGGFADYALADPNYVGRLPKDLGFVDIAPVLCAGVTVYKGLKVTDTKPGDWVAISGIGGLGHMAVQYARAMGLNVAAVDVDDDKLALARQLGASVTVNARDTDPAAFLQKEIGGAHGALVTAVSPKAFEQALGMVRRGGTVSLNGLPPGNFPLPIFDMVLRGVTVRGSIVGTRLDLQESLDFAARGQVKATVRTEKLENINDVFARMHKGQIQGRVVLDMAA

SEQ ID NO: 73137 - protein, 347 aa, Chromobacterium violaceum ATCC 12472
MNSKKIAFNGAESRADQGNSVRLPPRRLSVAPMLDWTDRHYRYFARQITRHTWLYTEMVTTGALLNGDVARHLRFDEAEHPVALQLGGSEPAELATCAKLAQQWGYDEVNLNVGCPSERVQKGAFGACLMAEPQLVSDCVKAMRDAVDIDVTVKHRIGIDQIEHYDYLREFVDTVAEAGCRTFIVHARNAILKGLSPKENREIPPLKYDYVYRLKRERPDLEILINGGVKTNAEIAEHLKHVDGVMVGREAYHNPWLMADWDALFYGDETARPERVAVVEAMMPYVTARLGDGSNVRHIARHILGLFQGLPGARNWRRMLSDAKLLDGADAGLLRQAYEATLAGRRA

SEQ ID NO: 73138 - protein, 409 aa, Prochlorococcus marinus str. MIT 9303
MRLRIWDSGKGIASGTLSPMGLHETVDVGLSPDELERFSRHLTLPEVGMNGQKRLKAASVLCVGSGGLGSPLLLYLAAAGVGHIGIVDFDVVELSNLQRQVIHGTSWVGQPKTHSARARILEINPHCQVDLYEKALTRDNAFEIIHPYDIVCDCTDNFPSRYLVNDACVLLGKPSIYGSIHRFEGQATVFNLDAESPNYRDLVPEPPPAGLVPSCVEGGVMGILPGLIGLIQSAEVIKIITGIGTTLSGRLLVVDALAMTFREMALRPSQPRVVIDQLIDYQDFCASGADQPAQEKAAGLESISVQDLKSLLDLGAEDFALVDVRNPNEAEIACIAGSELIPLNKIESGEAIEKVRQLASGRRLYVYCKLGGRSAKALTTLKRHGIEGVNVTGGIDAWAKEVDNSLPRY

SEQ ID NO: 73139 - protein, 464 aa, Yarrowia lipolytica CLIB122
MDSDTESVKRRKSSGSESESSVRDPKRTKIEDEDFQENGIDDEDEEEEEEEAKDEGDEDDEEKGEDDEEDDEEKEGEDGEGEEEDEEEDEEKKREEEEKYVTSFNFDGVEYKYKERPAVIEEREGKIEFRVVNNDNSKENLMILTGLKNIFQKQLPKMPREYIARLVYDRSHVSMAVVRKPLTVVGGITFRPFDTRKFAEIVFCAISSTEQVRGYGAHLMNHLKDYVKATSPVMYFLTYADNYAIGYFKKQGFSKEISLDRSVWMGYIKDYEGGTLMQCSMLPRIRYLDVNKILLLQKALIHKKIRAISKSHVVRKGLDHFRDSTTPVDPMTIPGLKEAGWTPEMDELARRPKRGPHFAVMQHVLSELQNHASAWPFAQAVNRDEVPDYYEVIKEPMDLSTMEQRLEADSYKTMEEFVYDARLVFNNCRAYNNETTTYYKNANKLEKFMVAKIKEIPEYSHLVE

SEQ ID NO: 73140 - protein, 287 aa, Prochlorococcus marinus str. MIT 9303
MNERLRQGLVAAEGPLSGEVIKDVDCVAGGCIHQAWCLQLKGGRQLFAKTGGADALPMLKVEVEGLKALKAWADPEVLEVPEPLAFDQVCGEAVLLLPWLDFWAGNQASLGRGLALLHRASAAENPGRFGWPVDGFIGAGSQPGGWREEWGDAFVTLRLRPQLREAARWGLDLVDIEPILSALIPWLDRHQPSPSLVHGDLWSGNANVLSDGRGVLLDPATWWADREVDLAMTQLFGGFSQDFYIGYEKVWPLPADASKRVEVYNLYHLINHAISLEAHIEVRAKPF

SEQ ID NO: 73141 - protein, 721 aa, Pyrobaculum aerophilum
MNMISYALLGVILGISGVIYAVYLAVWVLRQDPGNEKMRFISQAIATGARAYLFRQYRTLAVLLVILAVLILVAIDMPRRTFGLTALAFIVGALGSMLAGYLGMYVTTRSASRVAQAAATGGMGKALLVSWRAGAVMGLSLASIALLLISGFYLVFRSVLPDDWAVPLVALGFGASLVTLFMRVGGGIYTKAADLGADLVGKVEAGIPEDDPRNPGVIADNVGDNVGDVAGMAADVYESYIVTVTAAIFLAAILGLPTQFIEAIILFAALALVATFAGVNLLKTTGVKHPLSSISLAIYATIGLTVVLFFIGAFTLGLDSTKALALAATTSLGAVIAPLIVKITDYYTSYNYGPVRKIAEQAKISPATVIITGYGVGLMSAIPVIAVIVAVLGISYMIGYYTVPVSGFGELSKYLAGIFGTAMASVGLLVVAGIIITADSYGPVSDNAGGVVEMAGLPDEVREITDVLDSVGNTTKATTKGYAIASAALAALVLFIALIFEIVYSASKILGKGIVDMISESLSGLQLINANVLIGAFLGVALVYFFSSRTLEPVGRTAMEIVEEIRRQFREKPGILEWKEQPDYARVVDIATRRALGEFLIPGLAAIVLPLITGLLLGWNALAGLIMGAIVAGVPRALLMANAGGAWDNAKKYIEIQGLKKTEMHKAAVIGDTVGDPMKDTVGPSLNPLIKVLNTLSVVFTYVIVSTNIALGIWPSGLLPF

SEQ ID NO: 73142 - protein, 448 aa, Yersinia pestis CO92
MKVTVFGIGYVGLVQATVLAEVGHDVLCIDIDANKVADLKKGRIAIFEPGLAPLVKENYEAGRLQFSTDAQAGVAHGVIQFIAVGTPPDEDGAADLKYVLDVASTIGTYMDSPKVIIDKSTVPVGTADKVHQVIQAILEQRGEKIDFSVVSNPEFLKEGAAVADCKRPERIVIGIDTDDSGALELISELYEPFNRNHDRMLVMDIRSAELTKYAANGMLATKISFMNEIANIAERLGADIEKVRQGIGSDSRIGYHFIYSGCGYGGSCFPKDIQALIRTAEDKGYKPQLLQAVEQINNQQKYKLTEFIKSHFNSQLAGKTFAVWGLAFKPNTDDMREAPSRVVMESLWEAGATIQAYDPEAMDETQRIYGARDDLRLMGTKESALQGADALIICTEWQSFRAPDFDMIKSRLKHPVIFDGRNLYDPERLNSRGFTYYGIGRGVSINLS

SEQ ID NO: 73143 - protein, 481 aa, Prochlorococcus marinus str. MIT 9303
MLEARSHQQLKHLLLQNSSPWPHHLTLSRLVARSLRRKDHTLIQLDPRSKDLWWLGLLVPLCLEAKDAVMILSDQQRRRLLKVELPQLLTKGIKLPCWEGHLPPSGNQLWLMNHSELIEAHHQGHLKSRQLIIPEADQLSQRLRDSMALSITPQDWERLRRAHPSAEASLMQLHERLSRSLFTHATRANAQVRLDGSEIQALKDLMRLLGPSPSPWPSVLKADSRFWASWAELDHRLLQWQWHLQPLEPLQNLPGLLRDQPSVLLSGSRENDLVRTELDAAAFPATVMARLSEPNLQEPIPLFAPRRQPLPNTEIYAEHLLDQCRRLILGRPGITVVLLDDQQLRRQLTSELAAEFGRRVVHETTAPESNGVVCCRWTWWLHHQDQLPLPEQLIVALLPLASVESPLTAARVESLKNQGRDWFRDLLLPEALSLLTPAIAPLRKNHGRLAILDGRLRGRSWGKQVLSTLEPWTPLQRLLPD

SEQ ID NO: 73144 - protein, 586 aa, Clostridium acetobutylicum ATCC 824
MYLEKINSPEDVKKLSIDEMKDLSTEIREVLLKKLSEHGGHIGPNLGIVELTIALHYVFNSPKDKIVYDVSHQSYIHKMLTGRKEAFINSEKYDEVSGYSNPEESEHDFFNIGHTSTSISLACGLAKARDVKDETDNVIAIIGDGSLSGGEAYEGLNNAAETGTNMIIIVNDNDMSIAENHGGLYKNLKELRDTEGKSECNFFKAMGLDYHYVKDGHDLEQLIGVFNKVKDTKQPVVVHIHTVKGKGFKFAEKNKEQWHWGMPFVLETGASKVSMGSAENYGNLTGEYLLDYMKRDPKVVAITSGTPAVFGFWKERRNEAGRQFVDVGIAEEHAVALASGIAANGGNPVYGVYSTFLQRTYDQLSQDLCINNNPAVLLVFAASVYGMNDVTHLGLYDIGMMSNIPNMVYLAPTCKEEYFAMLKWAMIQKDHPVAIRVPAMGVIESGVVDNTDYSKLNKYEVTKAGKDVAVIALGDFYQLGQSVTEKLSQENGINATLINPKYITGIDEELLEGLKKEHKLVITLEDGILDGGFGEKIARYYGASDMKVLNYGIKKELLDRYVPDELMKKNRLTDVQIVEDIMNIIK

SEQ ID NO: 73145 - protein, 230 aa, Borrelia turicatae
MIQKLTKIVATISDLRCDPEHIKELYEAGVNVIRLNTAHQSHDDAIRVINNVRKVSNKIALMIDTKGPEVRTANIENPITVKIGDKIIISTSPINESNALQTNYDGFVNEVPNGSTILIDDGELEMTVIEKLTDRLICKVKNDGQIKNKKSINTPGISLKLQSVTEKDKGFIELAAKQNIDFIAHSFVRHAKDIQDVKDILNAAGNPDVKIIAKVENQEGIDNIEEIAKA

SEQ ID NO: 73146 - protein, 328 aa, Leptospira interrogans serovar Lai str. 56601
MKHYDVFGVGNALVDILVPTENVFIKRLGFEKGIMTLVDSEKQAEVLTALEGSKKELRSGGSAANTMIALANSGGTGTYTGKVSKDTYGEFYKKDMENAGILFEVAPEDKGHTGTCVVLTTPDAERTMLTHLGISITLQKSDVDLEKLKSSSISYIEGYLWDGQGTKEASLLTMEESKKNGVKVAYTYSDPFCVNRSREDFIRLTKEYFDIVFCNTEEAKALSQREDKLEALKFISGLSALVFMTDSANGAYFAENGKISHVDGFPVKPIDTTGAGDCFAAGVLYGITHGFSLEKSTRWGNYVASRIVQEVGPRLGIKLMGRQDEILK

SEQ ID NO: 73147 - protein, 421 aa, Corynebacterium flavescens
MALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRADGRRAMEILKKLQVQGNWTNVLYDDQVDKVSLVGAGMKSHPGVTAEFMEALRDVNVNIELISTSEIRISVLIREDDLDAAARALHEQFQLGGEDEAVVYAGTGR

SEQ ID NO: 73148 - protein, 711 aa, Haemophilus influenzae R2846
MSRTIILIPVSTGVGLTSISLGLIHSLEQKGTKVAFMKPVSQPSTGEDKLDRTTSIIRTSTSLETAEPFMLSVAESLIGQNQSDVLLEKIVANHQQLTKNNDIVVVEGLIPTRKHGYANSINYEIAQALDAEIVLVAAPATETPTELKDRVEAAASLFGGKNNPNLLGVVVNKFNAPVDESDRTRPDLAEIFDSFQHNHISETEVNKLFAGSAIKLLACVPWNANLIATRAIDLVKHLGASIINEGEINRRIRGITFCARSLSNMIEHFRAGSLLVASADRPDVIVAASLAAANGIEIGGILLTGGYKIDAQINKLCRPTFEKAKLPIFRIEGNTWQTALSLQSFNLEVPVDDKERIENIKQYISQHFNADFINNLVADSSRLPRLSPPAFRFQLTELARAAKKRIVLPEGDEPRTIKAAVLCAERGIAECVLLADPASVQRVAEAQGVKLGKGITIINPADVRENYVDRLVELRKAKGMTETAAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRIAKEKRPDLLIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 73149 - protein, 392 aa, Thermococcus kodakarensis KOD1
MRYKKRKYFMAGRINILQRSKIRELFEKASKMENVISLGIGEPDFDTPEVIKEAAKRAIDEGYTHYTPNAGIPEFREAIAEYYKEFYNVDVDMNNIIVTAGAYEATYLAFESILEQGDDVIIPDPAFVCYVEDAKIAEAGIIRIPLREENKFRIDPDELLEAITKRTRMIVMNYPNNPTGAIMKKDVAKAIADIAQDYNIYILSDEPYEHFLYEGARHHPMIKYAPDNTILANSFSKTFAMTGWRLGFAIAPEQVIRDMIKLHAYVIGNVTSFIQIAGITALRDKRSWEAVERMRQVYDERRKLVLKYLNDMPHITPFRPKGAFYIWAKIDPELDMTSEDFAEWLLENAGVVVIPGTAFGRQGEGWIRISYATEKEKLIEAMERMKEALSKL

SEQ ID NO: 73150 - protein, 535 aa, Pseudomonas putida KT2440
MATLHTQINPRSAEFAVNSAAMLEQVQALRGLLAQVAQGGGPKAQERHTSRGKLLPRERIDRLLDPGSPFLEIGQLAAHEVYGEDVPAAGVIAGIGRVEGVECMIVANDATVKGGSYYPLTVKKHLRAQTIALQNRLPCIYLVDSGGANLPRQDEVFPDREHFGRIFFNQANMSAQGIPQIAVVMGSCTAGGAYVPAMADEAIMVRQQATIFLAGPPLVKAATGEVVSAEDLGGADVHCRTSGVADHYADNDEHALAIARRSVANLNWHKLGKLQRLAPVAPLYAADELYGVVPADAKQPFDVREVIARLVDGSVFDEFKALFGTTLVCGFAHLHGYPVAILANNGILFAEAAQKGAHFIELACQRGIPLLFLQNITGFMVGKKYEEGGIAKHGAKLVTAVACAQVPKFTVIIGGSFGAGNYGMCGRAYDPRFLWMWPNARIGVMGAEQAAGVLAQVKREQSERSGQPFSAEDEARLKQPILDQYERQGHPYYSSARLWDDGVIDPAQTRDVLGLALSAALNAPIEQSRFGIFRM

SEQ ID NO: 73151 - protein, 468 aa, Physcomitrella patens subsp. patens
MKSRNENIRDEARRQGAGCSPTTFSAKYVPFCPGQETDEEYSLDEVIYRSKTGALLDVQHDIEALRRAGDGNYWKKLFDSRVGKTTWPYGSGVWSKKEWVLPEIDDDDIVSVFEGNSNLFWAERFGKEALNMSDLWVKHCGISHTGSFKDLGMTVLVSQVNRLRKLGKPLLGVGCASTGDTSAALSAYCAAAGIPAIVFLPANKISIAQLVQPIANGALVLSMDTDFDGCMRLIREVTSELPIYLANSLNSLRLEGQKTAAIEILQQFDWEVPDWVIVPGGNLGNIYAFYKGFYMCKELGLVDRMPKLVCAQAANANPLYRAYKDGWETFKPVKALPTFASAIQIGDPVSIDRAIHALSQVDGIVEEATEQEIMDVCAQADKSGMFTCPHTGVALVALQKLRGRGVIGANDRTVVVSTAHGLKFTQSKVDYHSSELPEITSKFANPPVTVPDDFGSIMDVLRQKLALR

SEQ ID NO: 73152 - protein, 189 aa, Glycine max
  misc_feature (74)..(74): Xaa can be any naturally occurring amino acid
  misc_feature (83)..(83): Xaa can be any naturally occurring amino acid
  misc_feature (122)..(122): Xaa can be any naturally occurring amino acid
  misc_feature (134)..(134): Xaa can be any naturally occurring amino acid
  misc_feature (164)..(164): Xaa can be any naturally occurring amino acid
MAERGGGERGGDRGGFGRGFGGRGRGGDRGRGRRRGPRREEEEKWVPVTKLGRLVKEGRIRSLEQIYLHSLPIXKEHQIIDTXLVGPTLKDEVMKITPVQKQTRAGQRTRFKAFVVVGDNNXHVGLGVKCSKEXATAIRGAIILAKLSVFRERVTGEQDWKPHXSFKVRECGPVRWSLGSGFQKGLGPL

SEQ ID NO: 73153 - protein, 408 aa, Mycobacterium sp. JLS
MGLDILLATVGLLGVVVAALSAKMRRLPISEPLLGLVAGVVIGPQVSGLLHVPALTDEQSLLHETSRVLLAISVMAVALRYPAAEVRRTWRPVTVLLLVAMPLMAVVTAALGWFLLSIPFVAAALLGAALCPTDPVLASSVVTGEDAERDLPARDRKVLSLESGANDGLALPLVLVAIAIAGGMSAGAAVRESLWQILGAVVVGAAMGWAGGQALKWGDRFGATAAAPALFFTVVLALGILGLAGLLHLDGILAVFVGGLLFNLAGTGDERAAEVPIDEAINRFAVLPLFVLLGAALPWHSWADLGWSAVALAVCVLLLRRLPILLLLRRPLRLSVPDALYLGWFGPVGVSALFYLTMEADRIGVDETVLAAGSLVLVVSTMTFGLSGVAGRLLYVRATGAAHSPADR

SEQ ID NO: 73154 - protein, 245 aa, Thermosynechococcus elongatus BP-1
MSETAVAIVTGASRGIGRAIALELAKEGATVVVNYARSAEAALEVVQRIEQQGGTAIAIAADVSVPEQVDTLVAKTVETYGRVDVLVNNAGITRDTLLLRMSLEDWQAVINLNLTGVFLCTRAVSKLMLKQKRGRIINIASVAGQMGNPGQANYSAAKAGVIGFSKTVAKELASRGITVNAVAPGFIATEMTAELKAEDILKFIPLGRYGEPTEVAGMVRFLALDPAAAYITGQVFNVDGGMVMA

SEQ ID NO: 73155 - protein, 507 aa, Acidovorax sp. JS42
MNMAEIASLGIANPYKQQYGNYIGGQWVAPVDGQYFENISPINGQKFTAVPRSNSKDIDAALDAAHKAKAAWGRTSTTERANILNRIADRMEANLLQIAVAETIDNGKPLRETMAADIPLAIDHFRYFAGAVRAQEGGISEIDADTIAYHFHEPLGVVGQIIPWNFPILMAVWKLAPALAAGNCVVLKPAEQTPASILVLMEIIGDLLPPGVVNVVNGFGLEAGKPLASSNRIAKIAFTGETTTGRLIMQYASQNIIPVTLELGGKSPNIFFEDVMSADDGFFDKALEGFAMFALNQGEVCTCPSRALIQESIYERFMERALKRVAAIQQGHPLDKNTMIGAQASQEQLEKILSYLDLGKQEGAQCLIGGARNTALGGDLAGGYYVQPTVFKGHNKMRIFQEEIFGPVVSVTTFKTEEEALEIANDTLYGLGAGVWSRDGARAFRMGKGIQAGRVWTNCYHHYPAHAAFGGYKQSGIGRENHKMMLDHYQQTKNLLVSYTQQPLGFF

SEQ ID NO: 73156 - protein, 338 aa, Klebsiella pneumoniae subsp. pneumoniae MGH 78578
MIIDQCRKLALRAPARVVFPDALDVRVLKAAHYLQQQGLAHPILVASPFALRQFALGERLPLTGVQVIDPHSNLAMREAFAAAWQARAGDKAPADAVDKLADPLMFAAAMVSAGQAEVCIAGNLSSTASVLRAGLRLIGLQPGCKTLSSLFLMLPQYTGQPLGFADCSVVPQPTAAQLADIAIASAETWQAIAGEAPRVAMLSFSTHGSARHPCVANVQQATEIVRQRAPQLMVDGELQFDAAFVPDVAAHKAPGSPLQGRANVLVFPSLEAGNIGYKIAQRLGGYRAIGPLIQGLAAPLHDLSRGCSVEEIIELALVASVPRQTDASRIPDSSTLVE

SEQ ID NO: 73157 - protein, 344 aa, Vitis vinifera
MSNSKETFNMADLGSSLPGAVAALNAEDRADLVNALKNKLQNLAGQHSDLGSVWRLSGRSRHGQHDELEAKFFEERAALEAKYQKLYQPLYSKRYDIVNGVVEVDGVTNEVTMDQEDKAEEKGVPDFWLTAMKTNEVLAEEISERDEGALKYIKDIKWCRIDNPKGFKLEFFFDTNPYFKNSVLTKTYHMIDEDEPILEKAIGTEIEWFPGKCLTQKLLKKKPRKGSKNAKPITKTESCESFFNFFSPPQVPEDDEDIDEDTAEELQNQMEQDYDIGSTIRDKIIPHAVSWFTGEAAQGDEFGDMEDDEDEDIDEDDDEDEDEEEDDEEDDDEDEEDSKAVKKV

SEQ ID NO: 73158 - protein, 262 aa, Gluconobacter oxydans
MSKKFNGKVCLVTGAGGNIGLATALRLAEEGTAIALLDMNREALEKAEASVREKGVEARSYVCDVTSEEAVIGTVDSVVRDFGKIDFLFNNAGYQGAFAPVQDYPSDDFARVLTINVTGAFHVLKAVSRQMITQNYGRIVNTASMAGVKGPPNMAAYGTSKGAIIALTETAALDLAPYNIRVNAISPGYMGPGFMWERQVELQAKVGSQYFSTDPKVVAQQMIGSVPMRRYGDINEIPGVVAFLLGDDSSFMTGVNLPIAGG

SEQ ID NO: 73159 - protein, 474 aa, Burkholderia vietnamiensis G4
MQPAEIGTPLRRTLGARHINLMALGATIGVGLFLGSATAIRLAGPSILLGYAFVGVFVFFVMRALGEMAVAHPVAGSFNRYAYEYIGPRAGFVTGWTYWFMWILCIMAEVTAVAIYMKFWFPGMPAWVWSLAALATMGLLNFVAVRAFGELEFWFAAIKIVTIVFMILSGIGIIGFGFGNGGVATGIGNLWRHGGFLPNGMWGLASAIPMVVFAYLGVEIIGLTAGETKNPEKSLARAVNSVFWRIAIFYIGALFIIMSLYPWNAIGTQGSPFVLTFERLGIRGAAGIINFVVLSAALSSCNSGIFGTARIVFNLAQQGQAPRIFAHTSKSGIPACAVVLTLVAALLGVLLNYVAPKGLFEWLTAIGTFAGLFSWAIILVAHYRFRRQRVAQDNRMLMPWWPYSSYCTLAFLAVLVAFMLKFDETRVAVIVGPLWLAFLWIVYGLSAKNGASRQGVPSPSASFAVEGVTRDIRD

SEQ ID NO: 73160 - protein, 361 aa, Zea mays
  misc_feature (233)..(233): Xaa can be any naturally occurring amino acid
MGGRASRHRAQPHDQSSHPPPRPPPKQQQQQQGQQHPNNRPNKPKQQQQPPPPRPPPPHQAPPASAAAPGAATVGRVLGRPMEDVRASYTFGRELGRGQFGVTYLATHKPTGHRYACKSIATRKLAHSDDVDDVRREVQIMHHLTGHRSIVELRGAYEDRHSVNLVMELCEGGELFDRIIARGHYSERAAAALCREIVSVVHSCHSMGVMHRDLKPENFLFLNKREDSPLKAXTDFGLSVFFKPGEQFRDLVGSAYYVAPEVLKRRYGAEADIWSAGVILYILLSGVPPFWAENEDGIFDAVLRGHIDFASDPWPSISNSAKDLVKKMLRQDPKERLTAAEILNHPWIREDGEAPDKPLDI

SEQ ID NO: 73161 - protein, 448 aa, Haloarcula marismortui ATCC 43049
MRGDTGAIVGVCISHERASVDQLETAAADSERHAVESLLANPAVEEAIALQTCNRTEGYVVVSDHEDGLEALELFTRAVPDDVVVEMGHEESLRHLLRVAAGLESIVLGEDQILGQLRTAYETARGVGGIGPMLEDGVTKAIHVGERARTETKINEGVVSIASAAVRLLKQESSLTDGTALVVGAGEMGQLAAEALSEEVDRLLVANRTVPHAEHIAESVDIDASALALDGIEAAVSEASAVISATGSGDQVFDIGTFSDSGDVSIVDIAQPRDVPAGADRLPSVTVYDLDALESVTAETRNKRQRAAEAVERIVDEEFDRLLTQYKRKRADRVISTMYESAEQVKAAEINSALSAADFDDEQAEVVEAMADAIVSQILAAPTKSLRDAAEEDDWSTIHTALQLFDPDFGGPDQATPPEFTKGMSVEDIPDGMRDEIPNAMLDRLSDD

SEQ ID NO: 73162 - protein, 518 aa, Pseudoalteromonas tunicata D2
MFNLLSRAPKSAKNDVLSGLTVALALVPEAVAFAFVAHVDPLVGLYAAFIVGLITAIFGGRPGMISGATGALAVVMVSLVLDHGVEYLFATVLLMGLLQILAGVFKLGKFIRMVPYPVMLGFVNGLAIVIFLAQLGQFKVPDDTGVMQWMQGSALYIMLGLVALTMAIIHFLPKLTTAIPSSLAAIVVVTGIVVGFDLDTRNVVDFLRSMTGDASATLAAGLPSFHIPSVPFNLETLQIIFPYALILAAIGLIESLLTLTLIDEITQTRGNGNKECIGQGAANMTCGVFGAMGGCAMIGQSMININSGGRSRLSGITAALMLLVFILFTSSLIEMIPLAALVGVMFMVVLGTFEWSSLRIMNKVPKSDAFVIVLVSGVTVLTDLAIAVCVGVIVSALVFAWEHAKHIYVSAYIDAQGSKVYELHGPLFFGSVKNFLDLFDIQNDPKDIIIEFKHSRVADHSAIDAIDTLAERYTKAGKKLHLKHLSNDCIQLLEKASGLVEFNVIEDPTYKVASDKLG

SEQ ID NO: 73163 - protein, 759 aa, Klebsiella pneumoniae subsp. pneumoniae MGH 78578
MDEQLKQSALDFHEFPVPGKIQVSPTKPLATQRDLALAYSPGVAAPCLEIEKDPLAAYKYTARGNLVAVVSNGTAVLGLGNIGALAGKPVMEGKGVLFKKFAGIDVFDIEVDELDPDKFINVVAALEPTFGGINLEDIKAPECFYIEQQLRERMNIPVFHDDQHGTAIISTAAILNGLRVVEKNLSDVRMVVSGAGAAAIACMNLLVALGMQKHNIVVCDSKGVIYKDREPNMAETKAAYAVEDDGKRTLDDVIDGADIFLGCSGPKVLTQEMVKKMARAPLILALANPEPEILPPLAKQVRDDAIICTGRSDYPNQVNNVLCFPFIFRGALDVGATAINEEMKLAAVHAIAELAHAEQSEVVASAYGDQDLSFGPEYIIPKPFDPRLIVKIAPAVAKAAMDSGVATRPIADFDAYIEKLSEFVYKTNLFMKPIFSQARKEPKRVVLAEGEETRVLHATQELVSLGLAKPILVGRPSVIEMRIQKLGLQIKAGVDFEIVNNESDPRFKEYWSEYYQLMKRRGITQEQAQRAVISNTTVIGAIMVHRGEADAMICGTIGEYHDHYRVVQPLFGYRDGVSTAGAMNALLLPSGNTFIADTYVNHDPSPEELAEITLMAAESVRRFGIEPRVALLSHSNFGSADCPSASKMRKTLELVKARAPELMIDGEMHGDAALVESIRNDRMPDSPLKGAANILVMPNMEAARISYNLLRVSSSEGVTVGPVLMGVAKPVHILTPIASVRRIVNMVALAVVEAQTEPL

SEQ ID NO: 73164 - protein, 51 aa, Phaseolus vulgaris
MKQFRVLTCQTVADMIKGKTPEEIRKTFNIKNDFTPEEEEEVRRENQWAFE

SEQ ID NO: 73165 - protein, 278 aa, Chromobacterium violaceum ATCC 12472
MGAYRFQIVNVFAEQRFGGNPLAVFTDASGLSGEEMQLIARQFNLSETVFLFPGDAECAASLRIFTPSYELPFAGHPTLGSAAALHARGELGDDFTLRTRSGLIPITHRDGVFRLQALPATARPGCGIDEAAAMLGLSAQDVLHAPQWVDAGSAQLLIGLSSREAVLRAQPDPALFVRHATLRPGRSIAYVWHQDDGVATVRLFFEQLGAVIEDPGTGSACANLGGWCALNGLAPLSWRVEQGEAINRPNALYLDVDAAGAVRVGGRAQFMGEGVFRC

SEQ ID NO: 73166 - protein, 217 aa, Salmonella enterica subsp. enterica serovar Paratyphi A str.
MNQTLLSSFGTPFERVELALDALREGRGVMVLDDEDRENEGDMIFPAEIMTVEQMALTIRHGSGIVCLCITEDRRKQLDLPMMVENNTSAYGTGFTVTIEAAEGVTTGVSAADRVTTVRAAIKDGAKPSDLNRPGHVFPLRAQAGGVLTRGGHTEATIDLMTLAGFKPAGVLCELTNDDGTMARAPECIAFAGQHNMAVVTIEDLVAYRQAHERKAS

SEQ ID NO: 73167 - protein, 121 aa, Photobacterium profundum SS9
MSITNEQILDAVADMSVMQVVELIEAMEEKFGVTAAAAVVAGGAAAEAAEEQTEFDVILTAVGAQKVQVIKAVRGATGLGLKEAKAVVDSAPASVKEGVDKAEAEALKAQLEEVGASVEIK

SEQ ID NO: 73168 - protein, 228 aa, Pseudomonas syringae pv. tomato str. DC3000
MSTIAANISTLEQRIRDAALAAKRDPASVGLLAVSKTKPAGDLREAYTAGLRDFGENYLQEALGKQLELADLPLCWHFIGPIQSNKTRAIAENFAWVHSVDRLKIAQRLSEQRPEGLEPLNICIQVNVSGEASKSGCAPQDLPALAAAINALPRLKLRGLMAIPEPTDDPAAQAASFAAVRTLQEQLNLSLDTLSMGMSHDLEAAIAQGATWVRIGTALFGARDYGQP

SEQ ID NO: 73169 - protein, 272 aa, Pseudomonas syringae pv. tomato str. DC3000
MSKTRIAFVGAGNMAASLIGGLRAQGVEASLICASAPGAETRERISTEHGIEVFADNAEAVKGADVVVLAVKPQMMKSVCQALKASLEAHQLIVSVAAGITCASLTQWLGDQPVVRCMPNTPSLLRQGASGLYATDKVSPTQREQAEQLLSAVGVAVWVEQEKHMDAVTAVSGSGPAYFFLMMEAMTAAGVKLGLPEDIAKKLTLQTALGSALIATGSNVDAGELRRRVASPGGTTEAAIKAFQAGGFEALVETALTAADHRAAELAEQLGK

SEQ ID NO: 73170 - protein, 270 aa, Geobacter sulfurreducens PCA
MLKGSTLGFIGGGNMAEAIIKGLLAGGVAAADVMVAEPVAARREYLHGTYGIDVCADNGRVAAAADALVMAVKPQVFRGMVAALGPAGLDGKLLISIMAGITTADMEEVCGSAARVIRVMPNTPALVLEGASTLCRGRNATDDDLFFATGIFDLVGTTCVVEEKLMDAVTGVSGCGPAYVFLFMEALSDAGVKNGLPRDVATRLAAQTVLGAARLLLETGDHPGVLKEKVTSPGGSTIAGIASLERDAFRGAVMAAVDAATARSAELGKK

SEQ ID NO: 73171 - protein, 263 aa, Bacillus thuringiensis serovar konkukian str. 97-27
MQEVWKDIDAHAKQWIRDAGEHLMASMKKALIIETKSNAADLVTNMDREIEQFLIGKIKETFPHHNILGEEGYGDEVTSSDGVVWLIDPIDGTMNFVHQKRNFAISIGIYENGIGKIGLIYDPVHDELYHALKGAGAFCNEVPIPLLQRGTVEQGIVALNAIWLTDNPLLNMESMMALVKKARGTRSYGCAALEMVYVATGRIDAYVTPRLSPWDFGGGQIIVEEVGGKVTTFSGTPLSIVEKSSVLVAKPGVYEEVLSFISK

SEQ ID NO: 73172 - protein, 175 aa, Triticum aestivum
MAPTVMASSDTSVAPFQGLKSTAGLPVSRRSNGASLGSVRNGGRIRCMQVWPIEGIKKFETLSYLPPVSTEALLKQVDYLIRSKWVPCLEFSKVGFIFREHNASPGYYDGRYWTMWKLTMFGCTDATQVINDVEEVKKEYPDAYVRIIGFDNMRQVQSVSFIAFKPPGCEEYGKA

SEQ ID NO: 73173 - protein, 231 aa, Geobacter sulfurreducens PCA
MAIADNLTHILAKIAAAARRAGRDPASVRLVAVSKTIPAEAVEDAARAGQRLFGENYVQEFTAKAREVRDPVEWHFIGHLQSNKVKYLAGLVTCIHSVDRLSLAEEIDRQWAKLDAVCDILVQVNIADEETKSGTSASELTDLVAAMATLPHVRVRGLMTMPPFFDDPEEARPYFRELRRLADAVAAENIPGISMTELSMGMSGDFEAAVEEGATLVRIGTALFGERVYRP

SEQ ID NO: 73174 - protein, 428 aa, Francisella tularensis subsp. tularensis SCHU S4
MNFISTRDKNIKVSLSEAMQSGLAPDGGLFVLERFPTVNWQSFAKDISYAKFAANTLREFFKGDQLEDSLDKICNNAFTFEVPVRRLDKTTSVLELFHGPTLSFKDFGARFLANCLSSIDSEKPFTILVATSGDTGSAVAAAFHGKSNIRVIVMFPKGKISKRQEKQITCWGDNIQAVEVEGVFDDCQSLVKEAFKTPWWTERTKLNTSNSINIGRLLPQSTYYAYTSWQHYLQTGEKANYIVPSGNIGNITAAFWAKQMGFPIGEISMSLNANDTVVDYLETGKFNPKASVETLANAMDVGNPNNFERLLYLLGNYENFKANVKAICVSDFEIIEEIKQVYRQYHEVVCPHTATGFVAKNQLDSNKDYIIVATAHPAKFESVIEPILDIQVPPTPALQKLLDKEQNKVVINKSMDELCEVYTKAFEA

SEQ ID NO: 73175 - protein, 630 aa, Photobacterium profundum SS9
MAIEINVPDIGADEVEVTEILVSVGDKVEEEQSLITVEGDKASMEVPASQAGIVKEIKIAEGDTVSTGSLIMLFVEEKSEAEGAAAAPAVEAAAPVAAAPAAAELKEVHVPDIGGDEVEVTEIMVAIGDSIEEEQSLLTVEGDKASMEVPAPFAGVLKEIKIAAGDKVSTGSLVMIFEVAGSGASVAPAAPVAQAAAPVAAAPVASAAKEVNVPDIGGDEVEVTEIMVAVGDTVEEEQSLITVEGDKASMEVPAPFAGTVKEIKIVAGDKVSTGSLIMVFEVAGSAPAPVAQAAAPVAASAPAAKPAQAAAPAGDFQENNEYAHASPVVRRLAREFGVNLSKVKGTGRKSRIQKEDVQNYVKDALKRLESGAAASAKGGDGSALGLLPWPKIDFSKFGEIETKPLSRIKKISGANLHRNWVMIPHVTQWDNADITALEAFRKEQNAIEAKKDTGMKITPLVFIMKAVAKALEAFPSFNSSLSDDGASLILKKYVNVGIAVDTPNGLVVPVFKDVNKKGIYELSEELMAISKKARSGKLTASDMQGGCFTISSLGGLGGTAFTPIVNAPEVGILGVSKSEMKPVWNGKDFEPRLMLPLSLSYDHRVVDGAEGARFITYLNGCLSDIRRLVL

SEQ ID NO: 73176 - protein, 300 aa, Methylococcus capsulatus str. Bath
MNPERSLSDFMRSSQERVERALDARLPAADRMPERLHQAMRYSVLGGGKRMRPLLTYATGQTIGVAADLLDGPACAVEFIHVYSLIHDDLPAMDDDDLRRGKPTCHKAYDEATAILAGDGLQALAFHVLAQDPSIAVPAENRIAMIETLAKASGPAGMVGGQAIDLASVGKKLDLPGLENMHIRKTGALIRASVRLACLARPGLPAEQFDRLDHYAKCIGLAFQIQDDILDEESDTQTLGKTRGKDRDHNKPNYPALLGLSGAKEKAEEMHEAALESLAGFGPEADLLRELARFIIQRQS

SEQ ID NO: 73177 - protein, 328 aa, Francisella tularensis subsp. tularensis SCHU S4
MLLWPAEWEEHSATWMIWPARIDMWPNITKAYEIYAKVANTIAKYEPVNMVVNQHQLDIAKKYLGKNMTLISEAVDDSWARDIMPIFSFKADKLIANNFDFNCWGNKFSPFDNDRRLKNDIAKQQKWQVNSSKMILEGGAVHSNGQGVLLTTKECLLNLNRNPNMQKEQIESELISILGVKKILWLPYGVAGDFDTDGRVDNVACFANKNTIIIQSCYDENDENFARHQANMTYLDKYASEFNIVEIPQPRAQYFAGERLALSYLNFYIVNNAIIMPAFGDPNDVIAFEILQKCFKDRSIEQLNIIDLVIGGGGIHCITMQQPAIKEI

SEQ ID NO: 73178 - protein, 639 aa, Methylococcus capsulatus str. Bath
MTETKRYALLEAADHPAALRNLPEDRLPELAEELRGYLLESVSRSGGHLAAGLGTVELTIALHYVFNTPEDKLVWDVGHQAYPHKILTGRRARLPTIRKKGGLSAFPNRAESPYDCFGVGHSSTSISAALGMAVAAALERRPIHAVAIIGDGGLTGGMAFEALNHAGTLDANLLIILNDNEMSISPNVGALNNYLAKILSGKFYSSVRESGKHLLGRHMPGVWELARRAEEHVKGMVAPGTLFEELGFNYFGPIDGHDLDTLITTLRNLRDQKGPRFLHVVTRKGKGYAPAEKDPVAYHGVGAFDLDADELPKSKPGTPSYTEVFGQWLCDMAARDRRLLGITPAMREGSGLVEFSQRFPDRYFDVGIAEQHAVTFAAGQASEGYKPVVAIYSTFLQRAYDQLIHDVALQNLPVLFAIDRAGLVGPDGPTHAGSFDLSFMRCIPNMLIMAPSDENECRQMLYTGFIHDGPAAVRYPRGRGPGVRPEETMTAFPVGKGEVRLRGKGTAILAFGTPLAAALAVGERIGATVANMRFVKPLDEALILELAATHDRIVTVEENAIAGGAGSAVGEFLAAQHCGIPVCHIGLKDEFLDQGTREELLAIAGLDQAGIARSIDAFIQATAAADKPRRARGQAKDKH

SEQ ID NO: 73179 - protein, 675 aa, Corynebacterium glutamicum ATCC 13032
MAFSVEMPELGESVTEGTITQWLKSVGDTVEVDEPLLEVSTDKVDTEIPSPVAGVILEIKAEEDDTVDVGGVIAIIGDADETPANEAPADEAPAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEEPKKEEPKKEAATTPAAASATVSASGDNVPYVTPLVRKLAEKHGVDLNTVTGTGIGGRIRKQDVLAAANGEAAPAEAAAPVSAWSTKSVDPEKAKLRGTTQKVNRIREITAMKTVEALQISAQLTQLHEVDMTRVAELRKKNKPAFIEKHGVNLTYLPFFVKAVVEALVSHPNVNASFNAKTKEMTYHSSVNLSIAVDTPAGLLTPVIHDAQDLSIPEIAKAIVDLADRSRNNKLKPNDLSGGTFTITNIGSEGALSDTPILVPPQAGILGTGAIVKRPVVITEDGIDSIAIRQMVFLPLTYDHQVVDGADAGRFLTTIKDRLETANFEGDLQL

SEQ ID NO: 73180 - protein, 171 aa, Methylococcus capsulatus str. Bath
MDKLRAKIRDIPDFPKPGILFRDITPLVKDPAALRLAIHQLVHPFVGEDITAVAGMEARGFIFGALAAWELGVGFVPLRKPGKLPYNVQSIDYDLEYGSARLEVHLDALGVGDRVLMVDDLLATGGTARASCSLVESLGAEVAACAFVIELDALEGREALHGRRVHSLLHY

SEQ ID NO: 73181 - protein, 311 aa, Ralstonia eutropha JMP134
MSIDILAYGEPLVEFNQQPDDPTRYLQGFGGDTSNFCIAAARQSATTGYISAVGADSFGERLMALWTRERVDTRHVRVDPVAPTGVYFVSHDNHGHRFDYLREGSAASRYQHEHLPLGAIAQASFLHLSGISLAISTSACDAGLAAMEHARKAGTKVSLDTNLRLRLWSLARARGIMREAFSLTDVCLPSWDDITVLTGLDDRDAIVDYLLGCGIGLVALKLGEEGAYVATPESRTLVQPFAVKPVDATGAGDCFGGSFIARLAAGADPFEAARYANVAAALSTTGYGAVAPIPSAETVLARLAQSVSVIA

SEQ ID NO: 73182 - protein, 362 aa, Methylococcus capsulatus str. Bath
MSGTPPSQPARHEHLSDDEFQAHFLDGVSRTFALTIPRLPEGLARPVSNGYLLCRIVDTIEDEVALTSTQKRRYCEHFARVVAGTAPAAPLADELFPLLSDQTLAAERELIAAIPRVISITHGFAAPQQEALAECVATMSRGMAEFQDKDLRHGLEDLRQMGDYCYYVAGVVGEMLTRLFCHYSPEIAAHRSRLMELAVSFGQGLQMTNILKDLWDDHARGVCWLPQEVFTECGFSLTELRPHHANPDFVRGFERLIGVAHAHLRNALEYTLLIPRHETGIREFCLWALGMAVLTLRKIHRHPYFSDSAQVKITRQAVKATIVTSRLTRGSDTLLKATFRLAGLGLPAAVPAAVLQPRPIDI

SEQ ID NO: 73183 - protein, 520 aa, Triticum aestivum
  misc_feature (341)..(341): Xaa can be any naturally occurring amino acid
MAATPPSSRDPSPQPRRPAAAAGRPAASGTGTIGNGKRGGLLLGRYELGRVLGHGTFAKVYHARHADTGETVAIKVLDKEKALRAGLVPHIKREITILRRVRHPNIVRLFEVMATKSKIYFVMEFVRGGELFARVAKGRLKEDTARRYFQQLISAVGFCHARGVFHRDLKPENLLVDERGDLKVSDFGLSAVADQFHPDGLLHTFCGTPSYVAPEMLARRGYDGAKADIWSCGVILFVLMAGYLPFHDQNLMAMYRKIYRGEFRCPRWFSRDLTSLLNRLLDTNPETRITMAEVMQSRWFQKGFRPVRFYVEDDQLHSLGDSESEELGLVEPTEPPLPPPXFPPPLPPPPQQEDDDSGWESDSSVASCPATLSCEERQRPAGRLTRPASLNAFDIISFSKGFDLSGLFEERGSEVRFISAQPMETIVTKLEEIAKMKSFSIRRKDWRVSIEGTREGEKGPLTIGAEIFELTPSLLVLEVKKKAGDKAEYDDFCNKELKPGMEPLVHHQSGSARNVPSDTE

SEQ ID NO: 73184 - protein, 653 aa, Arabidopsis thaliana
MEPEMVRLPIHEHWLTPARDNRWGKCCGLQFKTISDGYNCRKCRYFFHKSCSNCPKEINHPSHKCDKNLSLITNFASWSVRCRTCKETIQPYIQNYECQRCEFNIHLDCFKYPPPKVIDFPQNHDHKLKLEMVRSSFTCFTCGKGGSGYPYKCHECDLAFHVDCEKYGAEVNHPSHSLHTLKLITGKPPAYTDGNCSLCGKKIFDEMFYHCSACNFTLDLRCVSLPPPLNLHDQNTHNHELTLMPKLISFTCTTCGLHGDRSPYVCLQCNFTSHNNCSGFPWVININRHDHRVSRTSLLGIIDSVCGVCRKKMDWSCGGYSCKRCSESTFHTKCATREDVWDGIEMKDEPEEDEPMEPFEVISEGIIRHFSHIEHNLRLDKSGTFVEERSCKACAYPIYHDPFYSCMSCDFLLHENCAKHPTRKRHVLSNKPYILHASQRNYSKCKACGVFFNCFIYGTFPFGLDVRCASFSGSLVHPSHQHPLFYTSPKGVCSACNKETSHVLRCVEDKCGYALDFKCALLPHEVKHRVDDHFLSLCYGERDASGKYWCDICEKETDPTKWFYTCKDCGVTLHTNCVLGDFRGLEPETNIVLDDDRMQMTLYETVRNNSMSRPVCYKCKYHCIFPIILKVTDEDKYFCSISCCDIKTLPFYN

SEQ ID NO: 73185 - protein, 321 aa, Aquifex aeolicus VF5
MNILVTGCAGLIGWKVSEKLLEHGHRVIGVDNLNSYYDPRLKEYRLEQLKKFENFKFYKVNIENREALRILFQEFEFDAVINEAARAGVRYSIQNPHIYFTTNTLGNLNLLELMKEFGVKKLILASTSSLYAGQPMPFKEELPVNTPISPYAASKKAAEVTAYTYHYLYGIDVVILRYFTVYGLAGRPDMAVFNFIYKTLKGIPIKVYGDGSQKRDFTYVDDVAEATVKALNLKGYEIINVGNNKPRALKELIELIEKYTGKEVKVEYGDFHKADMRDTWADITKAKRLLGWEPKTSLEEGVKKTVEWFLENWDWVKDLRV

SEQ ID NO: 73186 - protein, 421 aa, Caragana jubata
MVRGLLNKLVSRSLSVAGKWQNQQLRRLNIHEYQGAELMSKYGVNVPRGVAVSSIEEVRKAIKDVFANQNEVVVKSRILAGGRGLGTFKSGLQGGVHIVKTDQVEDLAGKMLGQILVTKQTGPQGKVVSKVYLCEKLSLVNEMYFAITLDRKTAGPLIIACRKGGTSIEDLAEKFPDMIIKVPIDVFEGITDEDAAKVVDGLAPKGADRNKSIEQVKNLYKLFVESDCTLLEINPIAETADNQLVAADAKLNFDDNAAYRQKGIFKLRDTTQEDPREVTAAKADLNYIGLDGEIGCMVNGAGLAMATMDIIKLHGGTPANFLDVGGNASEGQVVEAFKILTADDKVEAILVNIFGGIMKCDVIASGIVNAAKQVALKVPVVVRLEGTNVDQGKRILKESGLALITAEDLDDAAQKAVKAYK

SEQ ID NO: 73187 - protein, 150 aa, Brassica napus
PNSAQLGFVGEVARVDPNVLRPLVDYGYIPVIASVAADDAGQAYNINADTVAGELAAALGAEKLILLTDVAGILEDKDDPSSLVKEIDIKGVKKMIEEGKVAGGMIPKVKCCIRSLAQGVKTASIIDGRRQHSLLHEIMSDEGAGTMITG

SEQ ID NO: 73188 - protein, 637 aa, Klebsiella pneumoniae subsp. pneumoniae MGH 78578
MAHNEEQHVLTPQRFLPRITVIKAEGQRNAITCRHCEDAPCVRSCPNDAIAQSGDSVQVRQEKCIGCKSCMVACPFGVMQVVVTPQAAGLVKASAHKCDLCQGREAGPACVENCPAQALTLADDETLITLAKQRRLRSACQEVQPWQRATPLCSQPNAGAKVRQMAMTPPRGEPDKLAAEVRKSHFEEIYQPFTPQQAQQQAARCLTCGEHSICEWTCPLHNHIPQWIELVKAGNIAAAVALSHQTNCLPEITGRVCPQDRLCEGACTLRDESGAVTIGNIERYISDQALASGWRPDLSQVKPSGKRVAIIGAGPAGLACADMLVRHGVQPVVFDRHPEIGGLLTFGIPAFKLDKSLLARRRAIFSEMGIRFELNCEVGKDISMATLLADYDAVFVGAGTYRSMKAGLPNEEAPGVYDALPFLIANTKQVMGLAASAQEPYVNTAGLNVVVLGGGDTAMDCVRTALRHGARQVTCAYRRDEANMPGSKKEVKNAREEGALFEFNVQPVTLELDENGRVNGVRFLRTELGAPDAGGRRRPTPIPGSEFVMPADAVIMAFGFHPHRMPWLEAAGVALDSQGRIKAGVESRYRYQTSQEKIFAGGDAVRGADLVVTAMAEGRHAAQGILDYLARKTTPLH

SEQ ID NO: 73189 - protein, 1285 aa, Coprinopsis cinerea okayama7#130
MPSYHGHRYSESVNQNRKAQLANAYNELGKELASSKIRVVGNYTLGKVIGEGAYGKVRLGTHRLTSTRVAIKQIPKAMSATLTREIHHHRQLHHPHITQMYEVIATESHIWIVTELCCGGELFDYLVEKGRLSEEETKIIFGQLCLAVAYLHETGIVHRDLKLENVLLDERCRVKLGDFGFTREYERGSLMETFCGTTGYAAPEMLQGKKYQGPEVDVWSLGVILYCLLTGTLPFDDDNEDVMRQMIIKGEFEDPAWLSLESRDLIKNILVKDPMKRFTIPQILAHPWFTTKDLTYEPESPLSVDTSLLTIPQPDEENPDELTIDTNFINGASTSPPRTPDNDPDGDPFNSTPNSITHRASSSTLRREDDAVESKSLKLRPISWSNSSGSKIPPPSKIRTPARTKRRSVSSVLSLSVDNAKSGEGDAEPTPLTPLPPPTSHSLDFASLLTTPTPIIFSTPLERELLNSLSALGMDTAQIVHSVLSDACDSAGAIWWMLKKKAEKRALEEPTDVVSPTTATEPHGRTNGAESELKSSRKVRKVQAGVQTESLVPSPTYLSKPAPQLAFVPPTPTFAKPSTPPRAVSPTRSPMLSPSSSTTHELPRSHPSTPGSSMKESKGRKNRSGSVSIMQRATTALEAAGLVRKKSTEGVREQREKSKDKDNDNEKRNTSGEESRSSHSHDPRGSKLTKSPPLKAQRDYNVPATPPPSETHDSTQIGSPWVLADAKNGAGPSHAPLRGEMPHSHSAPNLDTATIKAPTQHRNKANILTSLRLWFNEDRKGKRKDSTDSNPRVPSTPQQTYTRTAGGGGTAKRRGSNASAKVMRNSTGHRAKRPSMSSRRSSSVNSRRSSITSMQIPVLDSPQQLSNIRAMGSHTPNSERGDHSSRPSSIHSISSRQKPRHRKSPSASSSGSLHLRTASPMQKYHRRAGSGSSTRVIRQSLARPPHARSNSATSSLYSPPSSRPTSFYEQSETETGNVIGNTSSSSSAPRNSSPYRSRKYSDSDSIGGSRPPTSFLASKRSNPFSSPALGGGTLSKSSWKKSWGIEPPGWQNRTTHLPVEVLVISSSNEPATLRDVFSGRHSFSTTTGAGDDSDWVDEDDDIPAFAGGLGQMGASISSSSSSSAPINPEPIVTLSPAPRHRNTKRNGGGKQSMVVVVSTASNQTWTVTTTAIAIATKPLNCALLPHNLHSNLSINSTMSEPYDPYLPRAGSSSGNPGSTGGGAGNAKTAAIQAQIDDTVGIMRENITKVAERGERLDSLQDKTDNLAVSAQGFRRGANRVRKNMW

SEQ ID NO: 73190 - protein, 248 aa, Chromobacterium violaceum ATCC 12472
MSGKLVIGNWKMNTRGDSARQLAAALLADGQTNREGVGIAAPAVYLAALAEQLKGGKIALSSQDVSRFAADGAFTGEVSAAMLADVGCRYALVGHSERRQYFREDNAALLAKMRNAIAAGVTPVLCVGETLAQREAGDYLNVVREQLAILSDIADGEYVVAYEPVWAIGTGKVASLEQIAEIHAFIKNWCLQNAGGSAKIRVLYGGSVKAENAEAILATENVDGALVGGASLDADSFRVICQAAGKMI

SEQ ID NO: 73191 - protein, 240 aa, Oryza sativa Indica Group
MGGGVMRTAAAKWASSWEVDDWEFADWRDVAGAEPEVTAAGKPRLVFAPPSREEAEEATTELRDAIDRVYFSEAPIEVVKEQDKDLSKLGADAIIPAMPGHVMQAFTLLKSSPEAQGVVASLASDKNVWDAVLKNEKVMEFYKTHQQSLVYTFPEGTASVVSPEKLADASSENSSSGEKPESSPFADFMDNARKTVIDIVNNITNFFQDMFRKPNEAEILGGSFMALAIAVILLIMFKKA

SEQ ID NO: 73192 - protein, 511 aa, Rhodopseudomonas palustris CGA009
MVYDLAIIGGGINGCGIARDAAGRGHSVFLCEMNDLASGTSSWSTKLIHGGLRYLEYFEFRLVREALIERERLWQIAPHIIGPLRFVLPHHDGLRPAWRLRLGLFMYDYLGGRKLLPPTRSVDLAHDEVGKPLIPGRYTKGFEYSDCFVDDARLVVLTARDAAERGAEIRTRTRAVQVSQQGGIWQVTLEDVGSGARSTIQARALVNAAGPWVEGVLRSGAGVDARYKVRLVQGSHIVTRKLYDHDRAYIFQNADGRIVFAIPYQGDFTLIGTTDRDYHGDPSQVKATPEEIDYLCKAVSGYFAKPVTPADVVWTFSGVRPLYDDGASEAKAATRDYVFELDTPGGAPLLSIYGGKITTYRRLAEEALEKLSSYLKGGTAKQGWTAHQPLPGGDFPVDGGPALIGDLLREYPFLASAHASRLVHAYGTRARDVLGSAKSAADLGRDFGATLTEAEVRYLMSREWACSADDIVWRRSKLGLRLTPAAVAALDEWVIVHRAAEKPQQQAGGRA

SEQ ID NO: 73193 - protein, 402 aa, Pseudomonas syringae pv. tomato str. DC3000
MADQGSPRRFARIDRLPPYVFNITAELKMAARRRGEDIIDLSMGNPDGATPPHIVEKLVTVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFAELEKAIRGSIPKPKMMILGFPSNPTAQCVELDFFERVVALAKQYDVLVIHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPEAYAHLGSLEFAKKLLAEAKVCVSPGIGFGEYGDDHVRFALIENQDRIRQAVRGIRSMFRADDKLKS

SEQ ID NO: 73194 - protein, 360 aa, Photobacterium profundum SS9
MTLKVAINGFGRIGRSVLRALYESGKHHHINVVAVNELAEPEAMAHLLQYDSSHGRFFKPVSHDQEHLFIAHENGERDDIRILHQSDITLLPWHDLDVDIVLDCTGVYGSREDGLAHIKAGAKKVLFSHPAANDIDNTIIYGVNHKTLTSEHRIVSNGSCTTNCIVPVIKIIDDAFGIESGTITTIHSAMNDQQVIDGYHSDLRRTRAASQSIIPVDTKLHLGIGRIFPKFVDKFEAISVRVPTINVTAMDLSVTVKTNVKVNDVNQALSEVSRCTLEGIVDYTEAPLVSIDFNHDPHSAIVDGTQTRVSNKHLIKLLVWCDNEWGFANRMLDTALAMHASDAAQHSNKELRSKIAIKNS

SEQ ID NO: 73195 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKCLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLSGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 73196 - protein, 463 aa, Listeria monocytogenes str. 4b H7858
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIISLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPFYPVLPIVSFLLCAFLISRLSVHTWILCGIWFVIGLIVYFAYGRKHSELLKK

SEQ ID NO: 73197 - protein, 528 aa, Rhodopseudomonas palustris CGA009
MRNFHLAGRSTVHARNGMVATSHPQAALAAIEILKAGGTAADAAIAASALLAVIEPQSTGIGGDCFALVQPKGTGKITAYNGSGRAPAAAKAEWFLEKGIDAIPLTSPHSVTVPGAIDAWATILRDHGRFGLDKVLQPAIKAAAEGYVVAPRIAFDWANGFNKLKKGANTERYLLPHGEAAKTGDVITQPELANTLKLIADKGPDGFYKGAVAEDMVDTLRGLGGLHTLEDFAEHCTETTSPIGTIYKGLDVWQCPPNGPGITMLVMLNILSRFDLTKFGPLSVERFHLEAEATRIAYMIREQHIGDPQHVDVDVLRILAKEFAEEHYSQIALDKLLDLPVVSPPMNPSTVYITVVDEERNVCSFINSIAHSFGSAIVSNKTGVLLQNRGAGFRIQPGHPNCIAPKKRPLHTIIPALATENGRARMSWGVMGGQYQPVGQVHVLTNVLDYGLDMQEAIDLPRGLHYEDVYQLEDGVPAATVEGLKALGHKVLPIGTPHGGGQGIWIDWDKGTLTGGSDPRKDGCALGY

SEQ ID NO: 73198 - protein, 223 aa, Ralstonia eutropha JMP134
MPSLSHESDSITLAADADERPLALRIAQALDAMREGRPVVLLDDDDRENEADLILAAECLTPSNMAMMIRECSGIVCLCLTTDKVRQLGLRPMVENNRSQYGTAFTVSIEAREGVTTGVSAVDRITTIRAAIAKDAGTDAVVSPGHVFPLVAVDGGVLVRRGHTEGSVELARMAGLSPAAVLCELMNPDGTMARRPEALSFAEMYRLPILTIADLVAWREIHG

SEQ ID NO: 73199 - protein, 330 aa, Photobacterium profundum SS9
MTIKVGINGFGRIGRFVFRASVERNDIEVVGINDLIDVEYMAYMLKYDSTHGRFNGTVEVVDGNLVVNGNTVRVTAVRNPEELKWDEIGVDVVAEATGLFLTDETARKHITAGAKKVVLTGPSGDVPMFVMGVNSADYAGQDIVSNASCTTNCLAPIAKVINDKWGIESGLMTTVHATTATQKTVDGPSMKDWRGGRGASQNIIPSSTGAAKAVGKVIPELNGLLTGMAFRVPTANVSVVDLTVNLKTAATYEEICAEMKRASENEFAGVLGYTEDAVVSQDFIGEVQTSVFDAKAGVALTDKFVKLVSWYDNEIGYSNKVLDLIAHVSK

SEQ ID NO: 73200 - protein, 254 aa, Bacillus thuringiensis serovar konkukian str. 97-27
MKEKVVIITGGSSGMGKGMATRFAKEGARVVITGRTKEKLEEAKLEIEQFPGQILTVQMDVRNTDDIQKMIEQIDEKFGRIDILINNAAGNFICPAEDLSVNGWNSVINIVLNGTFYCSQAIGKYWIGKGIKGNIINMVATYAWDAGPGVIHSAAAKAGVLAMTKTLAVEWGRKYGIRVNAIAPGPIERTGGADKLWISEEMAKRTIQSVPLGRLGTPEEIAGLAYYLCSDEAAYINGTCMTMDGGQHLHQYPF

SEQ ID NO: 73201 - protein, 462 aa, Bacillus sp. TA2.A1
MNKGRIIQVMGPVVDIQFESGQLPDIYNAITIERPQGGTLTVEAAVHLGDNVVRCVAMASTDGLVRGLEAVDTGAPISVPVGKATLGRVFNVLGEPIDEQGEVNAEERHPIHRPAPEFEELSTADEILETGIKVIDLLAPYAKGGKIGLFGGAGVGKTVLIQELINNVAQEHGGLSVFAGVGERTREGNDLYHEMKDSGVISKTSMVFGQMNEPPGARLRVALTGLTMAEYFRDREGQDVLLFIDNIFRFTQAGSEVSALLGRMPSAVGYQPTLATEMGQLQERITSTKKGSITSIQAIYVPADDYTDPAPATTFAHLDATTNLERKLAEMGIYPAVDPLASTSRILSPAVVGEEHYRVARGVQQVLQRYNDLQDIIAILGMDELSDEDKLIVARARKIQRFLSQPFHVAEQFTGMPGKYVPVKETVRGFKEILEGKHDNLPEEAFYMVGTIDEAVEKAKKL

SEQ ID NO: 73202 - protein, 508 aa, Providencia rettgeri
MPMLSLNLSIRLSMLEKMKLEWFSNIRGDLLAGIVVALALIPEAIAFSIIAGVDPKVGLYASFCIAVVIAFVGGRPGMISAATGAMALLMVTLVKEHGLEYLLAATLLTGVIQIVAGYLKLGSLMRFVSRSVVTGFVNALAILIFMAQLPELTNVTWHVYAMTAAGLGIIYLFPYIPVIGKALPSPLVCIVALTAFAMMIGLDIRTVGDMGELPDTLPIFLWPDVPLNFDTLMIILPYSLGLAVVGLLESMMTATIVDDLTDTKSDRNRECKGQGIANIGSGLLGGMAGCAMIGQSIINVKSGGRGRLSSFSAGIFLLVMVVFLGDWLKQIPMAALVAVMIMVSIGTFSWSSIKDLKKHPLSTNIVMIATVIVVVATHNLAIGVFVGVLLATLFFANKIGRFMVVKATQTDEASRTYRVVGQVFFASSEQFIDSFDFKEAVDKVTIDLTHAHFWDITAVSSLDKVVIKFRREGATVDIVGMSEATETIVDKFGVHNDPKEVEKLMAGH

SEQ ID NO: 73203 - protein, 374 aa, Methylococcus capsulatus str. Bath
MTDIFDPSDEFGPARIIQVREPSVGLRATVIIDNVALGPAIGGLRIASAGSTADGCRLARTMTLKSAAADLPHGGGVAMLHPAPGSPENACRQHRVRALACALRSEDQFIFAPDMGSGETTMAWIRDENGRAVGLPRELGGIALSRIGAAGWGLYHATEVALRYCGFKLEDARVVIQGFGTVGQNTARYLVENGAVVVGIADSGGTLYHPRGLDIAELVAIKAKGGSVVDSSEGERLAPDAAVDLDCDIWIPAAGSDVITPDNAARLKARLVVEAADASLAPAAERYLHEKGIICVPDFIANAGGLIGAAMECRGANKTQVLSAIKEKIRRNTEKVLQSVETDGTLPREAAVRLAMKPIVKAMSYRRWSGLSAD

SEQ ID NO: 73204 - protein, 197 aa, Brassica napus
KSVGVVGHKIYVVGGVRSNENLAESFDLTTETWEPAPIPKEEKTWLASATVSLDRKVCALMLVGAYTVCYDTGDGSCESFPSPPDKWWKTGVCGMENVLYVYYARFGLMWYDTKLRVWRVVNGLGHVKKVRSVGMAEYYGKVALLWKEHGGCGKEIWCRMIAMGKCEEGVKGTAESAQLLGSVPDGYRMDHCLSVSD

SEQ ID NO: 73205 - protein, 209 aa, Listeria monocytogenes EGD-e
MTKKPIVVGVTGGSGSGKTSVTKAICNHFSGHSILMIAQDVYYHDQANISFEDRLKVNYDHPLAFDTDLLISHIAALRRYESIEKPIYDYAKYTRKKEVEIQEPREVIILEGILILEDKRLRDLMDIKVYVDTDDDIRFIRRLLRDMKERGRTMDSVIEQYLSVVKPMHNEFIEPTKKFADIIIPEGGENHVAIDLMTTKIESILQKHV

SEQ ID NO: 73206 - protein, 416 aa, Vitis vinifera
MPCTLQLYGAPLTDGTVPNTLVIANCEIVKPRVAAAEYISAFNEEARSPFVKKHKTILHPGEVNRIRELPQSNRIVATHTDCPEVFIWDIEAQPNRHAVLGAAVSRPDLILTGHQDNAEFALAMCPAEPFVLSGGKDKSVVLWSIQDHISTLATDSETTKPPGSGGSIIKSNSNPSEGNDKPADSPSIGPRGIFHGHEDTVEDVQFCPSSAQEFCSVGDDSCLILWDARVGFSPVVKVEKAHNADLHCVDWNPHDQNLILTGSADNSVCMFDRRNLTSGGVGSPIHKFEDHKAAVLCVQWCPDKSSVFGSSAEDGLLNIWDHQLVGKKKEGGPRTPTSASGLFFKHAGHRDKVVDFHWNASDPWTVVSVSDDCDVSGGGGTLQIWRMSDMIYRDEDAVLAELRNFKSHVAECPSWQ

SEQ ID NO: 73207 - protein, 490 aa, Escherichia coli
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVPEVSSPHRPLQRTRKNRTRAIYCVPQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 73208 - protein, 614 aa, Aspergillus nidulans FGSC A4
MAAVSEITERTGQIAIDPSSQAPATKPITGFSGPFKTRLDQIYQSLTTESSNFSRDIQRDDQDPKDNNPLSSLAAFHAYMASPSASALRPAGPPDDSAPITDYFISSSHNTYLTGNQLYSDAAAKAYTDVGLGMVQVFENETANQSSDDDGTSSSSSSSDDEKSKDKPKVSIFGRKSPSSEPAADDGKVAEPAKVGPIRLEPKVLHGHTLTKGTTFREVCYAIRDSAFIVSDLPVIVSLEVHASLEQQETMVEIMEDAFDGMLIQVTPEMEAMETPPPLRDLKRKILVKVKWVSPSAENAEDVDDRTDDLEQLAPTKSAGASSQSASQAAQKPSKILHSLSRHAIFTKGFSFKQFSQPEAKVPGHVFSLSERAARQADEKYGKELFEHNRKYFMRVYPYGLRVNSSNLDPTFFWRRGAQIVALNWQNSDKGMMLNQGMFAGEQGWILKPQGYRSTEPESAPIPRRTVDLSIEVLAGQDLTLPPGDKNEKGFRPYVACYVHVETPEDAANPGLKGDDSTDSEKTSYKRVTKAGEGVNPDFGSQILQFPTLPGVVEELTFVRFKVKDDEIGFDSLASWACIRLTRLQEGYRVLRLYKCDGSDSGGFLLVRITKNIS

SEQ ID NO: 73209 - protein, 544 aa, Legionella pneumophila subsp. pneumophila str. Philadelphia 1
MTKESEIKIPDIGGANQVDVIEILVKEGDQIEVDTPLITLESEKASMDIPSPISGTVTQILVKVGDKVSEGDLIVKAKSDTTTNISSSQEQKTEPEKQNLQTRAEEQSVDTKATASTPSSKDIEISIPDIGGANDVDVIDILVKPGMEVEKDQALITLEGDKATMDIPSPYAGKVIEMKIKLGDKVSQGTPILTLKTLGKSETPEIEKSQIKNISEQSIKEIEKPYEELKSEAISINNLEIAESKSILISAGPAVRRLAREFGVDLSLVQGSGRKSRITKEDLQNYIKVRLSEKTTSGGFSLPSNPAIDFSKFGSIETKPLNKIKKLTGTNVHRSWITIPHVTQFDEADITDLEAFRKSESESAKNQDYKLTLLAFVCSVVCKALHAYPQFNASLDTSGENLIYKKYYNIGIAVDTPNGLVVPVIKNVDKLSVIDIAKEMSRLSTKAREKGLTPIDMSGGCFTISSLGGIGGTAFTPIVNSPEVAILGLSRSIIKPIYDNKEFKPRLMLPISLSYDHRVIDGAEAARFTRFLCDCLGDIRRVLL

SEQ ID NO: 73210 - protein, 369 aa, Chlamydomonas sp. W80
MSGKAVHARQASRARKGAPIRMESDASEKKLKVAINGFGRHRPSFLPRLGGPQQSRLLDAGSAINDSGGVKQASHLLKYDSILGTFDAEVKIVDDSHISVQRQVRIQIVSSRDPLQLPWKALDIDLVIEGTGVFIDTKGAGKHIEAGAKKVLITAPAKGDGIPTFVCGVNADDYKHEYPIISNASCTTNCMAPFVKVLEEKFGIIKGTMTTTHSYTGDQRLLDASHRDLRRARAAAMNIVPTSTGAAKAVALVLPSMKGKLNGIALRVPTPNVSIVDLVVQVEKKTFAEEVNAAFREAANGAQKGVLAVSDEPLVSVDFRCSDVSSTIDASLTMVMGDDMVKVVAWYDNEWGYSQRVVDLAEITAQKWE

SEQ ID NO: 73211 - protein, 383 aa, Acidovorax sp. JS42
MTTPHFPSRLPNVGTTIFTVMSALAAEHQAVNLGQGFPDFHCDPQLVDAVTRAMQAGHNQYPPMAGVPALRQAVASKIEALHARQYCPNAEITITAGATQAILTAILACVQPGDEVIVLEPCYDSYVPNIALAGGVVVRVPLKPGSFRPDFAKIAAAITPRTRLLIINTPHNPSATVWTADDMRTLEELLAPTDVLLISDEVYEHMVFDGAEHQSAARFAGLAERAFIVSSFGKTFHVTGWKVGTVAAPAAMTAEFRKVHQFNVFTVNTPMQYGLADYLQNPAPYLQLPAFYQAKRDLFRQGLEGSRLKLLPSTGSYFQCVDISAVSDLNEADFCQWLTREIGVAAIPLSAFYGDGFDQRVVRFCFAKKDETLRAAIERLRTL

SEQ ID NO: 73212 - protein, 288 aa, Pseudoalteromonas tunicata D2
MWHTIAKQISENLNIDFVITHKEQLNQGAQTLAFKISDGQHHFFVKLNELNGLDQFEAESFNLTELTLHSTFFVPDCICTGITLDHSFIVLEWLTFSNQSTDNWQQLGEGLAQMHQKHEQAMFGWQQDNFLGKSIQTNRWHKRWDIFFAEQRIGWQLQLLHEKGLHFCDINEFIEITKHTLHNHVIEPSLLHGHLWRGNVGFVNHQAAVFDAACYYGDREVDLAMSELFGHFPADFYHAYQAHYPLSATASERKPFYQLYYLLNQANVFQGMYLTQAKSLIKQLIERN

SEQ ID NO: 73213 - protein, 629 aa, Pseudomonas syringae pv. tomato str. DC3000
MSFASLGLSEALVRAIEAAGYTQPTPVQQRAIPAVLQGRDLMVAAQTGTGKTGGFALPILERLFPNGVPDKSQRHGPRQPRVLVLTPTRELAAQVHESFKLYARDLKFVSACIFGGVGMNPQVQAMSRGVDVLVACPGRLLDLAGQGSVDLSHVEILVLDEADRMLDMGFVHDVKKVLARLPAKRQNLLFSATFSNDITSLAGKLLHNPERIEVTPPNTTVERIEQRVFRLAANHKRSLLAHLITVGAWEQVLVFTRTKHGANRLAEYLDKHGLAAVAIHGNKSQNARTKALADFKAGDVRIMVATDIAARGLDIDQLPHVVNFELPNVDEDYVHRIGRTGRAGRSGEAISLVAPDEEKLLKSIERMTKQKIADGDLMGFDITAVEAEKPEVRERPDVRNSRGARPARADGDKNNGGRRDKGKDKGKDKPAAAAATGERPARPPREKKPREGTPRSEQRAVQPSTPRQASDRAPDEFRDDEVDNFGNRADYVSPYQGKGQNRGRRPAAAPGAAPAAGGAARPANSGRPAGGAPRTGSGAGAPKRNGSGSSAPRSRDSQPRGRRPAREDQPLPREGQEPAVRAPRDGQPQPKIVHKESKIDRFPSAEQLDQLPARPRGEKPALLTRNRDS

SEQ ID NO: 73214 - protein, 273 aa, Triticum aestivum
QQRLGHRVENPLKGNLFLNIGEGPVKPFLAQIGRFVMFPRYTHEDGHPKGFGNVEFATAEDQQKGLDSMDGEDLMGRPVRRDMAAERDATPRTRDGGSFGKPIGGPSLSVFVKGFDSSQQEDAIRSSLQDNLYKCGEITRVSVPMDYENGASKGIAYMDFTDESSFSKALELSGSDLGGCNLYVAEAKPKGQFGGVGGRSGGRDGGRSGGGRFGRSGGRDGGGRFGRSGARDGGGRFGRSGGRDPARGGGRGFQSRQSAGTASAGKKTTFGDD

SEQ ID NO: 73215 - protein, 387 aa, Bacillus thuringiensis serovar konkukian str. 97-27
MEQFINPRVKDIQISGIRQFSNMIQNYDNLISLTIGQPDFPTPSLVKEAAKRAITENYTSYTHNAGLLELRKAACNFVKDNYDLHYSPENETIVTIGASEAIDVAFRTILEPGTEVILPAPIYPGYEPIIRLCGATPIFIDVRETGFRLTAEALENAITEKTRCVVLPYPSNPTGVTLSKKELQDIADVLKDKNIFVLSDEIYSELVYEQTHTSIAHFPEMREKTIVINGLSKSHSMTGWRIGLLFAPSYLAGHILKVHQYNVTCATSIAQYAAIEALTAAKDAPKMMRHQYKKRRDYVYNRLIQMGLTVEKPTGAFYLFPYVGHLTSSSFDFALDLVKEAGLAVVPGTAFSEYGEGYLRLSYAYSIETLKEGCDRLEAFLQKKAKS

SEQ ID NO: 73216 - protein, 462 aa, Methylococcus capsulatus str. Bath
MSSRIADLLKNRRGENFDLHEKHLNTQMVRVLKTIGYDRVYVRAQGPYLYDDQDREYLDLLSGFGVFALGRNHPQVVGALKDVLDAQLPDLVQMDVSLLSGLLSEKILQRCPGDLSRMFYCNSGAEAVEAAIKFARYTTKREKIVYCEHGFHGLTLGALSLNGEQVFRDGFGPLLPACKAVPFNDLGALEAALRHNDVAAFIVEPIQGKGVNLPDEGYLAEAARLCRKHGALFVADEIQTGIGRTGKFWAIEHWGVEPDMILMAKALSGGFIPVGAVAMKKHIMEAVFNRMDRAVVHGSTFSKNNMAMAAGIATLEVLAEERLVENAAKLGEQIISGIRAMTDRYELLHAVRGKGMMIAVEFGAPKSFSLKAAWSLLETANKGLFSQMITIPLFKNHRILSQVAGHGMNVVKFLPPLVIGQRDADWILQAMDTVIADCHKVPGAIWDLGKNLTSHALKTKAG

SEQ ID NO: 73217 - protein, 468 aa, Pseudomonas syringae pv. tomato str. DC3000
MGLNDQWMQRDLKVLWHPCTQMKDHENLPLIPIKRGEGVWLEDFEGKRYLDAVSSWWVNVFGHANPRINQRIKDQVDQLEHVILAGFSHQPVIELSERLVKLTPEGLTRCFYADNGSSCIEVALKMSFHYWLNRGQPAKKRFVTLTNSYHGETMAAMSVGDVPLFTETYKALLLDTIKVPSPDCYHRPDGMGWEEHSRNMFAAMEQTLAEHHASVAAVIVEPLIQGAGGMRMYHPIYLKLLREACDRYGVHLIHDEIAVGFGRTGTMFACEQAGIRPDFLCLSKALTGGYLPLAACVTTDDVYDAFYDDYPTLRAFLHSHSYTGNPLACAAALATLDIFEQDNVIENNKALAQRMATATAHLVDHPHVAEVRQTGMAIAIEMVQDKATKTAYPWQERRGMKVFQHALERGALLRPLGSVVYFLPPYVITPEQIDFLAEVATEGIDIATRSSISVAVRENFHPDFRDPG

SEQ ID NO: 73218 - protein, 232 aa, Gibberella zeae PH-1
MAAQEKNLVELEKASKLANVPHCEQYERMISGMLYDSLIPKLTNARLAARKAMNEYNTWFPTGDDFNIETITKRRAEMLKSFLGHVADDEVFIEPPFRVDYGPNMSVGKRFYANFNLTVLDSAILTIGDRVMIGPNVMISTATHETEVSSRRANIEYAYPITIGDDCWIGGGVTILPGVTIGNGCTIGAGSIVTRDVPAWSVAVGSPARVVRKVQELGDFEEDVKQNGTTSA

SEQ ID NO: 73219 - protein, 189 aa, Thermococcus celer
MSNVKLRIENIVASVDLFTQLNLERVIEMCPHSKYNPEEFPGIICRFDEPKVALLIFSSGKLVVTGAKSVEDIERAVNKLIQMLKKIGAKFSRAPQIDIQNMVFSGDIGMEFNLDAVALSLPNCEYEPEQFPGVIYRVKEPRAVILLFSSGKIVCSGAKSEHDAWEAVRKLLRELEKYDLIGEGEEEEW

SEQ ID NO: 73220 - protein, 186 aa, Pseudomonas putida KT2440
MNIPNLLTVLRVLLIPCFILLFYMPYQWSYMAASSVFAVAAATDWLDGYLARRLQQSTPFGAFLDPVADKLMVAVALVLLVQTHANFWLTLPAAVIIGREIVVSALREWMAELGARAHVAVSNLGKWKTAAQMLALVILLGNPPVVTFWVILGYGLLLVAAGLTLWSMVHYLLAAWPHLREGSEKK

SEQ ID NO: 73221 - protein, 428 aa, Glycine max
MAGAASALFLLDIKGRVLIWRDYRGDVSALDAERFFTKLIEKQADPQAQDPVVHDNGVTYMFIQHSNVYLMIATRHNCNAASLLFFLHRIVDVFKHYFEELEEESLRDNFVVVYELLDEIMDFGYPQYTEAQILSEFIKTDAYRMEVTQRPPMAVTNAVSWRSEGINYKKNEVFLDVVESVNILVNSNGQIIRSDVVGALKMRTYLSGMPECKLGLNDRVLLEAQGRTTKGKAIDLEDIKFHQCVRLARFENDRTISFIPPDGSFDLMTYRLSTQVKPLIWVEANVEKHSKSRIEIMVKARSQFKERSTATNVEIELPVPVDATNPNVRTSMGSASYAPEKDALIWKIRSFPGGKEYMLRAEFHLPSITDEEATPERKAPIRVKFEIPYFTVSGIQVRYLKIIEKSGYQALPWVRYITMAGEYELRLI

SEQ ID NO: 73222 - protein, 1010 aa, Neurospora crassa
MAGFPPRNQQHIQPDEGYSEDPLNPQANSSCLKSRDASPCAHPSSRQASDIPPWLIQHISGLSMENKTGWPSFSPVSCFFVSVFIQIIQKRIQLTCCAYLLELAMALLNDLPTSVISQIVETQLYPRLYIDFVRYLPAEICLKILGYLDPISLINVARACRVWYELAMDRKLWQHLYYMEGFKALMDEIHAAEEKMNQTPIPTPSHLEQYRPEEDGHVHKRRAIAKASPPMLPADEDTKVLPADEPCDIDMAGSSIFGGGGGGGGCGASRSRMSEHGEVSGRARRVDKGKGRAMSPPPQQSATTRYRDSMSHRTSILPGTLQKTTLWWWDANDRRYKIDWKYLYTMRRRLEANWEHGKYTNFQLPHPNYPEEGHRECIYSIQYNPQFLVSGSRDLTIKVWDMKSRRCLRTLKGHRRSVLCLQFDSSPDEDIIVSGSSDSDVIIWRFSTGEIIEVLRHAHQESVLNVKFDKRILVTCSKDKTIKVFNRRPLRHGDLGYPFDQVGTTVNVGYDIPPSIEDAPVIPPWTMIGTLVGHSAAVNAVQIHEREIVSASGDRYIKVWDWPTQDVQRTIIGHHKGIACVQYDGRRIVSGSSDNEVKIFDCQTGLEVTTLKGHTALVRTVQAGFGDHPYSVEEDLIKAKEVDQAYYKAVEAGEIDENDNPRTRRKTNAGSSRPQDVCATGAKLPPGGGGGRFGRIVSGSYDTTIIIWRRDSEGVWRPQHHLRHEQAAEAASRRDDGPPDVPGRIPLHPSMRSGLAAASMPAPINPHTTAGSSRTASAPPGPLAGRAPETVDPAILLEYEQMVHGAVQSGPTAFRNLLQARPEIISLRHMVDRALNRQSDPNLRAQLRTAWTGAHIQNQWNHGRARSNQENAMAANAAVAAGSSNGVIGTGTATATATAAAAALAAGAAAGQPVISQASLSQVPVPVAPADAVTAAPAQQPQLPPMAGGRHHPHIPPVAPAEENAPRVFKLQYDARRIICCSQTSYIVGWDFCNGDKELEEASRFFDTVQ

SEQ ID NO: 73223 - protein, 343 aa, Aquifex aeolicus VF5
MKAVILTGFGGIENLKYVEDFPKPEPKEDEVLIRVKAVALNHLDIWVRMGALPVKPELPHILGSDVSGVVEKVGSLVKNVKEGEEVIIAPGLSCGVCWDCQSGRDNHCKDYDILGLKNKGGYAEYVAVPARNVIKKPKNLSFEEAASYPLTFLTVWNALVDKAQIKPYSRVFIWAGSSGVGVAGIQLAKAFNAFVITTAGNEEKAKKCKELGADLVFNHYKDDVVKKVREVFKEGVDVVVDHIGEATFWKSVQMLRKGGKLVFFGTTTGSKGEIDIRYVFVREIQLLGVYMGSRANLFKITELFERGVFKPVVDKVFPLKEVPQAHKYLEESKHFGKVVLKVE

SEQ ID NO: 73224 - protein, 481 aa, Vitis vinifera
MISLLRRTKLLTLTLTSNPRTLRPFLRFLSSSSKFPEYEMPSVTWGVVLGRKERLVSRVIISDYLKTLGIIPDELEQVELPSTVEVMRERVEFLQKLGVTIDHLNEYPLMLGCSVRKNMIPVLGYLEKIGIPRSKLGEFVVNYPQVLHASVVVELAPVVKFLRGLDVDKQDIGYVLMKYPELLGFKLEGTMSTSVAYLVSIGVSPRDIGPMVTQYPYFLGMRVGTVIKPIVDYLVSLGLPKKVLARMFEKRAYVLGYDLEECIKPNVDCLVSFGIRREALASVIAQFPQILGLPLKAKLSSQQYFFNLKLKIDPDGFARVIERMPQIVSLNQNVIMKPVEFLLGRGIPAVDVAKMVVKCPQLVALRVELMKNGYYFFKSEMGRQVKELVEFPEYFTYSLESRIKPRYQRLQSKGVRSSLDWFLNCSDQRFEERLQADYIEMETIGPSFCMGGKLQLPGNEVVSDEEDESDDEELYRRTVSL

SEQ ID NO: 73225 - protein, 405 aa, Hordeum vulgare
HQVLFQGFNWESWKQSGGWYNMMMGKVDDIAAAGVTHVWLPPPSHSVSNEGYMPGRLYDIDASKYGNAAELKSLIGALHGKGVQAIADIVINHRCADYKDSRGIYCIFEGGTSDGRLDWGPHMICRDDTKYSDGTANLDTGADFAAAPDIDHLNDRVQRELKEWLLWLKSDLGFDAWRLAFARGYSPEMAKVYIDGTSPSLAVAEVWDNMATGGDGKPNYDQDAHRQNLVNWVDKVGGAASAGMVFDFTTKGILNAAVEGELWRLIDPQGKAPGVMGWWPAKAVTFVDNHDTGSTQAMWPFPSDKVMQGYAYILTHPGIPCIFYDHFFNWGFKDQIAALVAIRKRNGITATSALKILMHEGDAYVAEIDGKVVVKIGSRYDVGAVIPAGFVTSAHGNDYAVWEKN

SEQ ID NO: 73226 - protein, 428 aa, Aspergillus nidulans FGSC A4
MDSPRRSDASSPAEPCSPVCVDTPATQSSVLFDGNLDDLLRNFPLRQYILVTGGLGFIGSHTTLELLKASYNVVVIDNLSNSFQSVFDRIKHLAQKHHDERGTEMPALHLAAHDYRDTAALRQLLDQYQVDSRWGTPKSKISGVIHFAAYKAVEESIKNPLKYYANNVSGLIDFASTLGKYGIKTFIFSSSATVYGTLATSGLPLKEELCAHKDEIYHDADGVAQTIRAGSTGITNPYGRTKWMCEAILADLAASDPEWTIVALRYFNPIGCDESGLLGEDPKQTPTNLLPVVVKVMTGEYNELSMFGTDWETEDGTAVRDFIHVTDLARGHIAALDAANERKLAENFRAFNLGTGRGHSVKEVVDAMESVSRKQIPVRAAPRRPGDVGSCVAVATRSQQELRWKTEKSLTDACGSLCKFLEVSGVTL

SEQ ID NO: 73227 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLCHPNVVLFMGAVTRPPNLSIISEFLPRGSLYRILHRPNCQIDEKQRIKMALDVARGMNCLHASTPTIVHRDLKSPNLLVDNNWNVKVCDFGLSRLKHNTFLSSKSTAGTPEWMAPEVLRNEPSNEKCDVYSFGVILWELATLRLPWSGMNPMQVVGAVGFQNGRLEIPKELDPLVARIIWECWQQDPNLRPSFAQLTVALKPLQRLVIPSHQDQVASPLPQEISVNSTP

SEQ ID NO: 73228 - protein, 230 aa, Mycobacterium leprae TN
MSRAALDKDPRDVVAMFDDVAHRYDLTNTVLSLGQDRYWRRATRSALRIGPGQKVLDLAAGTAVSTAELSKSGAWCVAADFSVRMLATGGARKVPKVAADATQLPFSDGVFDAVTISFGLRNIADYQAALREMARVTRPGGQLVVCEFSTPTNALVANVYTEYLMRALPQVARLVSSNPDAYIYLAESIRAWPDQVTLACQLSRTGWASPRWRNLTGGIVALHAADKPVR

SEQ ID NO: 73229 - protein, 138 aa, Exiguobacterium sibiricum 255-15
MEQTFLMVKPDGVERGLIGEIIARIERKGFVIREMKMMQVTEELAQAHYAEHAEKPFFGELVTFLTSGPVVALRVEGEDVVTVSRMMIGKTKPTEALPGTIRGDFANTMSENVIHGSDSVESAERELGLWFQGQPLNV

SEQ ID NO: 73230 - protein, 501 aa, Rhodococcus sp. RHA1
MSTNITREIAHWSDGKGFAGTSGNTAPVTNPATGAVTGQVALASVEDARAVIDAAAAAFPAWRDTSLAKRTQVIFTFRELLNARKGELAEIITAEHGKVVSDALGEVSRGQEVVEFACGIAHLLKGGMTENASTNIDVSSLRQPVGPVGIISPFNFPAMVPMWFFPIAIAAGNTVVLKPSEKDPTAAIWMAELWAEAGLPAGVFNVLQGDKTAVDELLTNPAIKAISFVGSTPIAQYVYATGTAHGKRVQALGGAKNHAIVLPDADLDLAADAMVNAGFGSAGERCMAISALVAVGDIADELVAKIKDRTDTLKIGDGTQDSDMGPLVTKVHRDKVASYIDAGEKDGATIVVDGRTVQANGGADGFWLGPTLIDHVTTDMSVYTDEIFGPVLSVIRVGSYDDALELVNSSPFGNGTAIFTNDGGAARRFQNEVEVGMVGINVPIPVPMAYYSFGGWKNSLFGDTHAHGTEGVHFFTRGKVVTTRWLDPSHGGLNLGFPQNA

SEQ ID NO: 73231 - protein, 372 aa, Vitis vinifera
MGKVSVVIYISVALLVFWLVSHSPNKSLDRSHHHASRRLKLRSSYTFTGANDHRVAFDPIVADIERRREDKEWEKLQFQNRHPEFDSAPAAESQPEWEDFMNAEDYLNDEDRFNITGRLVLLFPKIDVDPEDGFVSESELTQWNLKQSEKEVLHRTQREMELHDKNKDGLVSFSEYEAPSWVRNSDNTSFGYDMGWWKEEHFNASDADGDGLLNITEFNDFLHPADSKNPKLVQWLCKEEIRERDTDKDGKVNFNEFFHGLFDLVRNYNEEGHNSSHESSDLMEAPAKKLFSQLDKDGDGLLSEDELLPIIGKLHPSEHYYAKQQADYIISQADADKDGRLTLTEMIDNPYVFYSAIFNDDEDDYDDFHDEF

SEQ ID NO: 73232 - protein, 360 aa, Chlamydomonas reinhardtii
MMDAQHLKHLKPELAAVLNCIASVVSEISTVLRSAGSGYSGTSNAFGDNQLDVDVQVDRLIFERLASCSAVQGAGSEEQPEIKALPGQGYTVVFDPLDGSSIMGANFAVGTIFGVWPGGTPVGRQGRDQAAAAYAVYGPQTILVWARPRAEAAAQASGAEAAAGTEAHAAANGGSDAAAEAPAASTSGNGGSSGGATGSLCCSAARLADSHEVQEFLLQADGSWRLLRSGVHIQPVSRTYAPANMRAAAQNAEYAALLQKWIEEAFTLRYTGGMVPDVHHTIAKGSGVFCNPCSEKAPAKLRLLFECAPLAFVIEAAGGSSTTGQCSVLDVVVRTPNDRSKICLGSSQLVEESLPAMQAA

SEQ ID NO: 73233 - protein, 225 aa, Geobacter sulfurreducens PCA
MFARLREDIQSVLDRDPAARSTLEVLCCYPGLHAIWFHRLANLLWRSDFHFLGRLVSHVGRFLTGIEIHPGATIGRRLFIDHGMGVVIGETAEIGDDVTIYHGVTLGGVSLEKKKRHPTVESNAVIGSGAKVLGPFTVGEGAKIGSNSVVVKEVPANATVVGIPGRVVMAAEKPKDKSDFEHGKLPDPEAKAISCLFEQIRELERKYGELAAEHEALKRRLDGGN

SEQ ID NO: 73234 - protein, 498 aa, Arabidopsis thaliana
MPPRVPNLIGGSFVESQSSSFIDVINPATQEVVSKVPLTTNEEFKAAVSAAKQAFPLWRNTPITTRQRVMLKFQELIRKNMDKLAMNITTEQGKTLKDSHGDIFRGLEVVEHACGMATLQMGEYLPNVSNGVDTYSIREPLGVCAGICPFNFPAMIPLWMFPVAVTCGNTFILKPSEKDPGASVILAELAMEAGLPDGVLNIVHGTNDTVNAICDDEDIRAVSFVGSNTAGMHIYARAAAKGKRIQSNMGAKNHGLVLPDANIDATLNALLAAGFGAAGQRCMALSTVVFVGDAKSWEDKLVERAKALKVTCGSEPDADLGPVISKQAKERICRLIQSGVDDGAKLLLDGRDIVVPGYEKGNFIGPTILSGVTPDMECYKEEIFGPVLVCMQANSFDEAISIINKNKYGNGAAIFTSSGAAARKFQMDIEAGQIGINVPIPVPLPFFSFTGNKASFAGDLNFYGKAGVDFFTQIKTVTQQWKDIPTSVSLAMPTSQKQ

SEQ ID NO: 73235 - protein, 283 aa, Pseudomonas syringae pv. tomato str. DC3000
MTDNARLLSQHSFIELGARQRARALLDAGSFRELLGPFDRVMSPWLAMQGVVPQADDGVVVAKGTVDGLPVVIAAIEGSFQGGSMGEVGGAKMAGALELAAEDNRNGIPTAAIVLLETGGVRLQEANLGLAAIAEIHAAMVDLRQYQPVIGVVAGSVGCFGGMSIAAGLCSYLLVTQEARLGLNGPQVIEQEAGIEEYDSRDRPFIWSLTGGEQRFASDLVDGFAADDVADIRQQVSGWLKQGVPATHRSGQYALFLQRLASLDTEPQIDPQSVRTLYQGARP

SEQ ID NO: 73236 - protein, 201 aa, Methylococcus capsulatus str. Bath
MSVLVGKPAPDFKAAAVLGCGTIVDDYWFSKETKGKYVALVFYPLDFTFVCPSELIALDHRVDELKKRGVEVIGVSVDSQFTHNAWRNTPIDKGGIGPVKYTLVADVSHAIVKAYDVEVEGAAVAYRGTFLIDKSGIVRHQVVNDLPLGRNMDELIRMVDALQFHEEHGEVCPAGWNKGQSGMKADPEGVASYLSKNADKL

SEQ ID NO: 73237 - protein, 310 aa, Methylococcus capsulatus str. Bath
MKIANSVTDLIGNTPLVRIHRLSAGCGAEVVAKLEFFNPAHSVKDRIGAAMIDAAEQAGLIGPDTVIVEPTSGNTGIALAMVCAARGYRCVLTMPETMSKERRMLLRAYGAELVLTPGPDGMGGAIRKAEELAASDPKYFMPQQFKNAANPEIHRRTTAEEIWRDTEGRVDIVVAGVGTGGTITGVGEVLKQRKPSLRCVAVEPDASPVLSGGEKGPHPIQGIGAGFVPPILNTTIYDEVIRVKNDDAFEFARRAAREEGLLVGISSGAALWAARQLACRPENAGKLIVTIIPSFGERYLSTALFAHLED

SEQ ID NO: 73238 - protein, 595 aa, Arabidopsis thaliana
MVRVKQKNLESYRSNGTYPPTWRNPTTSFAPDQHRVSIHSSLKSKTKRRRLYKEADDNTKLRSSSSTTTTTTTMLLRISGNNLRPLRPQFLALRSSWLSTSPEQSTQPQMPPRVPNLIGGSFVESQSSSFIDVINPATQEVVSKVPLTTNEEFKAAVSAAKQAFPLWRNTPITTRQRVMLKFQELIRKNMDKLAMNITTEQGKTLKDSHGDIFRGLEVVEHACGMATLQMGEYLPNVSNGVDTYSIREPLGVCAGICPFNFPAMIPLWMFPVAVTCGNTFILKPSEKDPGASVILAELAMEAGLPDGVLNIVHGTNDTVNAICDDEDIRAVSFVGSNTAGMHIYARAAAKGKRIQSNMGAKNHGLVLPDANIDATLNALLAAGFGAAGQRCMALSTVVFVGDAKSWEDKLVERAKALKVTCGSEPDADLGPVISKQAKERICRLIQSGVDDGAKLLLDGRDIVVPGYEKGNFIGPTILSGVTPDMECYKEEIFGPVLVCMQANSFDEAISIINKNKYGNGAAIFTSSGAAARKFQMDIEAGQIGINVPIPVPLPFFSFTGNKASFAGDLNFYGKILVTTKQKKIHSPFSLLIYIL

SEQ ID NO: 73239 - protein, 382 aa, Corynebacterium glutamicum ATCC 13032
MKLVIEADGGSRGNPGVAGSGTVVYSDNKAEVLKEIAYVVGTKATNNVAEYRGLLEGLKAARELGATSVDVYMDSKLVVEQMSGRWKIKHPDMKVLAIEAKEIASEIGSVSYTWIPREKNKRADALSNVAMDAAAAGKPVGVVGDSASVSSASSVAGSEKEDLNCTETKPTNWNGATTDPTRFLLLRHGQTAMSVARLYSGRSNPELSELGEKQAAAAARRLAQTGGIDAIVSSPLTRTMQTAEAAAAALGMKVRVIDDLIETDFGLWDGKSFSEAHEQDPELHTKWLTDSSVAPPGGESLQTVNRRVKKARESLQREYGAANVLVVSHVTPIKAIMRQALDAGPSFFQKAHLDLASLSIAEFYEDGPTCVRLFNDTSHLEA

SEQ ID NO: 73240 - protein, 240 aa, Ehrlichia ruminantium str. Welgevonden
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSKSFPKNGKFIIAYEPVWAIGNNKIPSTDVIIEALEIIRSYDYVSDIIYGGAVNHTNVGDIVSINQLSGVLVGSASLDMESFFNIICSAINVGQS

SEQ ID NO: 73241 - protein, 175 aa, Triticum aestivum
MAPTVMASSATSVAPFQGLKSTAALPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 73242 - protein, 314 aa, Vitis vinifera
MLIDFVPTVGGVSLAEAPAFKKAAGGAPANVAVGISKLGGSSAFIGKVGDDEFGHMLADILKKNNVNNSGMRFDHSARTALAFVSLRADGEREFLFFRNPSADMLFHESELDLKLLEQAKIFHYGSISLIEEPCRSTHLAAMTIAKKAGSILSYDPNLRLKLWPSAEAARKGIMSVWDKADIIKVSEDEITFLTGGDDPCDDNVVLKKLFHPNLKLLVVTEGSEGCRYYTKKFRGRVAGIKVKAVDTTGAGDAFVSGILSNIASDINLYQDEKRLREALVFANVCGALTVRERGAIPALPNKEAVLKMLQNIPE

SEQ ID NO: 73243 - protein, 161 aa, Pectobacterium carotovorum
GFDNFEKLLSGAHAMDKHFASTPAEKNLPVLLALIGIWYNNFFGAETEAILPYDQYMHRFSAYFQQGNMESNGKSADRNGNPVDYQTGPIIWGEPGTNGQHAFYQLIHQGTKLVPCDFIAPAVSHNPLSDHHSKLLSNFFAQTEALAFGKSRDVVEAEFAA

SEQ ID NO: 73244 - protein, 235 aa, Exiguobacterium sibiricum 255-15
MQTQEKEKKVYEVFQSISSNYDQMNSIISFRLHKLWRKETMRRMNVFPGAKCLDLCCGTADWTIQLAKAAGPTGVIKGLDFSENMLKVGVEKVEALEMKNVELIHGNAMELPFGDHSFDFVTIGFGLRNVPDYLQVIKEMHRVLKPGGTVVCLETSQPTAPLFKEAYSLYFGKIMPQVGRLFAKSYDQYNWLQESTEVFLDRVELKQLFEQAGFMQVEVKAFAGGAAAMHLGKKW

SEQ ID NO: 73245 - protein, 322 aa, Vibrio fischeri ES114
MTKIYEDNSQTIGNTPLVRLNRVSKGNVLAKVEARNPSFSVKCRIGANMIWEAEKAGTLKEGIELVEPTSGNTGIALAFVAAARGYKLTLTMPASMSLERRKLLKALGANLVLTEAPKGMGGAIAKAEEIVASDPSKYLLLQQFNNPANPAIHEKTTGPEIWEATEGNVDVFVAGVGTGGTLTGTSRYLKHTQNKAVLSVAVEPAESPVIAQALAGEEIKPAPHKIQGIGAGFIPGNLDLTLIDRVEAVTSEDAIEMARRLMEEEGILAGISSGAAVVAANRIAELPEFANKQIVVVLPSSGERYLSTALFAGLFTEQENEQ

SEQ ID NO: 73246 - protein, 428 aa, Oryza sativa Japonica Group
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATLLRIEEELGAAAVYAGAKFRAPVEPY

SEQ ID NO: 73247 - protein, 456 aa, Gloeobacter violaceus PCC 7421
MKVGVIGTGYVGLVTGACLARVGHRVCCMDNDTAKVDRLKRGIMPIYEPGLEELVRQGVEEGLLEFTDALAAVVEHAEVLFITVGTPSRPDGSPDLSAVRAVARGIGQHLDGRYRVIVNKSTVPVGSGNWVRMLVEDGARKTVPALTDGGGAGAQAGEPDFNVVSNPEFLREGSAVWDTFHPDRIVIGAESERAEQVMRELYRHWVSPDEPEREPVPLVVTDLASAEMIKYAANAFLATKISFINEIANICERVGADVSRVAQAIGLDKRIGNQFLNAGAGWGGSCFPKDVSALVSTGQEYGYECALLKATLSVNDTQRKRIIEKLQRELRILKGRTIAIWGLAFKPHTDDIRSAPALEVANQLLNLGCRVVAHDPVVTAAQAHSQVPDLQIADSALGALDQADALVVMTEWPEYPQLDLGEVGRRLRGRVIIDGRNCLKREMVQELGLVYVGIGR

SEQ ID NO: 73248 - protein, 240 aa, Vitis vinifera
MAEIGSKKRKMGEERRKANAKKTDWPLIKPKPNLQVTHLKDSHLFTVQNFFTSAESKAFVKIAESMGFTHQGSLGPTKGEAYRDNDRTSVNDPVLAYTIWQSGLNKLFSDIKIRGKVAVGLNPNIRFYRYKVGQRFGRHIDESVDLGEGKRTHYTLLIYLSGGSKQKTKGVQSNVGDSSSEPLVGGETVFYGSRNGIVAEVAPTEGMALLHIHGDMCMLHEARNVTKGIKYVFRSDVAFA

SEQ ID NO: 73249 - protein, 324 aa, Triticum aestivum
MANAWKRDKNQKLLAPKTLIITLLVLSIIFLSSLFFFSSSSSSSYLQNTNPNPTISTKFPIPPFDCFKCPQSKPVIANVVENLKYPFLYSLADLGNLPEKPHKNIVRLLKGKPFRKPDISATIQEVLERMSADGKRDGFVVDVGANVGMASFAAAAMGFKVLAFEPVFENLQRICDGIWFNRVASLVTVFEAAASDRNGDITFHKLVGRLDNSAVSKVGARLAFKSNKEIAVQVKSIPLDELIPPSQPILLIKIDVQGWEKHVLNGAKKLLSRKPAEAPYLIYEEDERLLKASNSSSKEIRDFLKSVGYSKCVEHGTDAHCTKE

SEQ ID NO: 73250 - protein, 391 aa, Vibrio fischeri ES114
MVVHLIHAIMARSLELPAIVGTNDITKQVKNGDMLILDAVNNKIVINPSEAELTESKKIRDDLVAEKEELAKLKDLPAITLDGHQVEVCGNIGTVKDCDGIIRNGGEGVGLYRTEFLFMDRDALPTEEEQYVAYKEVAEAMHGEPVIIRTMDIGGDKDLPYMDLPEEMNPFLGWRAVRISLDRREILRDQLRGILRASAHGKLRIMFPMIISVEEIRELKKAIEEYKAELRAEGHAFDENIEIGVMVETPAAAAIAHHLAKEVSFFSIGTNDLTQYTLAVDRGNEMISHLYNPLSPAVLLVIKQVIDASHKEGKWTGMCGELAGDERASLLLLGMGLDEFSMSGISIPRVKKIVRNATFADVKKMADEALQMPTAAEIEAHVEKFIAENTK

SEQ ID NO: 73251 - protein, 142 aa, Zea mays
  misc_feature (23)..(23): Xaa can be any naturally occurring amino acid
MTCHGMQLLSEKKKKVVNFAVQXAFKPACTQKHLPGFVATLGALRAKGVDTVACVSVNDAFVMRAWKESLGIGDEVLLLSDGNGELARAMGVELDLSDKPVGLGVRSRRYALLAEDGVVKVINLEEGGAFTNSSAEDMLNAL

SEQ ID NO: 73252 - protein, 503 aa, Rhodococcus sp. RHA1
MSRCVSIPQKGQHLMSTTHSAASARGSGGAARNERSHKRFLTKLTVISTLGGLLFGYDTGVISGALLYMKDELNLSAVGEATVVSSLLFPGAAVGALLGGRLSDALGRKRTLLVCAGLFLIGALGCAMAPNVEIMVLARIVLGLGVGAAAVTCPLYLAEMAPVERRGRMVTINELMIVTGQMLAFSINALLDHLIEDPTVWRYMLAIASVPAVLLLLGMLALPDSPRWYASKGRLAETRSTLELSRSESEAAVEYASISLHAARDRNSKVSGAVHYLRDYPWMRRILWIGCGLAIVQQATGINTVNYYAPTILEQSGLGVSASLVATIAVGVTSVVMTILGIILLGFVNRRKMLLTGFIGVASSQAALSLVFLLPSSTGRSYIILAAMMVFVAFVQCFIGTCVWLLLSEIFPMAIRGFAMGIAVFVLWTTNALISFVFPILNSVLGSTGTFGLFVLVNLISVYFVYRFVPETKGRSLEELEDRLGAGRPDASAAGSTAAVAAH

SEQ ID NO: 73253 - protein, 525 aa, Klebsiella pneumoniae subsp. pneumoniae MGH 78578
MTENIHKHRILILDFGSQYTQLVARRVRELGVYCELWAWDVTEAQIREFNPSGIILSGGPESTTEENSPRAPQYVFEAGVPVFGVCYGMQTMAMQLGGHVEGSNEREFGYAQVEVVNDSALVRGIEDSLTADGKPLLDVWMSHGDKVTAIPADFVTVASTDNCPFAIMANEEKRFYGVQFHPEVTHTRQGMRMLERFVRDICQCEALWTPAKIIDDAVERIRQQVGDDKVILGLSGGVDSSVTAMLLHRAIGKNLTCVFVDNGLLRLNEAQQVMEMFGDHFGLNIVHVEGEQRFLDALAGESDPEAKRKIIGRVFVEVFDEEALKLDDVKWLAQGTIYPDVIESAASATGKAHVIKSHHNVGGLPKEMKMGLVEPLRELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEVNGISRVVYDISGKPPATIEWE

SEQ ID NO: 73254 - protein, 342 aa, Exiguobacterium sibiricum 255-15
MMKKIAVIGAGSWGTALSLVLADNGHEVILYGRDQKNVDAINQNHENTQFLPGVTLPESLRATTVLSEAVEGVSHILIVTPSSAIRSVSRQLNELLTEPVVLIHASKGIEPKTHLRLSELMEQEIDASKRSAICVLTGPSHAEEVALRKPTTVTVASTDMEEAGRVQELFTNDNFRVYLNADIIGAELGGAFKNIIALAAGMADGLGYGDNAKAALITRGMVEIARLGTLFGANPMTFTGLTGMGDLIVTCTSVHSRNWRAGNAIGRGEKLETVLENMGMVVEGVRATQAAYDLAETKQCELPITTALYHVLFDGHTPAEEVQKLMRRPQKNEIEHLFTMKD

SEQ ID NO: 73255 - protein, 396 aa, Thermosynechococcus elongatus BP-1
MQVKGITKLPLSMTKKHPPIVGIAIAPLVKMMTSKFPLAINSILGEWLPKLEMIRSKSKRTPSWGDAVIHTAPLPTTTPSHTSDHSRLKLFSGSANIALAQEIARYLGIDLGPMVRKRFADGELYVQIQESIRGCDVYLIQPCCRPVNDHLMELLIMVDACRRASARQVTAVIPYYGYARADRKTAGRESITAKLVANLITQAGASRVLAMDLHSAQIQGYFDIPVDHVYGSPVLLDYLRSKNLEDIVVVSPDVGGVARARAFANKLDDAPLAIIDKRRQAHNVAEVMNVVGDVKGKTAVLVDDMIDTAGTILEGARLLRREGAKEVYACATHAVFSPPAIERLQGGDFEEVIVTNTIPVPETQRFPQLTVLSVASILGETIWRIHEDSSVSSMFR

SEQ ID NO: 73256 - protein, 179 aa, Oryza sativa
  misc_feature (36)..(36): Xaa can be any naturally occurring amino acid
NAGIRLRERDGDCVTGNNPQYTTVYVGNLPHDVNSXMYVHRFFHSLGVGSIEEVRVTRDKGFGFVRYSTHEEAALAIQTGNGQLIGGRQIRCSGGSKPTPPGTASAPLPPPAPAPFNPGMSATDLLAYERTLALSKMAANPALMSQHAALIRAPAMGMGAGASQAIYDGGYQSANAVFY

SEQ ID NO: 73257 - protein, 290 aa, Vitis vinifera
MPAGELRHPSILPATESGEDEAWLWTQIKAEARRDAESEPALASYLYSTILSHSSLERSLSFHLGNKLCSSTLLSTLLYDLFLDTFSKDAELRSATVADLRANHMRDPACVSFSHCLLNYKGFLACQAHRVAHRLWTQMRRPLALALQSRIADVFAVDIHPAARIGKGILFDHATGVVVGETAVIGNNVSILHHVTLGGTGKAGGDRHPKIGDGVLIGAGATILGNIKIGEGAKIGAGSVVLIDVPARTTAVGNPARLVGGKEKPARHEDVPGESMDHTSFISEWSDYII

SEQ ID NO: 73258 - protein, 328 aa, Salmonella enterica subsp. enterica serovar Paratyphi A str.
MGQLIDGVWHDTWYDTKSSGGKFQRSASAFRNWLTADGAPGPSGEGGFAAEKDRYHLYVSLACPWAHRTLIFRKLKGLEPFIPVSVVNPLMLENGWTFDDTFPAATGDTLYQHEFLYQLYLHADPHYSGRVTVPVLWDKKNHTIVSNESAEIIRMFNSAFDGLGAKAGDYYPHALQSKIDELNGWIYDNVNNGVYKAGFATSQQAYDEAVEKVFTALARLEQILGQHRYLTGNQLTEADIRLWTTLVRFDPVYVTHFKCDKYRISDYLNLYGFLRDIYQIPGIAETVNMDHIRHHYFRSHKTINPTGIISVGPWQDLLEPHGRDVRFG

SEQ ID NO: 73259 - protein, 413 aa, Pseudoalteromonas tunicata D2
MSFDALGLCDELVKAVTEQGYTQPTPIQVEAIPVVLRLRDVMAVANTGTGKTAGFTLPMVQLLSGGAIAQPKSVRALVITPTRELAAQVAQNVQDYSRHTNISSAVVFGGVRIEPQIAQLATGVDVLVATPGRLVDLYNQQAINFNQLELLVLDEADRMLDLGFIDDIRHIQTLLPSERQTLMFSATFSDEIKSLAKGMLNNPQLIEVSPVNSTVDTVKQKIYPVDKTRKSEALIYLLKKHQWRQVLVFSRTKQGADSLVTQLNNAGINSASIHANRTQHARTHALNGFKSGEIKVLVATDIASRGIDVNQLPCVINLDLPYVAEDYVHRIGRTGRAGTAGLAISLFSIDESNQLQAIERLLGRTLAREVLPNFAPSEKKAVSKFDDDEYGNFEPDPEPRSGKGKSQKRKGKR

SEQ ID NO: 73260 - protein, 470 aa, Burkholderia vietnamiensis G4
MGKQAIGVIGLAVMGRNLALNIESRGYAVSVYNRSREKTDELIAEFPGRNLVPTYTLEEFVASLETPRRILMMVKAGEATDATIASLKPLLEKGDVLIDGGNTHFTDTIRRNQELAQSGLHFIGTGVSGGEEGALRGPSIMPGGQRDAYDLVEPILKQIAAKAPSDGEPCVAYMGPDGAGHYVKMVHNGIEYGDMQLIAESYAVLKDVAGLTNDELGAVYTEWNQGELDSYLIEITSKIFGKKDDETGKQLVDVILDRAAQKGTGKWTSQNALDLGVPLPLITESVFARVLSSLKTERVAASKILSGPAAAPFDGDRAAFVEAVRRALYLSKVISYAQGFAQLRTASEEYGWNLDLGTIAKIFRAGCIIRARFLQKITDAYAKDPALANLLLDPYFKDIAANYQTALRDVVVAAVKAGVPVPAFASAVAYFDSYRSERLPANLVQAQRDFFGAHTFERTDRPGSFHANWS

SEQ ID NO: 73261 - protein, 496 aa, Nicotiana tabacum
MVLSKTASESDVSIHSTFASRYVRTSLPRFKMPENSIPKEAAYQIINDELMLDGNPRLNLASFVTTWMEPECNTLMMDSINKNYVDMDEYPVTTELQNRCVNMIAHLFNAPLGDGETAVGVGTVGSSEAIMLAGLAFKRKWQNKMKAQGKPFDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGIEKSGRFNIISKEIGVPLVAFSLKDNSQHNEFEISETLRRFGWIVPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 73262 - protein, 196 aa, Yersinia pestis CO92
MQLKRVAEAKLPTPWGDFLMVGFEELATGHDHLALIFGDISGDKPVLSRVHSECLTGDALFSLRCDCGFQLEVALTRIAEEGRGVLIYHRQEGRNIGLLNKIRAYALQDLGADTVEANHQLGFAADERDFTLCSDMYKLLGIKAVRLLTNNPKKVEILTQAGINIVERVPLIVGENPKNEHYLATKAAKMGHLLTK

SEQ ID NO: 73263 - protein, 492 aa, Gluconacetobacter xylinus
MTFMTATDVTVSTPEPRNRTITPVILSGGTGTRLWPVSRASHPKQFWALASSRTMIGETLQRATGTAFAPPIVVCNNAHRFLVAEQLRENGCEDGRIILEPAVRNTAAAIAAAALLAAQDDPETLLWIMAADAVFRYPERLPAVLEKAMTVAREGYIVTFGMKPDVPETGYGYIRLGAPLHSGDADDNVYRVARFIEKPDRLRATEMLNEGGYLWNSGMFLAPASVILAELKRHEPDVLENVRHALLHSESDLTFRRLETASFMRCPNVSIDYAVMERTDRAVVIPADLGWSDVGNWNALWELGDKDAAGNVVVGDVVLEQSHNCYVRSEGMLTAVAGLTDIVLVVTSDAVLAIHRDYAQDVSALVSQLKMARRTEAEIHNRCYRPWGFYEGLIQGERFQVKRIVVYPGQKLSLQKHFHRAEHWVVVSGTAIVTRNEEKLMLQENESVYLPLGCMHRLENPGRIPLTLIEVQSGPYLGEDDIVRFEDTYGRQ

SEQ ID NO: 73264 - protein, 137 aa, Ehrlichia ruminantium str. Welgevonden
MSYSESLLEHYKNPKNVGTLPKEDYNVGTGLVGAPSCGDVMKLQIKVDDNGKIIDAKFKTFGCGAAIAASSLATELIKGKTVDEAHELKNTVLAKELSLPPVKIHCSLLAEDAVKAAINDYHMKQANKKNATKNPNE

SEQ ID NO: 73265 - protein, 121 aa, Gloeobacter violaceus PCC 7421
MQGWHCVQNCGACCYLAPEERPFLAEYLSPGLLRLYHSLVGDDGWCVHFDKSRRTCGIYQTRPAFCRVTPEVLRDLYGEDPADLSAWAVHCCREHIDSVWGAQSPERRRFEQEVGGAVPGA

SEQ ID NO: 73266 - protein, 391 aa, Sulfolobus shibatae
DLDTLEALSQPERVIQVKIQIRGSDGKLKTFMGWRSQHNSALGPYKGGVRYSPNVTQDEVIALSMIMTWKNSLLLLPYGGGKGGIRVDPKKLTLKELEDLSRKYVQLIHNYLGSDVDIPAPDINTNPQTMAWFLDEYIKITGEVDFAVFTGKPSELGGIGVRLYSTGLGVATIAREAANKFIGGIEGSRVIIQGFGNVGSFTAKFLNEMGAKIIGVSDIGGGVISDDGIDVNKALEVVQSTGSVVNYPEGKKVTNEELLTSDCDILIPAAVENVINKFNAPKVKAKLIVEGANGPLAADADEIIKQRGIVVIPDILANAGGVVGSYVEWANNKSGGIISDEEAKKLIIDRMTNAFNALYEFHKRKFADQDLRTVAMALRVDRVVGMKARAI

SEQ ID NO: 73267 - protein, 364 aa, Populus deltoides
MGSTGETQMTPTQVSDEEAHLFAMQLASASVLPMILKTAIELDLLEIMAKAGPGAFLSTSEIASHLPTKNPDAPVMLDRILRLLASYSILTCSLKDHPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDVHCLKFLKNCYDALPENGKVILVECILPVAPDTSLATKGVVHIDVIMLAHNPGGKERTEKEFEGLAKGAGFQGFEVMCCAFNTHVIELRKN

SEQ ID NO: 73268 - protein, 409 aa, Vitis vinifera
MAVTSRFLSLPPPTTPTTTKPTIFSISPTSISIPTRRRRSPVPAMAFACSTTSFIGRVGFHRREGNVSILSFGINPGPISEIPTTDSSQLLSALLPFVVAATAVAALAQPSTFTWSLTQLLFLNSIDLNYYFLLSIDDFALAFQRPLPLSIGFMAQYALKPALGVLIARALGMSQLFYAGFVLTACVAGAQLSSYASFLSKGDVALSILLTSSTTIASVLVTPLLTGLLIGSVVPVDAVAMSKSILQVVLVPVTLGLALNTYAKPVVNLLRPVMPLVAMVCTSLCIGSPLAINRSQILSAEGLRLVFPVLAFHTVAFTVGYWVSKIPIFRQEEEVCRTISLCTGMQSSTLAGLLATQFLGGSQAVPPACSVVAMAIMGLSLASFWGNGGRIRDLPSLLLPQTGSTVEAQ

SEQ ID NO: 73269 - protein, 153 aa, Oryza sativa
IDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVL

SEQ ID NO: 73270 - protein, 168 aa, Oryza sativa Indica Group
SSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQ

SEQ ID NO: 73271 - protein, 322 aa, Exiguobacterium sibiricum 255-15
MKKLLLIHTGGTIAMAQNHSGHVLPNEINPLDASLPRATDIADITTRHFSNLPSPHITPEIMLRLAHFIKEELQTGGYDGVVITHGTDTLEETAYFLQLTIGAPIPIVLTGAMRSSNEVGSDGEFNLITALRVAVSAAAQDKGVLVVFNGEIHSAFNVTKTHTSSVDTFKSVHFGNLGMVTKDHVYLFNTPLLKPTHMVTQLSKRVAVLKVYAGMEPDLLLAISELGYDGLVLEVLGQGNVPPSLVDAIQSLTEQMPVVIVSRCFNGIVQDVYGYTGGGQQLKELGVIFSNGLNSQKARLKLMIELEIGANHHALEESFRVE

SEQ ID NO: 73272 - protein, 220 aa, Rhodococcus sp. RHA1
MTNLFDPRSLGGQAPAGPQSRYILPSFIEHSSYGVKESNPYNKLFEERIIFLGVQVDDASANDVMAQLLVLESLDPDRDITMYINSPGGSFTSLMAIYDTMQYVRADITTVCLGQAASAAAVLLAAGSPGKRLALPNARVLIHQPATGGIQGQVSDLEIQAAEIERMRRLMETTLAKHTGKDAAVIRKDTDRDKILTAAEAKEYGIIDDVLEYRKLSAQK

SEQ ID NO: 73273 - protein, 195 aa, Rhodococcus sp. RHA1
MTSATAGLNLSDSVYERLLRERIIFLGTQVDDDIANKLCAQILLLSAEDPSRDISLYINSPGGSVSAGMAIFDTMQFAECDVATFGMGLAASMGQFLLSAGAKGKRYALPHARIMMHQPSAGIGGTASDIAIMAEQFAHTKREMAELIAEHTGQTVEQITADSDRDRWFTAQQALEYGFVDHVVSRAAQAGGTGQ

SEQ ID NO: 73274 - protein, 252 aa, Oryza sativa
  misc_feature (134)..(134): Xaa can be any naturally occurring amino acid
  misc_feature (146)..(146): Xaa can be any naturally occurring amino acid
  misc_feature (170)..(170): Xaa can be any naturally occurring amino acid
  misc_feature (182)..(182): Xaa can be any naturally occurring amino acid
MVLTHVEAVEEGSEAAAAVFASRYVQDPVPRYELGERSISKDAAYQIVHDELLLDSSPRLNLASFVTTWMEPECDRLILEAINKNYADMDEYPVTTELQASNRTNQTIYPRLLHILSLHCVVVDVRRRWPWRCXNRCVNIIARLFXAPVGDGEKAVGVGTVGSSEAIMLXAGLAFKRRWAEXGRKAAGEAPTTKPNIPDGGPNVARGCWGKSFAPLLFKGGNLKGRGETWNRKGLPTVNGNPRPKGPGGKLG

SEQ ID NO: 73275 - protein, 333 aa, Glycine max
  misc_feature (85)..(85): Xaa can be any naturally occurring amino acid
  misc_feature (94)..(94): Xaa can be any naturally occurring amino acid
  misc_feature (100)..(100): Xaa can be any naturally occurring amino acid
  misc_feature (169)..(169): Xaa can be any naturally occurring amino acid
TKEEPEVIVISSDDESEEKPAAKGKKEREKSARKNAKAFSSVLSARSKAACGLPRDLLGSIDATDMDNELAAAEYLDDIYKFYKXTEKKGWVGXDGGSHXFFNAKMRSILGDWLIEVHRKFELMPETLYLTLNIVDRFLSVKAVPRRELQLVGISSMLIASKYEEIWAXPEVNDFECISDNAYVSQQVLMMEKTILRKLEWYLTVPTPYHFLVRYIKASTPSDKEMENMVFFLAELGLMHYPTAILYRPSLIAAAAVFAARCTLGRSPFWTSTLKHYTGYSEEQLRDCAKIMVNLHAAAPGSKLRAVYKKFCNSDLSAVALLSPAKENCLEQA

SEQ ID NO: 73276 - protein, 96 aa, Oryza sativa Japonica Group
MAARSFQARSPKEESDAAVHEAVTLGLKNAAISGTVVAVPTLVGCRVLPWAKANLNYTAQALIISAACIAGFFITADKAILRNARQNTIGKIDRST

SEQ ID NO: 73277 - protein, 1149 aa, Staphylococcus aureus
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDAINPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPEEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 73278 - protein, 489 aa, Mycoplasma penetrans HF-2
MKLNTLKSDKGIIYQIFGPVVDVKFARNQMPNINDCLEVKLPNNKKLVLEVALLEGDDVARCISMGSTEGLYRGLEVINTKNPIMAPVGSAVLGRMFNVVGEPIDNKPMPEKVEYSPIHKKPPSFDEQSTKTEIFETGIKVIDLLVPYVKGGKIGLFGGAGVGKTVLVQELIHNIATGHGGLSIFAGVGERTREGNDLYHEMIDGGVINQTALVFGQMNEPPGARMRVALTALTMAEHFRENNKQDVLLFIDNIFRFSQAGSEVSALLGRIPSAVGYQPTLAFEMGQLQERITSTKSGSITSVQAVYVPADDLTDPAPSTTFAHLDAKTVLDRKIASLGIYPAINPLESSSRMLDPSIVGIEHYKVARSVQTILQKFEELQDIIAILGIDELSEEDKLTVSRARKIRNFLSQPFFVAEKFSHKSGKYVSTQDTISGFSEIIEGKCDDIPEQYFLYVGGIDDVHKNYVAANSNNKVNSSNKPLNSENKSN

SEQ ID NO: 73279 - protein, 143 aa, Klebsiella pneumoniae subsp. pneumoniae MGH 78578
MAIERTFSIIKPNAVAKNVIGSIFSRFEAAGFKIVGTKMLHLTVEQARGFYAEHEGRPFFDGLVEFMTSGPIVVSVLEGENAVQRHRDLLGATNPANALAGTLRADYADSFTENGTHGSDSVESAAREIAFFFAEGEVCPRTR

SEQ ID NO: 73280 - protein, 191 aa, Zea mays
EPEKPLSIEEIEVAPPQKDEVRLKILYTFFCRTDVYWWDVKGQAPLFPRILGHEGSGIVESVGEGVTNLKPGDHVLPIFTGECGECAHCKSEESNLCELLRINTDRGVMLSDGKTRFSKNGKPIYHFVGTSTFSEYTVCHIGCVAKINPAAPLDKVCVVSCGFCTGFGATVNVAKPKPNSTVAVFGLGAVG

SEQ ID NO: 73281 - protein, 452 aa, Geobacter sulfurreducens PCA
MQTFDVVVIGGGPGGMTAGMMLKQAGKSVAIIQENHDSFGGVCLNRGCMPTKSMLKAAKVYRDAQNSEKYGLDLSVNPVDLTRLRAVADADLNMLRHMVQGKLTDARIAVFRGKGSFLSEHELQICQADGSSEQIRGEKIIIATGSVPAELPCAPFDGHSILSSDQILKNTDLPHKLLIIGGGAIGCEFATLYNTFGSRVTLVEAMDSLLPREDKEAGKTLQSTFEQQGITVKTGAAIKSISVEAGTVHVHYDGSCATEEFDKVLVGIGRTANIAGLNLDAAGVATEQGAVKVNEMMQTTVPHIYALGDVIGGMTLAHAAEKEGYLLAQNLIQGTRHPLDHRAVPRVVFCHPEVAAVGTHEARAGIKAFTMPQAPNGRAVVDKVAPAFVKLFIEEDTSQIAGAIIIGEGATEMIHEMAVAVENRLTLEQIGKTVHAHPTHSKNVLLAVQHFN

SEQ ID NO: 73282 - protein, 90 aa, Vitis vinifera
MGEDSAAATASIDSSNIGFKLLKKHGWKEGTGLGVSGQGRLEPVQAYLKKNKRGLGADKVKKTAVGSYENLPSNGKTDKVKRKGRLYLKG

SEQ ID NO: 73283 - protein, 205 aa, Oryza sativa
  misc_feature (137)..(137): Xaa can be any naturally occurring amino acid
MVLSHASSGRDDAVRCTFATRYACETLPRFRMPEQPIPREAAYQIINDQLMLDGNPRLNLASFVTTWMEPECDKLIMDSVNKNYVDMDEYPVTTELQNRCVNMIAHLFNAPIKEDETAIGVGTVGSSEAILLAGLSXQQKWSHIRKDRGAMGTAIWYGAMAGWRDTAIPVQTSGFDFSAPHQRPTNGTAGHSETLTNTDGLLGYN

SEQ ID NO: 73284 - protein, 453 aa, Methylococcus capsulatus str. Bath
MSSDSNSAGPAFADLGLAQPLLRAVSEAGYVHPTPIQAQAIPLLLAGGDLLAAAQTGTGKTAGFTLPILHRLLEKQAPRRPRRPRCLILAPTRELAAQVLESVEGYGKYVPLKATVMFGGVGLNPQVRALAAGVDILVATPGRLLDHCGQNTVDLSAVEIFVLDEADRMLDMGFIRDIRRILGLLPKQRQNMLFSATFSDEIRTLADGLLNNPGYVEVARRNAASDLVDQTVHLVAQEHKRDLLTHLIRRHDWRQVLVFTRTKHGANRLAEKLAEDGIPAAAIHGNKSQSARTRALADFKDGTVPVLVATDIAARGLDIDQLPHVVNFELPNVPEDYVHRIGRTGRAGRAGSAVSLVAKEELKLLGSIERLIKRPIQRGTVEGFNPPSRPRIERRDDRSRRPQEVRDGGGRQSPPGQPKARAGLGSRSAARHAQKPQQRQAGNRLRSQGGKRG

SEQ ID NO: 73285 - protein, 95 aa, Methylococcus capsulatus str. Bath
MGSKLYVGNLNYRVGDADLERTFAAYGTVKSAQVVMDRATGRSRGFGFVEMGSDQEAQAAIAGLNGKEMDGRNLMVNEARPPERRGGSGGGGRRY

SEQ ID NO: 73286 - protein, 158 aa, Haemophilus influenzae R2846
MIRIGHGFDVHAFGEDRPLIIGGVEVPYHTGFIAHSDGDVALHALTDAILGAVALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRQ

SEQ ID NO: 73287 - protein, 369 aa, Bradyrhizobium sp. ORS278
MKTRAAVAFEAKKPLEIVEVDLEGPKAGEVLVEIKATGICHTDAYTLDGFDSEGIFPSILGHEGAGIVREIGPGVTSVKPGDHVIPLYTPECRQCKSCLSRKTNLCTAIRATQGKGLMPDGTSRFSYKGQTIYHYMGCSTFANHTVLPEIAVAKIREDAPFDKSCYIGCGVTTGVGAVVNTAKVTPGANVVIFGLGGIGLNVIQGARMAGADKIIGVDINDSKEEWGRRFGMTHFVNPKKVTGDIVQHLVALTDGGADYTFDCTGNTTVMRQALEACHRGWGESIIIGVAEAGKEIATRPFQLVTGRVWKGTAFGGARGRTDVPKIVDWYMNGKIEIDPMITHTLKLEDINKGFDLMHEGKSIRSVVVF

SEQ ID NO: 73288 - protein, 572 aa, Gloeobacter violaceus PCC 7421
MATGFHSVPEILDELRAGRAVVVVDDENRENEGDLICAAQFASPEMINFMATHARGLICLAMTAERLDQLQLPLMVSENTDRNQTAFTVSIDAGPHLGVSTGISAADRAKTIQAAIDSRTRAGDLTRPGHIFPIRAREGGVLKRAGHTEAAVDLARMAGLYPAGVICEIQNPDGSMSRLPELLQYARTFNLKIVTIAEIIAYRLQNERFIKRETVAMLPTAFGKFEIFAYRDTLDGKEHVALVRRPPAGSGLFDGAPPFAGSEEPVLVRVHSECLTGDTFGSLRCDCRQQLQAALKMIDHHGQGVVVYLRQEGRGIGLINKLKAYALQDMGLDTVEANERLGFAADLRSYGVGAQILNDLGVHRMKLITNNPRKIAGLSGYNLEVVDRVPLIIEETDYNSTYLNTKAQKLGHLLPGVRLLTLGVLWRRATMQPYDPERSNQVELLRELFGQQDLLIQEERRPVASAVFGPDAVVVHIGLPSAGNKSPNAWYTDPTSACRRAILAALEELVQNNPPQVLQFLVSSGADPLNHLSERLQHREEDLASLPDAIKGPLSPETVYIFKADATQPPTS

SEQ ID NO: 73289 - protein, 282 aa, Listeria monocytogenes EGD-e
MKIAYLGPAASFTHSAAAKAFPKEEMIAKSTIPDCIMAIEKEDVDVAVVPIENTIEGSVNITLDYLFHFSSVPVVAEIVLPIAQHLMVHPAHVSAWKSVQKVMSHPQALAQCHTFLQAELYGVEREVTPSTAYAAKWVSNNPTELVAAIAPRMAANEYGLEIVKENAQDLELNQTRFFVLSRKPVSILLPKEEEKTSISVILPNNMPGALHKVLSTFAWRDIDLSKIESRPLKTSLGEYFFLIDVLSEGKEVLVTNALDEITLLGGTANKLGTYHVHRLQTN

SEQ ID NO: 73290 - protein, 337 aa, Oryza sativa
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKASSHLKGGAKKVFISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 73291 - protein, 353 aa, Oryza sativa
  misc_feature (255)..(255): Xaa can be any naturally occurring amino acid
MLKSILREQPLFTRSFSSIKDVRAREILDSRGNPTVEVDVTTDSGVYRAAVPSGASTGIYEALELRDGDKKRYAGKGVLKAVDNVNKIIRPALIGKDPVDQRGLDTLMTQKLDGTQNEYGWPKKNLGANAILGVSLAIARAGAGAQKLPLYKHLAKIAGLGTDRFFTPVPSLNVINGGKHAGNKLAMQEFMILPTGAKTFREAMQIGCEVYHSLKKVIQGKYGLDATNVGDEGGFAPSIQDNEEGLHLLMEAIEXSGHTGKVEVGMDCAASEFYVEKEKGLRSLTSRTARNTGALKVKPAGTIRLGRKSPPQSPLFGSIEKTLSIKNDWDLNSGETSPSQNGPKSAQNWRGKN

SEQ ID NO: 73292 - protein, 110 aa, Triticum monococcum
MAGEAGRRKRAAVVVLGDIGRSPRMQYHSLSLASQAGMEVDIVANGGSDPHLSLRENPSIHIHEMKPVQLSGVSKISGALALLLKTAIQFIMLIWFLCFKIPRPDVFIVQ

SEQ ID NO: 73293 - protein, 510 aa, Vitis vinifera
MANIDIEGILKELPNDGRIPKTKIVCTLGPASRSVPMVEKLLRAGMNVARFNFSHGTHEYHQETLNNLRIAMQNTQILCAVMLDTKGPEIRTGFLKDGKPIQLKEGEEITITTDYSIKGDQEMISMSYKKLPVDLKPGNTILCADGTITLTVLSCDPAAGTVRCRCENTALLGERKNVNLPGVVVDLPTLTEKDKEDILEWGVPNKIDMIALSFVRKGSDLVHVRKVLGSHAKRIQLMSKVENQEGVINFDEILRETDSFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKERIRSTPLPMSPLESLASSAVRTANKAKAKLIVVMTRGGTTAKLVAKYRPAVPILSVIVPVLTTDSFDWIISDETPARHSLIYRGLIPLLAEGSAKATDAESTEVILDAALKSATERGLCKAGDAVVALHRIGSASVIKICLVK

SEQ ID NO: 73294 - protein, 705 aa, Bordetella bronchiseptica RB50
MTNPDFEHIKPVVSVARHRNVAVLSVDNPPVNALSDTVRAGLCSALREAEADPAVRAVVLACEGNTFVAGADIREFARAKGAAEAIDVPAVIESCRKPVVAALHGQALGGGLELALACHGRVALAGCRLGLPEITLGLIPGGGGTQRLPRLIGLEAAAELILSGATIDAETARESGLLDAVWPDRLRERAIEFAASLADSPAGVRRASTLAHPPMSPQTGQDLRKIAESRPAALRAPQAGAAAVEALSAAAQPDFARGRALERELFARLRDGEESRALRALFFAERSARRVGLDDATSAPPMAHDAAVVGAGTMGRGIAIALADAGLRVRLIDVEQASLDRALEAIRAHYRSLAARGRMTEAAARDAVARISPASDMQAAAEADVVVEAAFEDLAIKQAIFRQLDSIVRPGAVLATNTSTLDVDAIAAATRRPQDVVGTHFFSPANVMRLLEVVRGARTAPRTLGAVLALGRRMGKVCVTVGVCDGFVANRMSAHRARQIELLLQHGALPQDIDQAAREFGFSMGPCAATDLAGLDISWRIRRGKGARSPIADALCELGRFGQKVGRGYFSYAPGSRVAVPDPEVEALIRRMAEQLGIRRQSFDLATITDRLILPVINEGARVLQDGVARQASDIDLIWVHGFGWPARRGGPMFHAERVGLASVCDRLARLADALEDASLQPAPLLRDLATRGAGFASLHAARQA

SEQ ID NO: 73295 - protein, 102 aa, Glycine max
  misc_feature (91)..(91): Xaa can be any naturally occurring amino acid
MKGALDRTKVVLRHLPPSISEAALLSQIDAAFAGRYNWLSFRPGKISQKHMSFSRAYIDFKRPEDVILFGEFFCGARFVNVKGSQFRVIDXYASSQRVPNQW

SEQ ID NO: 73296 - protein, 98 aa, Physcomitrella patens subsp. patens
APLRLKECSSRGPKVVCAVGDVSAAGTNYLIAGAVAIALVGTAFPIFFSRKDLCPECDGAGFVRKTDSALNANAARKDQLQIVCKNCNGLGKVGQIDK

SEQ ID NO: 73297 - protein, 251 aa, Zea mays
PRVRPNRKRRAAAMDPAAGGAGQQRQNKASAGKKVKKGGGSGGRWPAVKPKKDLQINRLKGTHLLTIPDFFTSAEAKAFIDIAESMGFTHQGSLGPLKGEAYRDNERISVTDPLLAQAIWESGINRIFTDISVSGKVATGLNPNIRFYRYTEGQRFGRHIDESVSLGDGSKTYYTLLIYLSGKGSAKDSSGQALVGGETVFYDQRGGVVAEVAPVQGMALLHLHGAKCMLHEARAVKKNAKYVLRSDVVFS

SEQ ID NO: 73298 - protein, 272 aa, Glycine max
MAERGGGDRAGFGRGFGGRGRGGDRGRGRRRAGGRRDEEEKWVPVTKLGRLVKEGKIRSLEQIYLHSLPIKEHQIIDTLVGPTLKDEVMKIMPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKATFDCLLKTYGFLTPEFWKETRFSKSPFQEYTDLLAKPTGKALILEEERVEA

SEQ ID NO: 73299 - protein, 802 aa, Vitis vinifera
MAWKSVKKDFSTAILERKKSPNRLVVDEAVNDDNSVVSMNPATMEKLQFFRGDTVLIKGKKRKDTVCIVLVDEQCEEPKIRMNKVVRANLRVRLGDVVSVHQCPDVKYGKRVHILPIDDTIEGVTGNLFDAYLKPYFLESYRPVRKGDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKTRAHVIVIGATNRPNSIDPALRRFGRFDREIDIGVPDEVGRLEVLRIHTKNMKLSDDVDLERVAKDTHGYVGADLAALCTEAALQCIREKMDVIDLEDETIDAEVLNSMAVTNEHFQTALGSSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRLQIFKACLRKSPVSRDVDLVALARYTHGFSGADITEICQRSCKYAIRENIEKDIERERKKTENPEAMEEDDVDDVPEIKAAHFEESMKFARRSVSDADIRKYQLFAQTLQQSRGFGSEFRFPDQPNNATAASTAADPFSSAAAAGDDDDLYS

SEQ ID NO: 73300 - protein, 188 aa, Mannheimia succiniciproducens MBEL55E
MDRTLGNKMNEQLQLIKSSIKSIPNHPKEGIIFRDITSLIEVPEAFQATVDLIVGNYKNQGITKVVGTESRGFIFGAPVALALGLPFVLVRKPRKLPRETISQSYQLEYGEDTLEMHVDSVKAGDNVLIIDDLLATGGTVDATIKLIKRLGGDVKHAAFVINLPELGGEERLRSLGVEPFTLVNFEGH

SEQ ID NO: 73301 - protein, 348 aa, Nitrosomonas europaea ATCC 19718
MASYRITFRPSGRIITTESTETILEAALHHGLSLPYGCRNGSCGTCKGKIIQGIVDYGVHSEEALTEQEKNQQLALFCCARPLSDLEIECQEIEAIKDIKIRTMPCRVHKLEHVASDVMIIYLKLPANERLQFLPGQYIDILMKDGQRRSFSLANAPANDEFLQLHTRNYAGGVFSEYVFSHMKEKDILRFEGPLGSFFLHDAPKKDTPIILLAGGTGFAPVKSMLEHIFQTENTRFTHNTIRLYWGARTRDGLYLSNLAEKWAAENENFSYIPVLSEPLITDDWQGRTGLVHQAVINDMNTLSDCQVYACGAPAMVKAAFDDFTHQRNLQSENFFSDAFVPSKPATA

SEQ ID NO: 73302 - protein, 312 aa, Fulvimarina pelagi HTCC2506
MTDTKPPIAFQGEPGANSDMACRSVYGDAMIPLPCPSFDDAFAAVRNGEAKLAMIPIENTLAGRVADIHLLMPDSELQIVGEYFMPIHFQLMALPGVAREEITEVKSHIHALGQCRKYLRRNGWRPLVAGDTAGAAREVSESGNRHQAALAPILAAEYYGLDIIEKNVEDEASNVTRFVILANPANQGFADIEESRLGLWAPRDATLDAGGRNYISRNVVTTFVFRVKNIPAALYKALGGFATNGINMTKLESYQLGGTFSATLFYADVEGHPHDPALARALEELRFFTAEYRNLGVYPAAKGRESLVANGG

SEQ ID NO: 73303 - protein, 303 aa, Nitrosomonas europaea ATCC 19718
MKNKLLIVGCGDIASRAAGLLEKHYQLFGLCRRAENSGHLRALGIRPITGDLDQPASLNKIAGLAAHTILHLAPPPGHGERDMRTLHLLSALSRHSSKTQTGILPQRLIYISTSGVYGDCSGSRVSESHPTNPKNARAFRRLDAERQVRSWGIRNRIQVSILRVPGIYAHNRLPIERLQQRTPVLLSTEDSYTNHIHADDLARIIVAVLRSGRPGRIYHASDDSCLKMGEYFDLVADHFALSRPERITRQEARKVISPGLLSFMLESRRLTNDRIKRELRVRLRYPTVSDCLAEMRKIPVKSS

SEQ ID NO: 73304 - protein, 509 aa, Phaseolus vulgaris
MEAPSPTKPIDPTKPSITTLSVEGSQGEPSPLRKMFAVASIAAGIQFGWALQLSLLTPYVQLLGVPHAAASFIWLCGPISGLVVQPIVGYYSDRSTSRYGRRRPFILGGAVAVAIAVFLIGYAADIGYSAGDDITKKTRPRAVAVFVIGFWILDVANNMLQGPCRAFLADLAAGDQRKTRIANGFFSFFMAVGNVLGYAAGSFSGLHKIFPFTQTKACDVFCANLKSCFFFSILLLLFLSTVALIYVKDKPVAARAVQEDAQPSCFFQLFGALKELKRPMWMLMLVTAVNWIGWFPYFLFDTDWMGREVYGGTAGEDAYAEGVRVGSLGLMINAVVLGFMSLAVEPLDRMVGGVKRLWGIVNFILAIGFGMTVVITKMAEHQRHLNPAAVGHPSDGVKIGSMVFFAVLGVPLAITFSVPFALASIYSSASGAGQGLSLGVLNLAIVVPQMVVSALSGPWDALFGGGNLPAFMVGAAAAALSAIMAIVLLPTPKPADEAKAASMVAGGFH

SEQ ID NO: 73305 - protein, 261 aa, Saccharomyces cerevisiae
AQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 73306 - protein, 668 aa, Fulvimarina pelagi HTCC2506
MSETSGTKSAEADAAYRVLARKYRPHSFDDLIGQEPMVRTLTNAFETGRIAQAWMLTGVRGVGKTTTARILARALNYETGEIDQPTIHMAEPGIHCQAIMEGRHVDVVEMDAASHTGIDDIREIIAQVRYRPVSARYKVYIIDEVHMLSTQAFNGLLKTLEEPPEHVKFVFATTEIRKVPITVLSRCQRFDLRRVESATLIGHLKQIAEKEKVEIEDDALRLIARAAEGSVRDSLSLTDQAIAHGAGAVTAGAVRDMLGLADRVRVIDLFEYIMKGDAASALVELRDQYTVGADPAIVLGDLADFTHLVTTLRYAPEAAEDAVLSPDEAERGLAYSKTLSIRTLGQVWQMLLKALEETRNADSPRQAAEMALIRIAHAADLPSPDDLLKLLKDGGSEGLPAPKSDQGEGTSLTPAASPTNERQQAAPPTENRPGRQPPAPPTGNVSQPPQDGNASAHATASRPARTPLSLATSAAPEVVPQRVLAQQPVKPAVEIADLVALAELAKHNRDSRLEAWIRRYVRLKSIGPRRLEIGVTDEAPERLAGELTRKLHDWTGARWSVTVTSGVTGQTLEETKKEKRLALLRDAEQDPAVAAVLKAFPGARIADVRLRGEMVAEEAEAEFAAGFDQADGDLSSTELDPGLDYEGDRDDIGENDFASSEDDHSEDR

SEQ ID NO: 73307 - protein, 321 aa, Triticum aestivum
MCHYNSLCITGCPVMEEVIAGGDTADVAAEKAPYWDPPPAPLLDTSELTRWSLYRAVIAEFVATLIFLYVSLATVIGYKSQSAAQPGTGVGYLGVAWAFGATIFVLVYCTGGVSGGHINPAVTFGLFVGRKLSLVRTVLYIVAQCLGAICGAGMVKGIAGASYETLGGGANSVADGVSVGAGLGAEIAGTFVLVYTVLSATDPKRTARDSFIPVLVPLPIGFAVFIVHLATIPITGTGINPARSLGAAVMYNQHRAWKDHWIFWVGPLLGATVAALYHRFVLRGEAAKALGSLGPRGRQRRPYHQFSGCDGRTSSCISGSN

SEQ ID NO: 73308 - protein, 309 aa, Brassica napus
  misc_feature (249)..(249): Xaa can be any naturally occurring amino acid
MMSIVVGMGLAICFLYWWVNTYVPLPARSQKKKNKPKMGTIESLKFLVSSPYIRDLATLVVAYGISINLVEVTWKSKLKAQFPSPNEYSAFMGDFSTCTGIATFTMMLLSQYVFDKYGWGVAAKITPTVLLLTGVAVDPRVRFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWXAAAKSLEGQFNALRSEEELEKEMERASSVKIPVVSQEEGGNGSLGESTSSWPEKSAPTNI

SEQ ID NO: 73309 - protein, 128 aa, Klebsiella pneumoniae subsp. pneumoniae MGH 78578
MAYSEKVIDHYENPRNVGSFDNSDENVGSGMVGAPACGDVMKLQIKVNNEGIIEDARFKTYGCGSAIASSSLVTEWVKGKSLDEAQAIKNTDIADELELPPVKIHCSILAEDAIKAAIADYKSKREAK

SEQ ID NO: 73310 - protein, 134 aa, Zea mays
MAAPIPREWVGLQQFPAATQTKLHELLGKLKEENVSTLTILVMGKGGVGKSSTVNSIVGERVANVSAFQSEGLRPMMCSRTRAGFTLNIIDTPGLIEGGYINEQAVEIIKRFLLEKTIDVLLYVDRLDTYRMDT

SEQ ID NO: 73311 - protein, 267 aa, Klebsiella pneumoniae subsp. pneumoniae MGH 78578
MHPMLNIAVRAARKAGNLIAKHYETPDTVETSQKGSNDFVTNVDKAAEAIIIETIRKSYPQHTIITEESGEHAGEEQDVQWVIDPLDGTTNFVKRLPHFSVSIAVRIKGRTEVAVVYDPMRNELFTATRGQGAQLNGYRLRGSNARDLDGTIIATGFPFKAKQHATTYMNILGNMFTECADFRRTGSAALDLAYVAAGRVDGYFEIALKPWDFAAGELIAREAGAIVCDFTGGHNYMLTGNIVAGNPRVVKAMLANMREQLSDALKR

SEQ ID NO: 73312 - protein, 591 aa, Zea mays
KNRQVFAAMASKAMPQILPETPGIPGTKQCSKSAPPFELPQTNNSCASALTVLPGTTTDLSKSSHKPELNEQKPDHRLKEPVDAASVKFPVEPSKKAVAEHGSTNGGSTSFQTCGGTSQAQAKVSASAKAADPPEIGDRGNSGRCRPSTSSDISDESSCSSMSNSTKPHKANDSRWEAIQTVRTRDGVLGLSHFRLLKRLGCGDIGSVYLSELNGTKSYFAMKVMDKASLASRKKLLRAQTEKEILQCLDHPFLPTLYTHFETDKFSCLVMEFCPGGDLHALRQRQPGKHFPEQAVKFYIAEVLLALEYLHMLGIIYRDLKPENVLVREDGHIMLSDFDLSLRCAVSPMLIRSSNPDAEALRKNSHGYCAQPACVEPSCVVQPSCAAPTTCFGPRLFSSKSKKERKPRPEAATPVNPWPELIAEPSDARSMSFVGTHEYLAPEIIKGEGHGSAVDWWTFGVFLYELLFGKTPFKGSSNRATLFNVIGQQLRFPEYPAVSFSARDLIRGLLVKEPQQRLAYKRGATEIKQHPFFEGVNWALIRCASPPEVPKPVEIERPSNHPSSPSGAAADDASVGAPQKGVDGYLEFGFF

SEQ ID NO: 73313 - protein, 360 aa, Burkholderia sp. 383
MDDELNSRLKPLRDRIDAIDAQLIALLNQRAAVALEVGEVKKHFNAPVFRPERELQVIARLQDMSAGPLASEHISAIWREIMAASRALEQTIHVAFLGPVGTYSEQAMLEYFGQSIEGLPCPSIDEVFRSVEAGASAFGIAPVENSTEGAVSRTLDLLLQTQLLISGELALPIHHNLLTQSGTLDGVKRVCAHAQALAQCQQWLAANAPQLERQAVASNAEAARLAAADPTVAAIAGDRAAAHYGLQIAFSLIQDDPHNRTRFVIVGKQPAGQSGHDQTSLIVSVKNEPGAVFKLLEPLARHGVSMTRFESRPARVGTWEYYFYIDIEGHRDDASVAAALAELGQKAAFLKILGSYPRAR

SEQ ID NO: 73314 - protein, 256 aa, Candida albicans SC5314
MDDKGWRFPTKEELKTLKTEDDISLGTPDHNYDFSRLRELYFKAEPEYEGRFTVPVLWDKKEGTIVNNESAEIIRMLNTEFNSILPSEYAEVDLVPKDLESQIDELNSWIYDNINNGVYKAGFASKQEVYAKECQNVFDHLDKVEAILEKNHNGSKKGEFLLGNQLTEADIRLYTTIIRFDPVYVQHFKCNIGTIRTHYPYIHNWLRLLYWKIPGFQETTNFEHIKYHYTKSHIKINPYGITPLGPVPNILPLEEK

SEQ ID NO: 73315 - protein, 330 aa, Pyrococcus abyssi GE5
MHPKVDALLSRFPRITLIPWETPIQYLPRISRELGVDVYVKRDDLTGLGIGGNKIRKLEFLLGDALSRGCDTVITIGAVHSNHAFVTALAAKKLGLGAVLILRGEEVLKGNYLLDKLMGIETRIYEADNSWELMKVAEEVAEELKGEGKKPYIIPPGGASPVGTLGYIRGVGELYTQVKKLGLRIDTVVDAVGSGGTYAGLLLGSAIVNAEWSVVGIDVSSATEKAKERVKNLVEKTKELLGINVKVQEPRIYDYGFGAYGKIVKEVAKLIKSVGTMEGLLLDPVYTGKAFYGLMDLAKKGDLGESVLFIHTGGLPGIFHYGEEMLELLV

SEQ ID NO: 73316 - protein, 440 aa, Bordetella bronchiseptica RB50
MKITVVGTGYVGLVSGACLADMGNEVLCLDTDAAKVAMLREGHIPIYEPGLEDLVKRNVAGGRLQFTDDIAASVAFGDVQFIAVGTPPGEDGSADLQYVLAAARSIARHMTTRKVVVDKSTVPVGTADKVRAAMQEVLAERGVEVPFSVASNPEFLKEGAAINDFMSPDRIIVGADDEHTIDTMRRIYAPFQRTHERVMVMDVRSAELTKYAANAMLATRISFMNEMANLAEALGADIEQVRRGIGADPRIGYHFLYPGIGYGGSCFPKDVQALMRSAGEHALPMRVIEAAETANQAQKLRLAHKVVARYGADLQGRTFALWGLAFKPNTDDMREAPSLSTIADLTRRGARIRAYDPVAMPQAAKVLDDNPAVELVDDMYQALDGADGLLIATEWKVFRAPDLTRVKQMLKAPLIIDGRNLYVPADMRAQGFDYQGIGRA

SEQ ID NO: 73317 - protein, 179 aa, Physcomitrella patens subsp. patens
SSSSSSSSRSGAGQVVATISVGDKLPEAQLSYFDKDGNVQSVSVSELTKGKKVVLFAVPGAFTPTCSSKHLPGFVAKADELRKAGVDTLACVSVNDAFVMQAWGKSAGVGDSVLMLSDGLAKFTQALGTAVDLTDKVEGLGIRSRRYSMLVEDGVVKVLNLEVGGAFTNSSAEEILSSL

SEQ ID NO: 73318 - protein, 510 aa, Ehrlichia ruminantium str. Welgevonden
MRFIGLQNLKDKKLNSYNGGGLSKIEQQHLKGKLTARERLRVLLDDNSFEEYGVFVEHRSVNFSMDQSKILGDGVVVGYGTINGRRVCVYSQDFTVFGGSLSESNAKKICNIMDKASVLGVPIIAINDSGGARIQEGVDSLSGYGEIFQRNVDLSGVVPQISLIMGPCAGGAVYSPALTDFIFMVRNTSYMFVTGPDVIKKVTYEQVSKEELGGATVHAAKTGIADLVFNNEIEALLQIRKFMQFIPSNNIMKPLKLDTNLDTFTEDISLNTLVPKNSSTPYNMYELIEKVCDERLFYEIKPDFARNIIIGFGKIGGCNVGIIANQPLQLAGCLDIDASRKGARFIRFCDAFNIPIISFIDVPGFMPGVNQEHSGIIVHGAKLLYAYAEATVPKISVIVRKAYGGAYIVMNSKHLCGDINYAWPDAEIAVMGAEGAVEIIFRNEADEEKRQYIIDEYRSKIVNPYVAASRGYIDDIIIPSHTRKHLFKSLQLLQEKKVQKISRKHDNLPL

SEQ ID NO: 73319 - protein, 327 aa, Mannheimia succiniciproducens MBEL55E
MCYFKCLFKIKELFNMQTFLKFTNFMSKTFALWVLVFAFLAFQFPAQFAIFAPYIPYLLGLVMFGMGITLTFNDFGEVFKHPKSVFIGVAGQFVIMPAIAFCLAKIFNLPADLAVGVILVGSCPGGTSSNVMTYLSRGNTALSVACTTISTLLAPFLTPAIFYILASQWLDINAGAMFMSVLKMVLFPIFLGLIVRAIFKKSISEISRTMPLVSVISIVLILSAVVAVSKDKIVESGLLIFGVVVLHNCLGYLVGFFGARLFKLNIADSKAVSIEVGMQNSGLGAALAAAHFNPIAAVPSAVFSFWHNVSGPILANIFANIKNDDKK

SEQ ID NO: 73320 - protein, 430 aa, Magnaporthe grisea 70-15
MTSLNEWSHGSSSTFRKPLSFPADKLGFGFRLHHSLQDQTLLRLPYDLMRKNFRNAHFVVEHESKAITKLLKDTATGSLKGKHSSDDVLKNIDAMLAKAKGIKRKLQACSDEEARLYRQLGARIKHVGEVVSMETVDDVRYEQWSRTRLDRLIVDYMLRHGYNESACALADDRGIRDLVDIDTFIHMSRIQESLANRSVTEALAWCHENKKELRKIDSNFEFMLRFQQYIELVRSQTLPKVLEAITHARKYLIPFKETYPHEVNQAAGLLAYPPEQTSDSYSNLWGQERWEMLSTLFIETHHRLLSLPSFPLLHIALSSGLSALKTPACHTAGARDLADTPNSAPGNSLDSSMCPICSAELNELAENVPYAHHSKSHVEHDLVLLPNDRVYGKARLEEYARKSGLPHNCVKDLRTGEIYPASRMKKVFIT

SEQ ID NO: 73321 - protein, 305 aa, Ehrlichia ruminantium str. Welgevonden
MSIEQFGGNVEWFNITKTLSESLPYIQQFSGETFIIKYGGAAMTDKKLAESFAHDVVLLKQLGINPIVVHGGGNKINEFLEKINKKSTFINGLRITDAETLEIVEMVLCGLVNKNITQLINNAGGNAIGLCGKDANLIEAKKICYTYKENQSNNVEKILDMGFVGEPHDINTDLLFFMEESDFIPVIAPVCSGENNLTYNVNADLVAGALANAMAAAKLIILTNVSGVTDSNGNLISELSVSHAENLIDNGTAHTGMIPKLQTCVRVVKEGYGSAHIIDGRIPHVLLLELFTIHGTGTMVVNSGV

SEQ ID NO: 73322 - protein, 200 aa, Ehrlichia ruminantium str. Welgevonden
MKLKSIMSQCQFIIGATSIKSLPDFSIPEVALAGRSNVGKSSLINAITNNRKNARISSKPGCTRQINFYLINKGLMVLVDLPGYGYSKADRATVNSYICLMEYYLLNRKNLSKVVLLIDAKVGFKEIDLDFIRWLEVHQILYQLVLTKIDRVQSNVLDVIVSDIQNFNLNFIIYPIINVSSKCKQGIEELIYEIAQCIKK

SEQ ID NO: 73323 - protein, 235 aa, Suaeda maritima
MAEERSVKLYGTWSSPYVLRVKLALKIKGIEYDYFEEDLANKSELLLQYNPVYKRVPVLVHNGLPISESSVILEYIDETWTDPPHLLPKDPYLRAKHRFWAAYLQQVAEMFGTSLVLKSQGKDIEDVVNEYWNKMDVAEELIRETFPYNEIPCFKDTIKPGYLDIILYSLVGTSDASEELFGFKPFIPERYPLLASWTKALSEVPEVKEVTPPKDKLIELLRTIRQMYLPSAPKA

SEQ ID NO: 73324 - protein, 295 aa, Flavobacterium sp. ATCC 21588
MTPKQQFPLRDLVEIRLAQISGQFGVVSAPLGAAMSDAALSPGKRFRAVLMLMVAESSGGVCDAMVDAACAVEMVHAASLIFDDMPCMDDARTRRGQPATHVAHGEGRAVLAGIALITEAMRILGEARGATPDQRARLVASMSRAMGPVGLCAGQDLDLHAPKDAAGIEREQDLKTGVLFVAGLEMLSIIKGLDKAETEQLMAFGRQLGRVFQSYDDLLDVIGDKASTGKDTARDTAAPGPKGGLMAVGQMGDVAQHYRASRAQLDELMRTRLFRGGQIADLLARVLPHDIRRSA

SEQ ID NO: 73325 - protein, 435 aa, Listeria monocytogenes EGD-e
MFILTMGLNHHTAPIDIREKLVFKETEEEMALVTLQQEKSILENVIISTCNRTEIVAVVDQIHTGRYYLKRFMANWFQMDMEKIEPYLFFHEETEAVNHLYKVTAGLDSLVLGETQILGQVKHAFEIAKQTETTGTLLNKLFREVVTFAKKVHHHTKINENAVSVSYAAVEVAKKLYGSLDNKKIVLVGAGEMSELALQNLAGSGIADITIINRTKSNAELLANQFQAKVGAYENMNEHLMLADIVLVSTSATEPIIKQAAMQDLMEQKASSMLVIDIGLPRNVEHDCSYIPNFHLYDIDDLAGVVSANSLERQRIVLELENTIEVEVRNFFEWEKQLGVVPVIRALREKALDMQEVAMTSLENKLPGLTEREYIQIGKHMKSIINQMLKQPISELKEMSVEEDATTSIEHFKRIFGLSETDVTVIEKEQAETRS

SEQ ID NO: 73326 - protein, 194 aa, Listeria monocytogenes EGD-e
MDVNNVELIISAVRPEQYPETDLPEYALAGRSNVGKSSFINTMIRRKSMARISQKPGKTQTLNFYKIEEALFFVDVPGYGFAKVSKTEREKWGVMIETYITSREQLRGVIQIVDLRHKPTEDDRMMYEFLKYYDIPVIVIATKADKIPRSKWQKNAKIVRETLDFDPDDKFVLFSSETKMGKDEAWQFIKEGME

SEQ ID NO: 73327 - protein, 356 aa, Arabidopsis thaliana
MSARYWCHMCSQMVNPVIGAEIKCPFCQSGFVEEMSREINGGSSSSLREVQDPEIDFGTDRALSLWGPILLGMMSNPRRRRRFRRTEFGVDNDEVNVSDDVDGNDSVDIDRHHHRRHRHRQQGREIDLDREFESILRRRRRSSATILQLLQGIRAGIASEYESSDRDLLNQSAVVQGSTSLNQNRNNTSLSAIGDYFVGSSLDHLLEHLADNDSIRHGSLPARKEVVDNLPTVKISESLQCSICLDDFDKGSEAKEMPCKHKFHIRCIVPWLELHSSCPVCRYELPPDDETKVNPVRPRTRTLEINVSNENVEDDARNSNVSERRFSFPWPFSGLFSSSSSSSASASGSSHLGENS

SEQ ID NO: 73328 - protein, 64 aa, Glycine max
TICAEFELDKQVDAFTESVFKGNPAAVCFLEEKRDKKWLQGVAAEFNLSVTCYLTRITESHGTT

SEQ ID NO: 73329 - protein, 79 aa, Zea mays
MAAAGGGAGGKVSFKIILTSDPKLLFKVFSVPEAAPFTAVLKYAAEEFKVPAPRTSGHHPPNDGNWASPPSQSARQTFS

SEQ ID NO: 73330 - protein, 303 aa, Pantoea agglomerans pv. milletiae
MMTVCAEQHVNFIHSDAASLLNDIEQRLDQLLPVESERDLVGAAMRDGALAPGKRIRPLLLLLAARDLGCNATPAGLLDLACAVEMVHAASLILDDMPCMDDAQLRRGRPTIHCQYGEHVAILAAVALLSKAFGVVAAAEGLTATARADAVAELSHAVGMQGLVQGQFKDLSEGDKPRSADAILMTNHYKTSTLFCASMQMASIVAEASGEAREQLHRFSLNLGQAFQLLDDLTDGMADTGKDAHQDDGKSTLVNLLGPQAVETRLRDHLRCASEHLLSACQDGYATHHFVQAWFEKKLAAVS

SEQ ID NO: 73331 - protein, 253 aa, Oryza sativa Japonica Group
MADRVHPMPAPPPPSSSPPLEHAAAATETTPLHPSFRGARPPSPGTYIIQIPKDQVLRVPPPDRARRYKKLAARPARRRRLRHACCAAFCAALLLLLLAAAFVGAVYLVFRPRAPSFSVASLSIRGLDALAVSSLTPQIDAAVRADNGANKKTGIDYRGGGEGFVLFVLFLFFRGSLAYIFTESKAVADEVADLAPLLAFSILLNSVQPVLSGVAIGSGWQSVVAYVNVTSYYFIGIPLGAILGYVLGFQAKM

SEQ ID NO: 73332 - protein, 220 aa, Brassica oleracea var. alboglabra
GGAGGGFGGGAGGGHAGGGAGGGHGGGAGGGFGGGAGGGHGGGAGGGFGGGAGGGKGGGLGGGGGVGGGHGGGVGGGFGGGAGGGKGGGVGGGFGGGAGGGKGGGLGGGHGGGVGGGFGGGAGGGKGGGVGGGHGGGAGGGFGGGAGGGHGGGAGGGFGGGAGGGHGGGAGGGFGGGAGGGHGGGAGGGFGGGAGGGHAGGGGAGGGFGGGAGGGGGGGF

SEQ ID NO: 73333 - protein, 466 aa, Burkholderia sp. 383
MKITIIGTGYVGLVTGACLAEIGHDVFCLDVDPRKIDILNNGGMPIHEPGLLDIIARNRAAGRLRFSTDIESSVAHGEIQFIAVGTPPDEDGSADLQYVLEAARNIGRHMTGFKVIVDKSTVPVGTAQRVRGVVDEALAARGLAGSVAHRFSVVSNPEFLKEGAAVEDFMRPDRIIIGVDDDETGTIAREKMKKLYAPFNRNHERTIYMDVRSAEFAKYAANAMLATRISFMNEMSNLADKVGADIEAVRRGIGSDPRIGYHFLYAGVGYGGSCFPKDVQALIRTAGENGQPLRILEAVEAANHAQKDVLIGKIEQRFGADLTGREFAVWGLAFKPNTDDMREAPSRRLIAALLERGATVRAYDPVAVDEAQRVFALDFGTDPDTLARLHLVETQDIAVTGADALVIVTEWKEFRSPDFTRLKAELKAPVIFDGRNLYEPDAMAELGIDYYAIGRPYVDPQSSTRG

SEQ ID NO: 73334 - protein, 455 aa, Mycobacterium tuberculosis CDC1551
MSTTQLINPATEEVLASVDHADANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 73335 - protein, 285 aa, Mycobacterium tuberculosis CDC1551
MPSRTALSPGVLSPTRPVPNWIARPEYVGKPAAQEGSEPWVQTPEVIEKMRVAGRIAAGALAEAGKAVAPGVTTDELDRIAHEYLVDNGAYPSTLGYKGFPKSCCTSLNEVICHGIPDSTVITDGDIVNIDVTAYIGGVHGDTNATFPAGDVADEHRLLVDRTREATMRAINTVKPGRALSVIGRVIESYANRFGYNVVRDFTGHGIGTTFHNGLVVLHYDQPAVETIMQPGMTFTIEPMINLGALDYEIWDDGWTVVTKDRKWTAQFEHTLLVTDTGVEILTCL

SEQ ID NO: 73336 - protein, 549 aa, Methylococcus capsulatus str. Bath
MGTVEPGAIGQHLLACLYQAGVGHIFGVPGDYVLGFYDLMAKGPVRHIGTTREDTAAFAADGYARCRGMGALAVTYGVGALNTVNAVAGAYAESSPVVVISGAPGVREQREDPLIHHRFGPFRFQREIFERITCAAVVLDDPVIAFRQVERALAAARQHCKPVYIEIPADRVMAPGYPIPQETPETPSSDDSALAEAVAEAAELLGRAVSPVILAGVELHRRGLQDALVGLVEQARLPVAATLTGKSVFAERHPAYLGVYEGAMSTENARYMVEQSDLLLMLGVTLNDVDTGIYTARLDPQRIVRAAQNEVVIRHHRYPRVLLADFVTALARSVKARGEAFPMPAGPEPWDFPAPDRPMTIARLVERLDRALTSDMIVVCDVGDCLFAATDLRVHERSEFLASAFYTSMGFAVPAALGAQIARPDHRALILVGDGAFQMTGTELSTHARLGLAPIVVVLDNRGYSTERFILDGAFNDIADWRFHRLGEVFGPLQGYDAPDEAAFENALSEALVNRNMPSLINVRLSPGDASIAMKRLAGHLQCRVKGEG

SEQ ID NO: 73337 - protein, 335 aa, Debaryomyces hansenii CBS767
MLAPSLSWAEAKQFLSIFWPPKPTFIPAEYPDLAGKVVIVTGGNTGVGYQTAKLMSGVCNAKVYILSRNEAKTKLAIDNIQMEIKREQNKDVNLRFIKLDLSDLPTIKQTANDFLKEEDRLDIIIHNAGVMTPPMGSKTAQDYDLQWGTNVLGPFLLQKLLDPLFIETSKKNPTNLSRVVWASSTAHLSAPDKGGIYWDDVNFEDPSKKYSNGEIYGQSKAGVIINAIQWSKRYSNENIVSISLCPGGLKTDLQRHLPGFVRSVLNLLLYDAVFGAYTEMFAAVSPEVTSENNNHRMILSFGRFGIIRKDIEEGANGENGEKYWNYAEKQVSKYL

SEQ ID NO: 73338 - protein, 275 aa, Zea mays
  misc_feature (164)..(164): Xaa can be any naturally occurring amino acid
MAERGGERGGERGGFGRGFGRGGRGDRGGRRGGRRGPRQEEEKWVPVTKLGRLVKENRITKIEEIYLHSLPVKEHQIIETLVPGLKDEVMKITPVQKQTRAGQRTRFKAFVVVGDCDGHVGLGVKCAKEVATAIRGAIILAKLSVVPVRRGYWGNKIGQPHTVXPCKVTGKCGSVTVRMVPAPRGSGIVAARVPKKVLQFAGIEDVFTSSRGSTKTLGNFVKATFDCLMKTYGFLTPEFWSQTKFSMTPFQQYTDLLAKPTKGLVLEAPTETVEA

SEQ ID NO: 73339 - protein, 433 aa, Listeria monocytogenes str. 4b H7858
MNWSPKTEAWQELKNTVPYIQKGKIHTVQEQVYISKGPQVKIGDTVMVGENKVLCEVISIEKENNMLLPFNQSDKVAYGDWVYVTDTKITIPADEYLLGKVLNASGDILNEEAGVAKFKQKMPLEAPPIHAFSRAEITDTLETGIKAIDGMLTIGIGQKIGIFAGSGVGKSTLLGMIARNAKADINVIGLVGERGREVKDFLRKDLGEDGLRKSVIVAATSDESHLMQLRAAKLATSIAEHFRDQGKTVLLMMDSVTRFADARRSVDIAVKDLPIGGKTLLMESYMKKLLERSGKTQNGSITGIYTVLVDGDDMNGPVPDLARGILDGHIVLTRELATKNHYPAIDVLGSVSRVMEEIVPESQWKTASKIREWMSIYQENELYFKLGTIEQTSDNAAIFTSKEKSYFIHQFLKQLRDESVTLEETSKLMETLV

SEQ ID NO: 73340 - protein, 382 aa, Corynebacterium glutamicum ATCC 13032
MARDYYGILGVDRNATESEIKKAYRKLARKYHPDVNPGEEAAEKFREASVAHEVLTDPDKRRIVDMGGDPMEQGGGAGAGGFGGGFGGSGGLGDIFDAFFGGGAGGSRGPRSRVQPGSDTLWRTSITLEEAYKGAKKDLTLDTAVLCTKCHGSGSASDKKPVTCGTCNGAGEIQEVQRSFLGNVMTSRPCHTCDGTGEIIPDPCTECAGDGRVRARRDIVANIPAGIQSGMRIRMAGQGEVGAGGGPAGDLYIEVMVRPHAIFTRDGDDLHASIKVPMFDAALGTELDVESLTGEEVKITIPAGTQPNDVITLDGEGMPKLRAEGHGNLMAHVDLFVPTDLDDRTRELLEEIRNHRSDNASVHREGGEESGFFDKLRNKFRK

SEQ ID NO: 73341 - protein, 265 aa, Nitrosomonas europaea ATCC 19718
MKTKILASLASIIFTGYVSIAASAPPHWSYDEEPIWGAIEDAALPVPLRYPYAECGIGQHQSPVDLADAKIVSAKPLNKLSAQYKTDTPTFFNTGHAIQVNTSKNFAGGLKVGKELLPLIQLHFHEPSEHVFGGKKFPAELHFVHINKDGRIAVLGVVINIGKENAVFQTILDNMPRHEGEANSPSRVRFNPAKLLPSGVNAANLKYLTLAGSLTTPPCSEGVQWYILTKSITISADQLEQMKSFYHDNARSAQSLNERSILSNQ

SEQ ID NO: 73342 - protein, 546 aa, Methylococcus capsulatus str. Bath
MSGPKFSDITLPPDLTGHGKGTGPVRRRRPIYVDLLPPCNSACPAGENIQAWLAEAQAGRYRRAWQILMRDNPMPAVHGRVCYHPCESHCNRNEVDEAVSIHAVERFLGDLALREGWEAETEAPPSGRRVLVIGAGPSGLSAAYHLVRLGHEVEIHEAGPLAGGMMHFGIPAYRLPRRELEQEIQRIQRMGVKIRLNHRVDDVLEEQTNGRFDAVFLAIGAQLSKRVEIPSRDAGKILDAVSFLRQSASGDPPKLGRRVAIYGGGNTAMDAARTAKRLGAEEALIIYRRDREHMPAHPFEADEALEEGVKINWLRSIKQIDQTHIQVEVMRIDEHGYPQPTGEFETLEADALILALGQDTDTAFLHRIPGIRFKEDGTVLVDANLMTGKAGIFAGGDMVPSERTVTVAVGHGKKAARHIDAYLRGTTYAPPPKHPIVGFDQLHVWYLTEADQREQPVLDPVVRAYGFDEVVQGLSEPEALFEARRCFSCGNCFECDGCYGACPEQAIVKLGPGKRYRYDYDRCTGCAVCHEQCPAHAIEMISEPGA

SEQ ID NO: 73343 - protein, 557 aa, Arabidopsis thaliana
  misc_feature (92)..(92): Xaa can be any naturally occurring amino acid
  misc_feature (516)..(516): Xaa can be any naturally occurring amino acid
SLVPPPPLFAFPQSQDNHKTLTPKLSILPSFDRILQWASVSAIGVLKVPPASTSNSTGKATEAVPTRTLSFSSSVTSSDDKISLKSTLSPCXNRLSQENDNCLSPRAVLKSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEQRATAFGLMKIDEEGRIIEFAEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDXMSRSINSDNVQEAARETDGYFIKSGIVTVIKDALIPTGTVI

SEQ ID NO: 73344 - protein, 504 aa, Ehrlichia ruminantium str. Welgevonden
MSSLTGKVKGRARKIKGDADIRINESTENVGLVIRVMTAVVDIKFPSGKVPKILNALESKEIYNGKKLVLEVSQHISDSIVRCIALDSTDGLSRNDEFIDTGAPISVPVGRATLGRVFDVLGNPIDNCGPLTKSDYSIKPIYSEVPKLTDQKVTTEILVTGIKVIDLLAPYLKGGKVGLFGGAGVGKTVLIMELIHNIAKAHKGVSVFAGVGERTREGNDLYHEMIESGVINLEEKDKSQAVLVYGQMNEPPGARLRVALSALTMAEYFRDVENQDVLFFVDNIFRFTQSGSEISALLGRIPSAVGYQPTLAAEMGAMQERITSTNRGSITSVQAIYVPADDLTDPAPATSFAHLDSTTVLSRQIAELGIYPAVDPLDSASQALSIDIVGEKHYEVSKEVQRILQTYKSLQDIIAILGMEELSEEDKLIVARARKIQRFLSQPFHVAEVFTGTPGVFVSLEDTVSSFKDIVEGKYDHLPEAAFYMVSNINEAVKKAELLQKEGK

SEQ ID NO: 73345 - protein, 215 aa, Marsilea vestita
SQRKKRQVSQDLATPESVEKYTQLSSHPLHKTNKPGILSVDVYQSEDLILTGGVDSTAVVFNRSSGEIVSTLNGHSKRVNSVKFVPENGYVLTGSADKTVKIWQQKDGMYECKHTLREHTEEVRAVTVHATQNFFVTASTDKSWCFYDLAYGECLVQVTEPSLQEGYTSASFHPDGLILGMGTAESLVRIWDVKSQANVAQFEGHSGPVTGLSFS

SEQ ID NO: 73346 - protein, 201 aa, Shewanella sp. MR-4
MSVLVGRPAPDFTAAAVLGSGEIVDSFNLTAAIKGKPAVVFFYPLDFTFVCPSELIAFDHRMEEFTKRGVEVIGVSIDSQFTHNAWRNTPVEKGGIGQVKYTLVADVKHDICKAYDVEHPEAGVAFRGSFLIDKEGMVRHQVVNDLPLGRNVDEMLRMIDALQFHEEHGDVCPAGWEKGDKGMNASTEGVAAYLAENASSL

SEQ ID NO: 73347 - protein, 130 aa, Arabidopsis thaliana
  misc_feature (96)..(96): Xaa can be any naturally occurring amino acid
  misc_feature (120)..(120): Xaa can be any naturally occurring amino acid
MGSCMLSSATMVASPTQVTMAAPFSGLKTSAAFPASRKANNDITSITSNGGRVNCMQVWTPIGKKKFETLSYLPDLNDSELAKEVDYLIRNKWIPXVEFELEHGFVYREHVNSPGYYDGXRYWNMWKACL

SEQ ID NO: 73348 - protein, 290 aa, Nocardia brasiliensis
MRGIILAGGTGSRLHPITRGVSKQLVPVYDKPMVYYPLSTLMLAGIRDILVITTPEDADSFRRLLGDGARFGLALSYVVQPEPDGLAQAFVLGADHIGTGSAALVLGDNIFHGPGLGTRLRRFHDIDGGAVFAYWVSDPSAYGVIEFADGKAVSIEEKPKLPRSNYAIPGLYFYDNDVVEIARGLRPSARGEYEITDINRAYLEQGRLQVNALERGTAWLDTGTFDSLLDAANYVRTIEERQGLKIGVPEEVAWRMGFIDDEQLSRLAEPLVRSGYGRYLLGLLERGRDW

SEQ ID NO: 73349 - protein, 445 aa, Zea mays
  misc_feature (210)..(210): Xaa can be any naturally occurring amino acid
  misc_feature (388)..(388): Xaa can be any naturally occurring amino acid
  misc_feature (398)..(398): Xaa can be any naturally occurring amino acid
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAGSGRSVQKNRRKKPACTLSTVLSARSKAACGLTEKPKEPIEDIDKFDGDNQLALVDYVEDIYTFYKTAQHESRPIDYMGQXPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTXPQRAADHGRXAKTLVGSHAASASPDARLKAVYQKYATEQFGRVALHPPAPTALPDLV

SEQ ID NO: 73350 - protein, 103 aa, Brassica napus
MRARLVVFPIKGRKWCFSRSVDPFASQTPSGVTPTTVRGLWKKLSSESKPINANAELLVDFISDKMNKAWTGLEKAPEGSMKNKIHGLGLKLLARVKPSEKNS

SEQ ID NO: 73351 - protein, 300 aa, Burkholderia sp. 383
MAYKTIEDTIGNTPLVQLVRLPDDEIRARNNVVLAKLEGNNPAGSVKDRPALSMISKAEARGRIKPGDTLIEATSGNTGIALAMAAAIRGYKMVLIMPEDLSVERRQSMAAYGAEIILTPVKGGMELARDLADQMQREGKGVILDQFANPDNPIAHYEATGPEIWRDTEGRITHFVSAMGTTGTIMGTSHYLKEQNPAIEIVGAQPEDGSRIPGIRKWPEAYMPTIFDRSRVDRVENVSQAAAETMARRLASVEGIFAGISSGGACEVAMRIARQVENATIVFIVCDRGDRYLSTGVFPA

SEQ ID NO: 73352 - protein, 139 aa, Glycine max
MQAVIRSFVSGGNVVRSSLLQHLRVVNPAIQPSVLSTRSESTQPARMEEHGFESTTISDVMNAKGKSADGSWLWCTTDDSVYDAVKSMTQHNVGALVVVKPGEQQSLAGIITERDYLRKIIVQGRSSKSTKVGDIMTEE

SEQ ID NO: 73353 - protein, 617 aa, Pseudoalteromonas tunicata D2
MLEMAVIYLAAAIVAVPIAKRLGLGSVLGYLLAGILIGPYILALVGDQTDVMHFAEFGVVLMLFLVGLELQPSRLWKLKKTIIGLGGLQVILTTLLVWAVAYYVFALVWQTALALGLMMAMSSTAIVLQTLTEKGWIKQEAGQNAFSVLLFQDIAVIPILALLPLLALTEPDAHSQGHTSLIAHLAVYQQVLIATGAIVGIIAAGKYIASPLFRYIAQTRLRELFTVFALFLVMVIALLMQKIGLSPALGTFLAGVVLAESEFRHELEADIEPFKGLLLGLFFITVGASIDFPLFIAKFWLVIGLVTSLILIKACVLYALAFGFSMQKKQQVLFTLALAQGGEFIFVLLSLTASLSILSPEHTKLATLVVAISMLFAPLLLIGYEKWLEKSSRHAPSFDKPEHIEATKHVIIAGYGRFGQIIGRLLSAQGYHLSILDYSPSQIELLRRFGNKVFYGDAARQDLLEAAGAKDAKLLVIAIDEGDKILEIARICKKHYPHLKLVARAIDRRHAYELMHLGVVHFKRETFDSALNLGIEALQLLGNDPIAAERAGQLFAKHDDDSLAQLAQLWGDDKSYGIAVKKRLEDLKIVLMNDKAEQDKLNLCHGEQQKDESSCLE

SEQ ID NO: 73354 - protein, 505 aa, Arabidopsis thaliana
  misc_feature (48)..(48): Xaa can be any naturally occurring amino acid
MEDETQTLILITILILTLITLTFLIKKLKPKPNLPPSPPFSLPIIGHXRLLKPPLHRLFLTISKSLNGSPIFSLRLGNKLVFVVSSHSIVEECFTRNDVVLANRPKSIASKHISYNYSSMVSAPYSEHWRNLRRIGAVEIFSNHRLNSFNTIRRDEIRRLVARLSRSPNSSLPTRTVEMNSMLSNLAFNNIIRMVTGKCYYGDGAEDDPEAKRVRQLIAEAMSCFGAGHAADHLPMLRWITDFERRVKKIAARLDEFFQRLVDEKRVAKEKKENTMIDHLLSLQVSQPEYYTDHTIKGTMLSLILAGTDTSAVTLEWALSSLLNNPEVLKKVRDEIDNQIGLDRLLEESDIPNLPYLQNIVSETLRLYPAGPLLVPHISSEDCKVGGYDMPCGTMLLVNVWAIHRDPRLWDDPASFKPERFEKEGETHKLLTFGLGRRACPGSGLARRLVSLSLGSLIQCFEWERIGEEEVDMTEGGGLTMPRAIPLVAMCRARAFVGKIPHESG

SEQ ID NO: 73355 - protein, 569 aa, Bacillus halodurans
ERLKAPEGPPSDVERIKEESNYLRGTLKESMLEPISAGISDDDNRLMKHHGSYLQDDRDLRNERQKQKLEPAYQFMLRVRMPGGVATPEQWLVMDELAQKYGNGTMKLTTRETFQLHGILKWNMKKTIQAIHSALLDTIAACGDVNRNVMCTSNPYQSEIHQEVYEWSKKLSDDLLPRTRAYHEIWLDEEKVAGTPEAEEVEPMYGPLYLPRKFKIGIAVPPSNDIDVFSQDLGFIAIVEDDKLVGFNVAIGGGMGMTHGDKATYPQLAKVIGFCKPEQIYDVAEKIITIQRDYGNRSVRKNARFKYTVDRLGLETVKNELENRLGWSLDEAKPYHFDHNGDRYGWVKGVKGRWHFTLFVEGGRVTDYADYKLMTGLREIAKIHTGDIRLTSNQNLIIANVTSQKKKKINELIEQYGLTDGKHYTALRRSSIACVALPTCGLAMAEAERYLPKLIDKIDEIIEENGLKNEEITIRMTGCPNGCARHALGEIGFIGKAPGKYNMYLGAAFDGSRLSKMYRENIGEEEILKELREILPRYAKERKEGEHFGDFVIRAGIIKETTDGTNFHD

SEQ ID NO: 73356 - protein, 160 aa, Frankia sp. EAN1pec
MTEPSLPRVGTGVDVHPFEQGRECWVACLLWPGETGLAGHSDGDVASHAACDALLTASGIGDLGAVFGTGRPEWSGASGAALLGETARLLAEGGWLIGNVAVQVVGNRPRMAARRVEAQEAMSAALGAPVNLSATTTDGLGLTGRGEGLAAIATALVTRV

SEQ ID NO: 73357 - protein, 227 aa, Bacillus halodurans
MTSKSKGGRAMSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSS

SEQ ID NO: 73358 - protein, 394 aa, Brassica napus
  misc_feature (366)..(366): Xaa can be any naturally occurring amino acid
MALLRPHLHRFHSNALHQSAPHTKSTADAGGGLVVYPTYGRRRRHRCSAIAIDAPSSLAGVTPIRWGYTSVQGFREEMEDDIVIRSEALDSFSFAAVFDGHAGSSSVKFLREELYKGCVEALQVGSLLKGGDFGAIKGALVEAFESVDQSLLKWLETKGEEDESGSTATVMLIRNDVSYFAHIGDSCAVLSRSGQIEELTDSHRPYGSSKAAVQEMKRIKDAGGWIVNGRICGDIAVSRAFGDIRFKTKKHEMLKKGVDEGRWSEKFVSRIEFKGDMVVATPDIYQVPLTSDVEFIILASDGLWDYMKSKDVVSFVREQLREHGNVQLACEALAQVALDRRSEDNISIIIADLGRTEWKKLPVQRXQNMVVELAQAAATVGIVTVGIWMTSLLS

SEQ ID NO: 73359 - protein, 120 aa, Triticum aestivum
LTSFGSRSFHQATSPSKMSTVTRAYLDQRLAAAKRCSREAAVAGAKAAAVATVAAAVPTLASVRMLPWAKAHINPTGQALIISTVAGMAYFIVADKTILSMARKHSFDEAPDHLKNTSFH

SEQ ID NO: 73360 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARETSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 73361 - protein, 312 aa, Zea mays
MKAVGYNLYDSSGTDDDLPPAQNRGLRGRVFSGNGRASAGAFPYMRANNDLESEIHRVEQDAYTGVLRAFKVQSDAISWEKESLITELRKELRVSDEEHRELLNKVNEDGSIRQMRELRQAGGIPSGLHRGNRVLYDAEPGPTTKRQRASHSIPSQSAGLQSPMMPSHSVSSAKWGPLSARGKKAKMMAPEDIRWEFDGHLSNHDGWGPSGPMLKRHMTNNGAMAGSIRGRGRLSINEPIKDYAPPQNDINRNFDYIDIPNTESVVTEVERVLANPNMPEIEKARKLLKDQEQSLLDAIARLDEASDSDSGN

SEQ ID NO: 73362 - protein, 270 aa, Oryza sativa
  misc_feature (196)..(196): Xaa can be any naturally occurring amino acid
  misc_feature (222)..(222): Xaa can be any naturally occurring amino acid
MAEAVASGAAGRWTLRGKTALVTGGTRGIGHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVXAPWYMKTSLVADELAGKEFVGSVLRXTALKRVGEPEKVSSLVAFLCMPGASYITGQTISVDGGMTINGLYPTQD

SEQ ID NO: 73363 - protein, 257 aa, Rickettsiella grylli
MNVIFGTERLTNTSLINLIYYSYDLGYRKFDTAQAYNNLTLLGRAFKKLQKRETIQITSKVSKPFIEKYSFSACFELILRELKVDYLDYLFIHAPKGINHHTTIPEMLKLKDQKKIIKWGLSNYTIKHLEKLKSDYLLPDTLQVEVHPYLNEDKLVQYCHNNQIELMAHSAFAHGKVFKDKNLLQIARDNHCSISQLVLSWALHRKYLPIISTLKKEHLKKNSESKLISLEDKTIKLLDGFNSNSRICFSEDWAEFD

SEQ ID NO: 73364 - protein, 273 aa, Dioscorea cayenensis
MSSSTLLHLLLLSSLLFSCLPNAKPQQAEDEFSYIEGSPNGPENWGNLKKEWETCGKGMEQSPIQLRDNRVIFDQTLGELRRNYRAAEATLRNSGHDVLVEFEGNAGSLSINRVAYQLKRIHFHSPSEHEMNGERFDLEAQLVHESQDQKRAVVSILFRFGRADTFLSDLEDFIKQFSSSQKNEINAGVVDPNQLQFDDCAYFRYMGSFTAPPCTEGISWTVMRKVATVSPRQVLLLKQAVNENAINNARPLQPTNYRSVFYFEQLKSKLGVI

SEQ ID NO: 73365 - protein, 511 aa, Saccharomyces cerevisiae
MVLPRLYTATSRAAFKAAKQSAPLLSTSWKRCMASAAQSTPITGKVTAVIGAIVDVHFEQSELPAILNALEIKTPQGKLVLEVAQHLGENTVRTIAMDGTEGLVRGEKVLDTGGPISVPVGRETLGRIINVIGEPIDERGPIKSKLRKPIHADPPSFAEQSTSAEILETGIKVVDLLAPYARGGKIGLFGGAGVGKTVFIQELINNIAKAHGGFSVFAGVGERTREGNDLYREMKETGVINLEGESKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPSPSTSFAHLDASSVLSRGISELGIYPAVDPLDSKSRLLDAAVVGQEHYDVASKVQETLQTYKSLQDIIAILGMDELSEQDKLTVERARKIQRFLSQPFAVAEVFTGIPGKLVRLKDTVASFKAVLEGKYDNIPEHAFYMVGGIEDVVRKAEKLAREAN

SEQ ID NO: 73366 - protein, 569 aa, Vitis vinifera
MGNTCVGPSISKNGFFQSVSAAMWRSRAPEGSASYTNGETMDEPQATTKEPGSPLPVQNKPPEQMTIPKEEQPTKPKKPHQIKRVSSAGLRIESVLQTKTGNFKEFFILGRKLGQGQFGTTFLCVQKATRKEYACKSIAKRKLLTDEDVEDVRREIQIMHHLAGHPNVISIEGAYEDAVAVHVVMELCKGGELFDRIIQHGHYTERKAAELTRTIVGVVEACHSLGVMHRDLKPENFLLVNEEEDSLLKTIDFGLSVFFKPGEKFTDVVGSPYYVAPEVLRKRYGPEADVWSAGVILYILLSGVPPFWAETEQGIFEQVLHGDLDFSSDPWPSISESAKDLVRRMLVRDPRRRLTAHEVLCHPWVQVDGVAPDKPLDSAVLSRLKQFSAMNKLKKMALIVIAENLSEEEIAGLKEMFKMIDTDNSGQITFEELKAGLKRVGANLKESEIYDLMHAADVDNNGTIDYGEFIAATLHLNKVEREDHLFAAFSYFDKDGSGYITPDELQQACEEFGLEDVRLEEMIREVDQDNDGRIDYNEFVAMMQKGNPGIGKKGLQTSFSMGFREALKH

SEQ ID NO: 73367 - protein, 449 aa, Vitis vinifera
MSASTVSITANTAARRRPVVIGEKKPNIELLSGDAGVSQFNGIAGEDKLTGGGGKDLSHSIRGETILERSKEVVQIKKTSANAATEPRRTRKVVSKSERPRWVTAVSIFTKNLVLLVVILGLVQMIRKLALKSADSSGGSLVAVPDFERRIAEVESFLKTTTKMMQVQVEVVDRKIESEKRAGDFNNHLEKLDSKSETLEKKLGELGAMEFLRKEDFDKIFDELKNAKSADYGDREMSLDEIRGIAREIVEKEIERHAADGLGRVDYALSSSGAMVVRHSEPYILGKGSGWFPKTSLTGVHRDSEKMLKPSFGEPGQCFPLKGDSGFVQIRLRTTIIPEAITLEHVDKMVAYDRSSAPKDCRVYGWHQGHDTDIAAETGSMFLLAEFSYDLEKSNAQTFNVLDLVGSGLVDMVRFDFASNHGSPSHTCIYRLRVHGHELDSVSMLAMQS

SEQ ID NO: 73368 - protein, 334 aa, Streptomyces globisporus
MLGDEDGKAAELWSMANLGTPMAVRVAATLRIADHITAGAHTAGEIAEAAAVHEESLDRLLRYLTVRGLLDRDGLGRYTLTPLGRPLCEDHPAGVRAWFDMEGAGRGELSFVDLLHSVRTGKAAFPLRYGRPFWEDLAEDPRRAESFNRLLGQDVATRAPAVVAGFDWASTGHVIDLGGGDGSLLTALLTACPSLRGTVLDLPEAVQRAKESFAVSGLDDRANAVAGSFFDALPAGAGAYVLSLVLHDWDDEASVAILRRCAEAAGQTGSVFVIESTGSAGDAPHTGMDLRMLCIYGAKERRVEEFEELAGRAGLRVVAVHPAGPSAIIQMSAV

SEQ ID NO: 73369 - protein, 376 aa, Glycine max
MMSCQAWPEPIVRVQSLADSGLSSIPSRYIRPHSQRPSNTTSFKLSQTEHDHGHGRETRDHDHVNIPVIDLEHLFSEDEILREKIFRHVDEACREWGFFQVVNHGVSHELMKSSRELWREFFNQPLEVKEEYANSPTTYEGYGSRLGVQKGATLDWSDYFFLHYRPPSLRNQAKWLAFPQSFRKVIAEYGEEVVKLGGRILKMMSINLGLKEDFLLNAFGGESEVGACLRVNFYPKCPQPDLTFGLSPHSDPGGMTILLSDDFVSGLQVRRGDEWVIVKPVPNAFVINIGDQIQVLSNAIYKSVEHRVIVNSNKDRVSLALFYNPRSDLLIQPAKELVTEERPALYSSMTYDEYRLYIRLNGPCGKAQVESLAFQP

SEQ ID NO: 73370 - protein, 306 aa, Streptomyces globisporus
MRTRRRWSAADVPDRTGTTAVVTGASSGIGLHLAQELARHGAHVVLAVRDPDRGVAAAARIQSRVPSAQLTVRRLDLSRLASVRAGAEELRDRFPRIHLLVNNAGVMWTDRARTPDGHELQFATNHLGHFALTGLLLDSLRAAPGARVVTISSYLHRLGRIDFSDLHGERRYSRYRAYNQSKLANLMFALELHHRLAESGAELASLAAHPGLTATGLGRDFPAPVRRLGSPLAPLFLQPAAAGMLPGLRAATDPGARGGEFYGPLGVTETRGAPGLVRPGGAAVDPRARRRLWEESEHLTGVRLRP

SEQ ID NO: 73371 - protein, 206 aa, Triticum aestivum
MGEQGTSGSEGGGSMVEAQAPAKKGDGRAADPRLQGISDAIRVVPHFPKPGIMFNDITALLLRPGVFKDAVDMFVERYRGMGIAAVAGIEARGFIFGPAIALAIGAKFIPLRKPGKLPGEVISETYTLEYGTDCLEMHVGAVEPGDRVVVVDDLVATGGTLSAAIKLLERAAADVVECACLIGLPKFKDFYKLDGKPVYILVESRK

SEQ ID NO: 73372 - protein, 298 aa, Picea glauca
MAMLSGGLQKEEEMAKIDKACEEWGFFQVVNHGVPHSLMDDITRMGKEFFRLPAEEKEKYAIRDFQGYGQIFVVSEEQKRDWGDLLGLIISPPQSRNLSVWPSVPSEFRQIVEAYNMEIRSLAVKILSLIAENLHLKPDYFEQSFGNTYQKMRMNYYPACPRPDLVLGLSPHADGSGITLLLQDEKVEGLHVRKDDIWVAVQPIPYALVINIGNLLEVITNGRYKSIQHRAVTNKHKSRLSIDVFYSPGFDAEIGPAPELIDESHPCLFRKFIHEDHIKYYMSRKVDGKTSFYEYAGV

SEQ ID NO: 73373 - protein, 223 aa, Oceanobacillus iheyensis HTE831
MVDVATNLSNIQENIRQACANANRSPEDIRLIAVTKYVTIERTKEAINAGIDNLGENRNEGFLEKYNEIQNQVNWHFIGSLQSRKVKDIINQVDFIHSLDRKSLAKEINKRATHPVNCFVQVNVSGEESKHGIFPDEVISFIKSLSGYENIKIVGLMTMAPHVEDPEDVRSVFKKLRDLRDEITKKELPHAPCEWLSMGMSNDYHIAIEEGATHVRIGSKLVG

SEQ ID NO: 73374 - protein, 248 aa, Shewanella sp. MR-4
MSINLSLAGKVALVTGASRGIGRAIAETLVEAGAIVVGTATSEKGAAAIQEYLGDKGFGLVLNVTDSQSVTDLFDSIKEKAGDVDILVNNAGITRDNLLMRMKDDEWNDIIDTNLTSLFRLSKPVMRTMMKKRFGRIINIGSVVGTMGNAGQVNYSAAKAGLIGFTKSLAREVASRQITVNAIAPGFIQTDMTDELTEDQQKAIMSQVPMERLGQAQEIANAVLFLASDSAAYITGETLHVNGGMYMV

SEQ ID NO: 73375 - protein, 213 aa, Hordeum vulgare subsp. spontaneum
MANKHLSLSLFLVLLGLSASLASGQVLFQGFNWESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGGTPDARLDWGPHMICRDDRPYADGTGNPDTGADFGAAPDIDHLNLRVQKELVEWLNWLKADIGFDGWRFDFAKGYSADVA

SEQ ID NO: 73376 - protein, 367 aa, Zea mays
MEMENGHAKYRVAVIGSGNWGSVASRLIASNTAKLPSFYDEVRMWVFEEILPTGRKLSESINEQNENCKYLPGIKLGTNVIADPDLESAVKDANMLVFVTPHQFVEGICKKLVGKLTPGAEAISLIKGMEVKMEGPCMISKLIADTLGINCCVLMGANIANEIAVEEFSEATIGYRKDKEVANRWAKLFTTPYFLVSVAEDIEGVELCGTLKNIVAIAAGLVDGLDMGNNTKAAIMRIGLREMRAFSKLLFPSVRDNTFFESCGVADLITTCLGGRNRRVAEAFARNGGKRSFDELEAEMLRGQKLQGVSTAREVYEVLTYRGWQELFPLLSTVHEICIGQLPPTSIVEYSEHTPNLSIIGGHTPFY

SEQ ID NO: 73377 - protein, 389 aa, Fulvimarina pelagi HTCC2506
MLHLSRLRAEARNAPPSGIVAVMQHAFGREGVLPMWAGEGDLSTPDFIARAASESLAKGETFYTHQRGLPELRQALAGYVERLYGRPQSADRFFVTGSGMQAIQISIAALAGAGDEVVYFGPAWPNFAAAAGLIGAKPVEVALRPEDGAWHLDLDKVRDAVSAMTRAIFVNTPANPTGWTASEDELRAILHIARETNTAIIADEIYSRFFYAGTRAPSFHDVMAEDDTILFVNSFSKNWAMTGWRVGWIEAPAELDEVLANLIQYSTSGVAVFMQRAALAALQEGESFVEEQIARAHRARNIFADRLLATNRVALTPPAGAFYAFFSIDGVEDTRAAAFRIVDEAGVGLAPGTAFGPVGTQFLRACFHRRLDEVEMAADRIAGWIGRTL

SEQ ID NO: 73378 - protein, 276 aa, Zea mays
MASSLSFVSSSHLTLRTPSLTLRKLSPPRTSVSFSVKAQSVALSQDDLKKLAAEKAVEAIKPGMVLGLGTGSTAAFAVDQIGKLLSSGELHDIVGIPTSKRTEEQARSLGIPLVALDTHPRIDLAIDGADEVDPNLDLVKGRGGALLREKMVEAVAERFIVVADDTKLVKGLGGSGLAMPVEVVQFCWKFNLVRLRDLFKEFGCDAKLRVGEGGEAYVTDNSNYIIDLYFKEPLKDGFAAGREIGKLEGVVEHGLFLGMATSVIIAGKNGVEVMNK

SEQ ID NO: 73379 - protein, 275 aa, Vibrio fischeri ES114
MSVKIKNAAEIEKMRVAGQLAAEVLEMIEPYVKAGVTTEELDQICHKHITEVQGAIPAPLNYHGFPKSICTSINHIVCHGIPASQDEQYNGFVKPAVLKDGDILNIDITVIKDGYHGDTSKMFLVGDVSPTDKRLCLIAQESLYVGMRKVKPGVKLGEIGTAIQKYIKGTTPKCSIVRDYCGHGIGSEFHEEPQVVHYKNSDRTVLKAGMTFTIEPMINLGKFGCLQDDNDGWTVYTGDGKNTAQWEHTILVTETGCEVLTLRAEETIPRHMNNK

SEQ ID NO: 73380 - protein, 319 aa, Streptococcus suis 89/1591
MKKILVLHTGGTISMQANHQGEVASSKINPMTQIDSPLEEIQVTSLDFLNVPSPHIRLEHMMTLYQKIKEEQMNFDGFVITHGTDTLEETAYFLDTMAIPEKPIVLTGAMRSSNELGSDGIYNYRTALRVAADDKSADKGVLVVMNDEIHAAKYVTKTHTTNVSTFQTPTHGPLGLVTKREILYFKTAEPRVRFDLSTVTGTVPIIKAYADMDSILLDSLTASSISGLVIEALGAGNLPPTVLPAIKKLLDQKIPIILVSRCFNGIAEPVYAYQGGGIQLEQDGILFVKELNAQKARLKLLIALNAGLEEQSLADYIQG

SEQ ID NO: 73381 - protein, 356 aa, Oryza sativa Japonica Group
MKNTSSLCLLLLVVLCSLTCNSGQAQVLFQGFNWESWKQQGGWYNMLKGQVDDIAKAGVTHVWLPPPSHSVAPQGYMPGRLYDLDASKYGTAAELKSLIAAFHGKGVQCVADVVINHRCAEKKDARGVYCVFEGGTPDDRLDWGPGMICSDDTQYSDGTGHRDTGEGFGAAPDIDHLNPRVQRELTDWLNWLKSDVGFDGWRLDFAKGYSTDIAKMYVESCKPGFVVAEIWNSLSYNGDGKPAANQDQGRQELVNWVNAVGGPAMTFDFTTKGLLQAGVQGELWRLRDGNGKAAGMIGWLPEKAVTFVDNHDTGSTQKLWPFPSDKVMQGYAYILTHPGVPCIVSKPCIIVLYTMS

SEQ ID NO: 73382 - protein, 287 aa, Medicago truncatula
MGKDVEGQEQGGEFSAKDYQDPPPAPLFDLDELTKWSLYRAVIAEFVATLLFLYITVLTIIGYSRQSDTTIKGNTECDGVGVLGIAWAFGGMIFILVYCTAGISGGHINPAVTFGLFVGRKVSLIRAFLYIVAQCLGAICGAGLAKGFQTSYYNRYKGGVNTVSDGYSKGTALGAEIIGTFVLVYTVFSATDPKRSARDSHVPVLAPLPIGFAVFMVHLATIPVTGTGINPARSFGPAVIFNNEKAWDDQWIYWVGPFIGAAVAAIYHQYILRGSAIKALGSFRSNA

SEQ ID NO: 73383 - protein, 629 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDMTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 73384 - protein, 267 aa, Pseudomonas fluorescens Pf-5
MSVPAFGLGTFRLQGQVLIDSLSSALELGYRAIDTAQIYDNEADVGAAVAASDIPRDQLFITSKIWIANLSRERLIPSLKKSLHKLRTDYLDLTLIHWPSPDNQVPVAEFMQALLEAKTQGLTRQIGVSNFSNALLQQAIDAVGAEQIASHQVELHPYLQNRKVVEFARSQGIHITSYMTLAYGEVLKDPLILQIAQARQATPAQVVLAWAMQSGYAVIPSSTRRANLQGNLAACALTLSSAELESIAGLERGQRLTSPAGIAPQWD

SEQ ID NO: 73385 - protein, 377 aa, Streptomyces coelicolor A3(2)
MATEDAVREALATVNDPEINRPITELGMVKSVEIGADGAVAVAVYLTVSGCPMRDTITQRVSDAVSRVEGVTRVDVELDVMSDEQRKELATALRGGQTEREVPFAKPGSLTRVYAVASGKGGVGKSSVTVNLAASMAADGLKVGVVDADIYGHSVPRMLGADGRPTQVENMIMPPSAHGVKVISIGMFTPGNAPVVWRGPMLHRALQQFLADVYWGDLDVLLLDLPPGTGDIAISVAQLVPNAEILVVTTPQQAAAEVAERAGAIAVQTHQKIVGVVENMSGLPCPHCGEMVDVFGTGGGQTVADGLTRTTGASVPVLGAIPIDVRLREGGDEGKPVVLSDPDSPAGAALRSIAGKLGGRQRGLSGLSLGITPKNKF

SEQ ID NO: 73386 - protein, 449 aa, Streptomyces globisporus
MRIDPPGPPLRALPGLLRKLAVDRLGMMRDAAGLGDAVRVSMGPKKLYIFNRPDYAKHVLADNSDNYHKGIGLVQSRRVLGDGLLTSDGETWREQRRIVQPAFKPGRINQQAAAVAEEAAKLVALLRGHEGGGPVDVLQEVTGLTLGVLGRTLLDSNLTAHESLAHSFEEVQDQAMLEMVSQGTVPAWLPLPPQARFRRARRELYRVADLLVADRRSRMADGGPGDDALSRIIVAADRRRDDPARARNRLREELVTLLLAGHETTASTLGWTLHLLERHPEVRDRVRAEARAALGDGVPGPEDLHRLTYTTMVVQEAMRLFPPVWILPRVAQQRDVVGGYTVSAGSDVLVCPYIMHRHPGLWEDPERFDPERFEPRQTADRPRYAYIPFGAGPRFCVGSNLGMMEAVFVTALVTRDLDLRTVAGHRAVAEPMLSLRMRGGLPMTVSTAR

SEQ ID NO: 73387 - protein, 459 aa, Physcomitrella patens subsp. patens
MGLFLSSARNSEYDASIGNSDSTKRPRISVKYEHQPATIPGLPEEIAVQILARVSRGNHPLLSCVCKAWYHVLSTPEFFNLRKELGVTEEWLYVLMKDEEERLGWRVLDPVEGRWRKLPPMPELSNIAKKTEANEISWGWRLRSGPLRMLRLTSLFGGWFQRKGFLDKIPYCGCSAGAINGSLYVLGGFSWANAMRAVWRYDSRTNRWASSAAMEVARAYCKTGVIDNKLYAIGGVDRGRGGLTPLQSAEVYDPETDSWSQVAPMPFRRARVLPTAFLSDMLKPIATGMASYNGKLCVPQSLYSWPFFVDVGGEIFDPATDTWVEMATGMGNDWPARQAGTKLSAVVGGKLYALDPTSSMDGSKIKVYDSDKDVWKVVLKKVPILLDLSDSESPYLLAGFDGKLHVITKDFNNNVTVLRAELGFNSQSHQAKEFEVGWKTISSASFGAVELVACQVLDL

SEQ ID NO: 73388 - protein, 190 aa, Picea glauca
MAALSAKMPLLSISKGSTHHGVTAMRSATAAPRVFFRTIPRAGEYGRNAAEEARETADSTAEKSKRMAEEAKERAKGATYEAKEKAKGTTYEAKEKTKSAAEEAGNKAGEMKENAREKAEGLGQRAKETTSQATEKAQNIGDQPKQKVQEAWDMAKGTGQKVKETVVGKAEDTKETVEDKTESAKRKINE

SEQ ID NO: 73389 - protein, 271 aa, Triticum aestivum
  misc_feature (246)..(246): Xaa can be any naturally occurring amino acid
  misc_feature (257)..(257): Xaa can be any naturally occurring amino acid
AYLGDLQNKFVQKSRFVPVRNSRDIVDPRVRAEEAAASAATNFEVDLGHLLAYDPSHHLAAAAASSRAELREECLRKATELAQAVANALFSLPATEGLDGPVVRLPPPANRLPREKHLPRPKPPTKWEQFAKSKGIIKHKKNKRAWDEQTNSWKRTYGYDRVNDDRDVPIIEAKLTDEPGVDPFAQRKEERKGRVDKQEKNRLGNLKNAAKSGALPSHIQLAATSLPITGTKADLPRKTKKEDLEXVLGMPSAATAXGGKFNKKWPGEKPS

SEQ ID NO: 73390 - protein, 95 aa, Oryza sativa Indica Group
MASGHQQQVSSDLYLMSREGQTVVPVGTGGKSLEAQENLAEGRSRGGQTRKEQMGEEGYREMGRKGGLSTGDESGGERAAREGIDIDESKYKTKS

SEQ ID NO: 73391 - protein, 525 aa, Shewanella sp. MR-4
MINRGFMFDLFRHKTSSHKADILSGLTVALALIPEAVAFAFVANVEPMVGLYAAFIMGLVTALIGGRPGMISGATGAMAVVMVSLVVEHGVQYLFAAVVLAGLIQISAGVFKLGKFIRIVPYPVMIGFVNGLAIVIFLAQLGQFKVKNAAGELVWLPQEPLMLTLGLVALTMAIIYFLPKLTTAVPSSLVAILSVTAIVVGFDLDTRNVLDFLKTMSGDEHATIAGSLPSFAIPQVPFNLETLYIILPYSFILAAVGLIESLLTLTVIDEMTNTRGRSNKECIGQGVGNITSGFFGAMGGCAMIGQSMININSGGRGRLSGITAAIGLLTFILFGASFIEIIPLAALVGVMFIVVLGTFEWASFKFMGKVPKHDAFVIVLVTTVTVFTDLAFAVFVGVVVSALVFAWQHAKHISVKVTSNSLGWKVYELNGPLFFGSVASFLELFDASQDPQDVVIDFKHSRVADHSALEAIDTLAERYVALGKKLHLVHLSADCKALLHKAGDLVEVNLLDDPHYKVADDKLDS

SEQ ID NO: 73392 - protein, 366 aa, Oceanobacillus iheyensis HTE831
MKKRKLILEDGTVFNGTAFGSDAESSGEIVFNTGMTGYQEVITDPSYCGQFVTLTYPLIGNYGINRDDFETVTPFIHGLVVKEYSEFPSNFRNEETLDEFLQAHNIPGIANIDTRKLTRIIRKHGTMRAVMVDEQKNEQHVIEQLRLAEMPRDQVKRTSTIKPYVVPGRGLRVVMVDFGAKHGILRELTRRDCHITVVPHNYSAEAILRLKPDGIMLTNGPGDPKDVPEAIEMIKQLLGQIPIFGICLGHQLLALACGADTEKMKFGHRGANHPVKDLLAGKTYLTSQNHSYAVNVSSLVNTDLELTQIALNDDTVEGIRHTAFPAFSVQYHPEASPGPEDTNFLFDEFLNLIKASKVKQGGEVYA

SEQ ID NO: 73393 - protein, 279 aa, Zea mays
  misc_feature (95)..(95): Xaa can be any naturally occurring amino acid
  misc_feature (224)..(224): Xaa can be any naturally occurring amino acid
  misc_feature (271)..(271): Xaa can be any naturally occurring amino acid
MAFRLSNNLIGVLNFVTFLLSVPILGAGIWLGHRADGTECERYLSAPVIALGAFLLAVSLAGLVGACCRVTWLLWAYLLAMFVLILVLFCWNSAXTVFAFVVTNRGAGEAVSGRGYKEYRLGDYSNWLQKRVENTRNWDRIRSCLQDSKVCKSLQDKNETVAQFMSSSLSPIESGCCKPPTSCGYTYVGGTDWTPVTTNSTDPDCKTWSNDASALCYNCQSCKXPGVVATFQRNWKRVAVVCIVFLVFIIIVYSVGCCAFRNNRRDNAYRXGGWKGGYA

SEQ ID NO: 73394 - protein, 202 aa, Vibrio fischeri ES114
MVLVGRQAPDFTAAAVLGNGEIVDNFNFAEFTKGKKAVVFFYPLDFTFVCPSELIAFDNRLEDFQAKGVEVIGVSIDSQFSHNAWRNTAIEDGGIGQVKYPLVADVKHEICKAYDVEHPEAGVAFRGSFLIDADGLVRHQVVNDLPLGRNIDEMLRMVDALNFHEKNGEVCPAQWEEGKAGMDASPKGVASFLSEHADDLSK

SEQ ID NO: 73395 - protein, 162 aa, Triticum aestivum
  misc_feature (2)..(2): Xaa can be any naturally occurring amino acid
  misc_feature (17)..(17): Xaa can be any naturally occurring amino acid
  misc_feature (33)..(33): Xaa can be any naturally occurring amino acid
  misc_feature (43)..(43): Xaa can be any naturally occurring amino acid
  misc_feature (49)..(49): Xaa can be any naturally occurring amino acid
  misc_feature (52)..(52): Xaa can be any naturally occurring amino acid
  misc_feature (69)..(69): Xaa can be any naturally occurring amino acid
  misc_feature (72)..(72): Xaa can be any naturally occurring amino acid
  misc_feature (92)..(92): Xaa can be any naturally occurring amino acid
  misc_feature (94)..(94): Xaa can be any naturally occurring amino acid
  misc_feature (106)..(106): Xaa can be any naturally occurring amino acid
  misc_feature (112)..(112): Xaa can be any naturally occurring amino acid
  misc_feature (118)..(119): Xaa can be any naturally occurring amino acid
  misc_feature (128)..(128): Xaa can be any naturally occurring amino acid
  misc_feature (134)..(134): Xaa can be any naturally occurring amino acid
  misc_feature (142)..(142): Xaa can be any naturally occurring amino acid
  misc_feature (147)..(147): Xaa can be any naturally occurring amino acid
MXPTVMGSSGTSVAPFXGLKSTAGLPVSRRSNXASLGSVSNGXRIRCMXVWXIEGIKKFETLSYLPPLXTEXLLKQVDYLIRSKWVPCLEFXKXGFIFREHNASPXYYDGRXYWTNVXXLLCSGCTDXTQVINXGWGGGQKXSNLDXYVRHHSFRQQAKVQL

SEQ ID NO: 73396 - protein, 308 aa, Fulvimarina pelagi HTCC2506
MKHFLDIAAVDSSDLRTIIADAMHRKTLDGRQAKPLEGKVLAMIFDKPSTRTRVSFDVGMRQLGGETLFLSGTEMQLGRSETIADTAKVMSRYVDAIMIRTTEHARLLELAESATVPVINGLTDDTHPCQIMADILTFEEKRGPVKGKTFAWVGDGNNVTASWIEAAARFEFKMTIATPEGSEADARFVTWARNEGAEILTTTDPVEAVNGADCVITDTWVSMGREAQARGHNVFMPYQVNENLMRHAKSEALFMHCLPAHRGEEVTDGVMDGPQSVVFDEAENRLHAQKSIIAWVFGSLQDGKLGLA

SEQ ID NO: 73397 - protein, 371 aa, Streptococcus suis 89/1591
MALTAGIVGLPNVGKSTLFNAITKAGAEAANYPFATIDPNVGMVEVPDERLQKLTELITPKKTVPTTFEFTDIAGIVKGASKGEGLGNKFLANIREVDAIVHVVRAFDDENVMREQGREDAFVDPIADIDTINLELILADLESINKRYARVEKMARTQKDKDSVAEFAVLEKIKPVLEDGKSARTVDFTDEEQKIVKQLFLLTTKPVLYVANVDEDKVADPESISYIQKIRDFAATENAEVVVISARAEEEISELDDEDKGEFLEALGLTESGVDKLTRAAYHLLGLGTYFTAGEKEVRAWTFKRGMKAPQCAGIIHSDFEKGFIRAVTMSYDDLMTYGSEKAVKEAGRLREEGKEYVVQDGDIMEFRFNV

SEQ ID NO: 73398 - protein, 404 aa, Fulvimarina pelagi HTCC2506
MPSSPAETSSSIYPTYNRAPISFESGEGVWLKANDGKRYLDCAGGIAVNALGHAHPHLVDALKSQAEKLWHVSNLFEIPGQKRLADRLCQATFADRVFFTNSGAEALECAIKTARRFHHVNGAPERVNILTFEGAFHGRTLATIAAGGQAKYLEGFGPKAPGFMSLPFGDHDALRMAAAEPDVAAILVEPVQGEGGVRKLPLPCLTGLRELCDERGILLIYDEVQTGIGRTGRFFAHQNAGGAEPDILATAKGIGGGFPLGACLATEAAGSAMTPGTHGTTYGGNPLAMAVGNAVLDIVLDEGFLEGVRDKAILFKQSLESLKDRFPDVLEEVRGTGLLIGLKTVCPNTEAVAALRTEGLLTVPAGDNVVRLLPPLTITSEEIREAVQRLENAFAALSENKKSA

SEQ ID NO: 73399 - protein, 318 aa, Oryza sativa Japonica Group
MHPITFFTNIIGVVTIVLISIVSILGLICLCHSLNFQLLIKRRRRNYYQANDEQLSYFNGPWLTRITLILVALWWGVGEVLRLTFVNGEGRFISDQTWQANVCKFYIVSNLGFAEPGLFLLLAFLLSAALQNQEVGALNRKWNQRTICAVFMLCSPSLIWEACVVFIGPHIASNDGQTSKVAKYWYSASSVHDGDVACTYPLLSSIFLGTFYTVLTLYVIFVGGQILSLVINKGLRRRIYMLIFATGILLPRAMFLGFSVLPWPGEIVHESLVFVSFLVLMIAAMLGIVILVYFPVAETFEVRNQEHIELQTSHSIAL

SEQ ID NO: 73400 - protein, 516 aa, Thermoplasma acidophilum
  misc_feature (1)..(1): Xaa can be any naturally occurring amino acid
  misc_feature (46)..(46): Xaa can be any naturally occurring amino acid
  misc_feature (73)..(73): Xaa can be any naturally occurring amino acid
  misc_feature (93)..(93): Xaa can be any naturally occurring amino acid
  misc_feature (126)..(126): Xaa can be any naturally occurring amino acid
  misc_feature (171)..(171): Xaa can be any naturally occurring amino acid
  misc_feature (195)..(195): Xaa can be any naturally occurring amino acid
  misc_feature (267)..(267): Xaa can be any naturally occurring amino acid
  misc_feature (277)..(277): Xaa can be any naturally occurring amino acid
  misc_feature (289)..(289): Xaa can be any naturally occurring amino acid
  misc_feature (305)..(305): Xaa can be any naturally occurring amino acid
  misc_feature (352)..(352): Xaa can be any naturally occurring amino acid
  misc_feature (385)..(385): Xaa can be any naturally occurring amino acid
  misc_feature (398)..(398): Xaa can be any naturally occurring amino acid
  misc_feature (412)..(412): Xaa can be any naturally occurring amino acid
  misc_feature (422)..(422): Xaa can be any naturally occurring amino acid
  misc_feature (426)..(426): Xaa can be any naturally occurring amino acid
XFRSRPNALSQRSVIASSSELASLAGRDILKRGGNIFDAALAVSAXLCVTQNNLCGLGGDLFALIRDENGQIXDLNGSGQASRAVSIDYYESXGLTKIPERGPYAAITVPGIAGSWDEIFRKFATXDIADILEPAIRTASAGFPITQNYSDSIARSAPVIGQYRGWSSIFXPNGSVPVAGEILKQPDLAESFRLXSEEGFRSFYDGSLADIIIAGLEGTGSPLSDRDLRVYRPLIGKPVFTDLDEFRIYETSPNSQGITVIEWIRGXESHGYDSRTXWEAKIEDIFETXEEAYDKRRKITDPSYXNIAQHDSANGKKDGLPKRDHNDIGDTTYFSISDSEGRSVSIIQSNYXGFGSGIVPKGTGFVLQNRGSYFTLQRDHPNALXPGKRTFHTLAACXVEKEHDLYASLGSXGGDIQPQVQXQILXEILKDNTDPQAILDKPRWTEPYTIYEAPGAVYVESEELYRNVSKQISGRKVVLRDVSQEFGTAQITTLIRGDVVVGAADPRGDGIAIPYS

SEQ ID NO: 73401 - protein, 464 aa, Pseudomonas fluorescens
MAVYNYDVVVLGSGPAGEGAAMNAAKAGRKVAMVDSRRQVGGNCTHLGTIPSKALRHSVRQIMQFNTNPMFRAIGEPRWFSFPDVLKSAEKVISKQVASRTGYYARNRVDLFFGTGSFADEQTVEVVCANGVVEKLVAKHIIIATGSRPYRPADIDFHHPRIYDSDTILSLGHTPRKLIIYGAGVIGCEYASIFSGLGVLVELVDNRDQLLSFLDSEISQALSYHFSNNNITVRHNEEYDRVEGLDNGVILHLKSGKKIKADALLWCNGRTGNTDKLGMENIGVKVNSRGQIEVDENYRTCVTNIYGAGDVIGWPSLASAAHDQGRSAAGSIVDNGSWRYVNDVPTGIYTIPEISSIGKNEHELTKAKVPYEVGKAFFKSMARAQIAGEPQGMLKILFHRETLEVLGVHCFGYQASEIVHIGQAIMNQPGEQNTLKYFVNTTFNYPTMAEAYRVAAYDGLNRLF

SEQ ID NO: 73402 - protein, 642 aa, Staphylococcus aureus subsp. aureus MW2
MILLQLNHISKSFDGEDIFTDVDFEVKTGERIGIVGRNGAGKSTLMKIITGVENYDSGNVSKIKNLKLGYLTQQMTLNSNATVFEEMSKPFEHIKRMESLIKEETDWLSKHANDYDSDTYKTHMSRYESLSNQFEQLEGYQYESKIKTVLHGLNFSEEDFNKPINDFSGGQKTRLSLAQMLLNEPDLLLLDEPTNHLDLETTKWLEDYLRYFKGAIVIISHDRYFLDKIVTQIYDVALGDVKRYVGNYEEFIQQRDLYYQKRMQEYESQQAEIKRLETFVEKNITRASTSGMAKSRRKILEKMERIDKPMLDAKSANIQFGFDRNTGNDVMHVKNLEIGYQTAITKPISIEVSKGDHIAIIGPNGIGKSTLIKTIANQQKALNGDITFGANLQIGYYDQKQAEFKSSKTILDYVWDQYPLMNEKDIRAVLGRFLFVQDDVKKIINDLSGGEKARLQLALLMLQRDNVLILDEPTNHLDIDSKEMLEQALQHFEGTILFVSHDRYFINQLANKVFDLTIDGGKMYLGDYQYYIEKVEEAEALKAHQEEQSVNVQAHEKSMEQSSYHNQKEQRREQRKLERQISECENEIETLETTILQIDEQLTQPEVYNNPQKANELAIQKQDSEQKLEHAMSKWEELQQKL

SEQ ID NO: 73403 - protein, 169 aa, Zea mays
  misc_feature (115)..(115): Xaa can be any naturally occurring amino acid
  misc_feature (124)..(124): Xaa can be any naturally occurring amino acid
MDHDKTGCQSPPEGPKLCINNCGFFGSAATMNMCSKCHKTILFQQEQGAKLASAVSGSPSNILKETFTADLVDAGTKSIEPVAVSVQAVAEVVAPEEAAAKPKEGPSRCTTCNKXGVGLTGFKXRCGDLFCGTHRYADVHNCSFDYHVAAQEAIAKANPVVKADKLAKI

SEQ ID NO: 73404 - protein, 489 aa, Oryza sativa Japonica Group
MAAGVALHLHLQGMKVKAIRVHKIGGPEVLTWEEVEIGEPSEGEIRIKNKAIGVNYVDIYYRTGLHQEPLPFVPDLVYGDSDNKIPTYFVKSNVSSWPGENSWLPSELIEYTGKEAVGVVSAVGPGVTGIEVGDVVGYADTPMGTYTEEQIIPATLAIPIPPSVDHITAASVLLKGMTTYVLVKQAFKIQAGHTVLVHAAAGGVGSLLCQWANALGATVIGTVSTQEKAIQAAEDGCHHVIIYTEEDFVAQVAEITSRKGVHVVYDAVGKDTFKGSMECLMPRGCMISYGQCSGRPDPVPVSDLASKSLILGRPGMRHYTATRDELLHAAGEVFAGVAAGVLRVRVNHVYPLHEAARAHADLEARRTSGSVWYQSPRFGTWNNFHGSHGGEARPNVTWVAYGWWAGLRTPTSGRLTFITSGENNFHGSHGNKVVSEPKVWIPEQFPWVTWWTGQLRLISTGKRDGGDHHSDKPHAGMSFQAVNLKDLTV

SEQ ID NO: 73405 - protein, 369 aa, Debaryomyces hansenii CBS767
MPEYKVLACGSNGSYQLGISNDEDQDTLQTVIFRHENGSKTNYIDSKPIKISSGGNHTFILTNTGILYSAGDNTYGQCAHPINPESTHTLEFTTVGGNNKWKDVSCGWEFSILMDDSDEIYVCGIGMKGELGLGSNTKRSELMKTSFELPSRIIDLKSSINHTIIKLANGDLYGWGNCRKGQLGKQKAVVVNNKSKTRSIVWEPERLLFGEIDLQAYDLGRDCTVILNRNHQISIYGKGAETYDCGDNVIDLKSMWSSNHYLVEDQNHLQTIKSRGNNSHGQLFPKTRIDFAKYEIGSEHGLVLTKQNTVYAWGWGEHGNCGIHTASVNENNLEEKVTFDYLNCLYDGDDRVILLGAGCATSWLCLQTK

SEQ ID NO: 73406 - protein, 448 aa, Oryza sativa
MPVNMISKLLEKAVLPALDVAPPVKIGGPRRTSVLRNPNMEKLQKGYLFPEISIKREEHLKKYPDAKVISLGIGDTTEPIPSIVTSAMAEDVPFPFCRYALALSTPEGYQGYGPEQGHKNLRKEIADKVYPDMGIKESEVFISDGAQCDIARLQTLFGPNVTIAVQDPTFPGYVDNGVIMGQTGKADDGGRYAGIEYMRCAPENAFFPDLSRVRRTDVIFFCSPNNPTGHAASREQLRQLVELARRNGSIIVFDSAYSSYISSSSSSSTPRSIYEIPGAREVAIEVSSFSKFAGFTGVRLGWAVVPDELLYSDGVPVARDFDRVVCTCFNGASGIAQAGGVACLSTEEGRGAVARVVGVYRENARVLVETFRSLGKEVHGGGDAPYVWVRFPGRRSWDVFAEILEKTHVITVPGSGFGPGGEGFIRVSAFNSRDKVLEACQRLKSFLA

SEQ ID NO: 73407 - protein, 583 aa, Candida albicans SC5314
MGQILSQPVVEKHSDEHKDKYLAYGISCMQGWRINMEDAHATILNLYDLPLKKSLSSNSEQDEDEEDEEEEADSQDSTTTNTTKSHQQQNQKEDLQQNNDKQNSQQDIKDGDNDTQMSDSDENHHHAAPQQQHIAFFGVYDGHGGEKAAIFTGEKLHHLIKETKEFKQKDYINALKQGFLNCDQEILKDFYMRDDDSGCAATSAIITPDLIVCGNAGDSRTIMSTNGFAKALSFDHKPSNEGEKARICAAGGYVDMGRVNGNLALSRGIGDFDFKKNVDLPAEEQIVTCYPDVIQHNIDYKSDEFVVLACDGIWDCLTSQKCVECVRRGIYERKSLSIICEEIMDLCCAPTSDGSGIGCDNMSIAIVALLDYTKNETLDQWYEKIISRVEQQQQQKNDPNSLNKYGPISQPYNELYKEMYGEYYDIGQQGQGGNGRSNIGSGSGRGSGASGSSSGGGASINGNSIFGRSGYDDEEDDDEEKNIERRRRDQDESNLNGGAISLQKLLASNAITNENGVIYLDTSSAQSLLAHFGVADAGAHGDEEDEEEEGEDVHQGLAHEEEEEEEKEGSKIEEISEKIDDEV

SEQ ID NO: 73408 - protein, 798 aa, Arabidopsis thaliana
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAASVTLMFESNMVLQTLSSSSPPIHRLYLHHSQILPSSGSPSKISLQADTWKDFGHSIFSWFRLIALDYVFAEISARGLPALNKASLKKLPIKGSTFLLGQSLLMVSAHPQLAAAAEIIKPEPIYEVGELFELSIQLSYLLLLLGLLGVGTFYVIRQVLVRRELDLSAKELQEQVRSGDASATELFELGAVMLRRKFYPAANKFLQQAIQKWDGDDQDLAQVYNALGVSYVREDKLDKGIAQFEMAVKLQPGYVTAWNNLGDAYEKKKELPLALNAFEEVLLFDPNNKVARPRRDALKDRVKLYKGVVAVKSKKR

SEQ ID NO: 73409 - protein, 346 aa, Physcomitrella patens subsp. patens
MVKAVRVHAVGGRHHLQLEEVELPHPGCDEVEVRHRAIGFNYPDMEDCRGVGHHTSHSIFTPGLSAVGVITELGTGVLNHQIGQRVGYVNPPKKGAFSETSILPTNCLIPLPSNIADEEAAALLFPGLTAWMTLKKLKPLRRGDAVLVRNVTSGLGSIIAQWAKHFQAFVIGTVSSEDRVEHAKNNGCREVLVNRDEASSQCGFADEVRELTSGEGVDVAFDSIGNNTFMASLDCLAPKGMLVSLGAKGGDAPVLNLNYLAGKTSVVVAFPVLADYVKRKVDLLEGAQLLFELYKAGDLKVEIAKKVDLNMISKELDEMVEVEFQGSGSCILIPPIPTPEHYYSSK

SEQ ID NO: 73410 - protein, 262 aa, Solanum demissum
MIGVECRVCCERRLKVVKTLDRGVNLLGRGERKLPADYDPVTFDPTEHRSPPSERVWRLVDEVSGLTLVEVTEVSSIIMKRLGMTEQPTVGVMKAGAAELAAAMKGPEAAKEEKKPEKTVFELKLESFESAQKIKIIKEVRSSTDLGLKEAKDLVEKTPAVFKKGVSKEKAEQIIDKMKAVGAKMAKTQPSSRKRRMDEAIEDPDKICTSSRMMKNKSINFHMRTGNCTQFINEQDGQVTISRGALGPKEIDCSWVQIDRNE

SEQ ID NO: 73411 - protein, 320 aa, Triticum aestivum
MDRYQRVEKPRPEAAAISENEIRITTQGLIRNYVTYATSLLQEKRVKEIVLKAMGQAISKTVAITEIIKKRIPGLHQDTTISSVSITDVWEPIEEGLVPLEMTRHVSMISISLSPKELDTSSPGYQAPLHAEPLKPRYQQVQRYQQQHQPRQNQGQTDSYVRGRGRGRGRGWGGRGGYGGGYGGYDNNQGGYGGYSNQGGYGHNQGGYGNHGGYGHNQGGYGNQGGYGNQGGYGQNQGGYGGGYGYDQGGYGGYDNGGWNYNQNRGRGGGGRGRGNWGYSGPGYERGGRGAGGPGGPGGRGYVRGRGRMGPGRGRGNQNY

SEQ ID NO: 73412 - protein, 1248 aa, Solanum demissum
MFNKLLLVWFFVVTLVLGYVFSETEFEVLLEIKKSFLDDPENVLSNWSDKNQNFCQWSGVSCEEDTLKVVRLNLSDCSISGSISPSIGFLHDLLHLDLSSNLLSGPIPPTLSNLSSLQSLLLYSNQLTGPIPNEIGLLKNLQVLRIGDNVGLTGLIPSSLGDLENLVTLGLASCSLSGMIPPELGKLGRIENMNLQENQLENEIPSEIGNCSSLVAFSVAVNNLNGSIPEELSMLKNLQVMNLANNSISGQIPTQLGEMIELQYLNLLGNQLEGSIPMSLAKLSNVRNLDLSGNRLTGEIPGEFGNMDQLQVLVLTSNNLSGGIPKTICSSNGNSSLEHMMLSENQLSGEIPVELRECISLKQLDLSNNTLNGSIPVELYELVELTDLLLNNNTLVGSVSPLIANLTNLQTLALSHNSLHGNIPKEIGMVENLEILFLYENQFSGEIPMEIGNCSRLQMIDFYGNAFSGRIPITIGGLKELNFIDFRQNDLSGEIPASVGNCHQLKILDLADNRLSGSVPATFGYLRALEQLMLYNNSLEGNLPDELINLSNLTRINFSHNKLNGSIASLCSSTSFLSFDVTNNAFDHEVPPHLGYSPFLERLRLGNNRFTGEIPWTLGLIRELSLLDLSGNELTGLIPPQLSLCRKLTHLDLNNNRLYGSIPFWLGNLPLLGELKLSSNKFSGPLPRELFNCSKLLVLSLEDNSINGTLPLEIGELKSLNILNFDKNQLSGPIPSTIGNLSKLYILRLSGNSLTGEIPSELGQLKNLQSILDLSFNNISGQIPPSVGTLTKLETLDLSHNHLTGEVPPQVGEMSSLGKLNLSYNNLQGKLDKQYAHWPADAFTGNPRLCGSPLQNCEVSKSNNRGSGLSNSTVVIISVISTTVAIILMLLGAALFFKQRREAFRSEVNSAYSSSSSQGQKKPLFASVAAKRDIRWDDIMEATNNLSNDFIIGSGGSGTVYKAELFIGEIVAIKRIPSKDDLLLDKSFAREIKTLWRIRHRHLVRLLGYCNNSGEGSNVLIYEYMENGSVWDWLHKQPANNNKRKTCLDWEARLKIAVGLAQGVEYLHHDCVPKIIHRDIKSSNILLDSNMEAHLGDFGLAKAVHDNYNSYNTESNLWFAGSFGYIAPEYAYSSKATEKSDVYSMGIVLMELVTGRMPTDGSFGEDIDMVRWIESCIEMSREELIDPVLKPLLPNEESAALQVLEIALECTKTAPAERPSSRKVCDLLLHAFNDKVVHSDKMSPDNYV

SEQ ID NO: 73413 - protein, 309 aa, Zea mays
MGHRMFSPLGFFLLAIVVLYGGTEQRRAEAAEGASPHRMLATISVSKPSYPMVTTPMSAYGDPVSTPGTPYSTFPSLATGNGGAGAGAGAGGGAGVGGGGGGGAGVGGGGGGGGTWCVASQSASPTALQVALDYACGYGADCSPIQQGGSCFNPDTVHDHASYAFNSYYQKNPAPTSCDFGGTATITNTDPSSGSCQYPSSSGGAQSTMPPPSPTSMPPTVPTAPMTPTPMTPDTTPTTGTPVYGLSPPDYGSLSPPDSGSMSPPGYGSTSPPDYNDVGAAATTGQGGAALALALLCVLVATVSLHVSK

SEQ ID NO: 73414 - protein, 348 aa, Staphylococcus aureus subsp. aureus MW2
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGKDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 73415 - protein, 422 aa, Staphylococcus aureus subsp. aureus MW2
MTVKTTVSTKDIDEAFLRLKDIVKETPLQLDHYLSQKYDCKVYLKREDLQWVRSFKLRGAYNAISVLSDEAKSKGITCASAGNHAQGVAYTAKKLNLNAVIFMPVTTPLQKVNQVKFFGNSNVEVVLTGDTFDHCLAEALTYTSEHQMNFIDPFNNVHTISGQGTLAKEMLEQSKTDNVNFDYLFAAIGGGGLISGISTYFKTYSPTTKIIGVEPSGASSMYESVVVNNQVVTLPNIDKFVDGASVARVGDITFEIAKENVDDYVQVDEGAVCSTILDMYSKQAIVAEPAGALSVSALENYKDHIKGKTVVCVISGGNNDINRMKEIEERSLLYEEMKHYFILNFPQRPGALREFVNDVLGPQDDITKFEYLKKSSQNTGTVIIGIQLKDHDDLIQLKQRVNHFDPSNIYINENKMLYSLLI

SEQ ID NO: 73416 - protein, 628 aa, Physcomitrella patens subsp. patens
MTPLSSRFSAAQFGPNRTGPARNPRAGPGAGEKQFRTKESLANLVARWLRKYTHSLAHLLTHDDDDDEVMRSGREHRKQGSGFCMERGEGVERGEGEDRVEELLRDLSTHPHVAYMCLKAESSAMEEEKAAAYYNELLSKGRNAAMFKQGLGFGSSSSNAPAAKYGMINFVGAGKAAETRKEQEEDDDSRSREILKRGPEDGRSESKRSSEEREKMELKKNKCRSISRSMERRDRHRSTSIERRRSPSKDRLHSRRDRSGSRIRRHRENLRNPRRERSRRDRSGSRQRSRSRSRERSQRHYRDRSRSRSRDRSERYHRDRKSRSRSTSKGSGHRRRDVPRNRSRERSRHDYIHSKGRSKSRSSERRARDRSRDDDRKDQHRSDYRQEDSRLSPNRRLRRSRSNEERRKGISKRVERDQDWAKLIPDYDSLTPAEKVKAKMKLQLSQTVIKDSSKGVTEEWERFDFNKDAPLDGDAKQDYFGDGTGAANDTAQLDNLGASHLVFTEQARREAQLQAAHEAAIFGAPVVEDKGTKRRSTWRVREDTGPSKGYSGVDDDTHDNASTKVYGVVSEQIIALQTGSSWQDRIKKMRAAQAQDKPTLHASAFYMRNCGMYLKFINNNNPYHRQMQ

SEQ ID NO: 73417 - protein, 280 aa, Synechococcus sp. RS9916
MVAFLHLRGRMPDTGSPNQNRRGAEESQAPEAPKATILVVDDEPAVRRVLVMRLQLAGYRVICAEDGEQALEVFHSESPDLVVLDVMLPKMDGFAVCRRLRAESCVPIIFLSALEAISERVAGLDLGADDYLPKPFSPKELEARIASILRRVGRGSATAEPREIPVGQGVLRVGDLVVDTNRRQVTRGTDRISLTYTEFSLLELLFREPGRVVPRAEILEQLWGYPPRRAADLRVVDVYVARLRGKLEPDPRNPELILTVRGIGYASQRMGDLPQAAANG

SEQ ID NO: 73418 - protein, 688 aa, Oceanobacillus iheyensis HTE831
MNKGELLNERYKIIKKIGGGGMANVYLARDTILERDVAVKALRMEYIHDQEFIARFDREAQSATSLSHPNIVNIFDVGEEDQLLYMVMEYVDGMTLKEYIHQHGPIDVPEALDIMKQLTSAIAHAHANEIVHRDIKPQNILINSTGQAKVTDFGIAMALSATALTQTNSILGSVHYLSPEQARGGMATKKSDIYSMGIVLYELLTGKLPFSGQSPVSIALKHLQNNTPSVKKANPSIPQSVENIVLQATAKDPFHRYNNIYELEEALETALDPNRLDEEPFSLPEEVGDETKAIPIITDQDNVVDNNNEDTIIHATNQGTKNYPEEPHAKDNKKKKKGKVKKEQKKSKNKKPKSKKKKVFWIVFSILLLALLVTGITVFATQPKDIPMPDVIEMDSADAKQTLEESNLEVEEEEVFSDEIENGLVVRTDPNAGRTVKEGSTVTMFVSQGQERVEMEDYEGQDFEQVKELLEEEGFTDITSYEKSSEAPVGEIISQIQPEAGSEVVPGETKVIFEISSGPELVSLNNLTGMSKEEVQDYIDRNELTMNSHEEYSDNVDEGRVIRQEPPSGTDLEKGSTVDVYFSMGPEEIPPRSHTVSFTVNYEPQEEEGSENEDGNEEEQQPVEQIVRVYIGDVNNEISDVYEERAITEDEEFTFTLMVPPDSEAEYKVTRDDEVIKERSVSYEGEED

SEQ ID NO: 73419 - protein, 592 aa, Schizosaccharomyces pombe 972h-
MTTDVKEKATFKLLDLIDSVTGKKSLLLERDLSGILGQIVTTNTLQEHGIPQVYWFNENIPNDIEKKTIYLCRPTYENAKLVATHVRQFQRDMLRIESTVIVLPTSNILFETVLQEEGVFGELLVTEWPLHAVPLDKDLLSLELGPEKLEESLLQRSTDALIDFERTHGRFPRVSGRGPYAAKMLELLEKTYQEEATINFGKVEGEISALYDSVLLVDRSLDRITPFLTQLTYFGFLDEILGIQQMNVKLPSSLVNRNEASNTGPMKKFSLSSSSSQITKEIRDINFNCIGPYLSKIARKLSSDFEGRRQAKTVNQIRDFVSKLGSLQSEHTSLNIHTGLAETLVQHTKNNYFQKLLQLQHLLVSHADSFTQFNLLDEIIYAEAPVEEVFRVLCLASITTNGLRRKDIDHYRREITQTYGYYHLLTFQALIDAGLLRLRQSTNISLQKSLSYSTWLNTYPLVKDEVDEQNPEDIAYTYSGYGPLSVHIAYDILKGRDNEEKILKLQNMPGTYVDKWTLDQEKVMPKNLKTNVPGKRRVLVFFIGGCTYTELAAFRLLQEKEDLYEFTFMTTGMVTGSSLIRAFIPNIESLNE

SEQ ID NO: 73420 - protein, 218 aa, Oceanobacillus iheyensis HTE831
MTKIAPSILSADFAKLGQEIKEVEEAGADYIHVDVMDGHFVPNITIGPLVVEAIRPITDLPLDVHLMIENPDAYIPAFAEAGASIITVHQEACVHLHRTLQLIRSHGVKPGVVINPATPVEMIKPILAEVDLILIMTVNPGFGGQSFIQETTSKIKQLADWREKYKLSYEIEVDGGVNEKTAGICTTSGADVLVAGSAIFNHENRKQAIELLREKAKV

SEQ ID NO: 73421 - protein, 545 aa, Candida albicans
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 73422 - protein, 237 aa, Arabidopsis thaliana
MSSQICRSASRAARSLLSSAKNARFFSEGRAIGAATVVHATGKVPQYASNFGKSGSGFVSNSWITRLLALPAAAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTSNAEKWIYGQN

SEQ ID NO: 73423 - protein, 242 aa, Oryza sativa
QGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLKKQPC

SEQ ID NO: 73424 - protein, 289 aa, Glycine max
MSLNQVPVKRKKAEWCDKNTEIMLKVCIEEVNVGNKPHNHFTKLGWANIAEKFNKATNLRYEYKQFRNRWDSLKKEWQLWAKLIGKDTGLGWDGEKKTIAASDEWWEAKIQEDPEVAKFREQGLKFLPEMEFLFKGTIATGFAAYAPSEDSRQYEGFNTRTEETNDNIDDNTDMEVNEPEIDTTTQNTSSAKENGQRKRGREGDKKIGVAAKLSSQLDRIIQTFESSVSAQDPTSITTCVAKLKDLPGLERGSELFYKATKLMKKRANRITFVALEEPELQLGWIKSET

SEQ ID NO: 73425 - protein, 244 aa, Zea mays
SRLVPVRNSRDPTLAPTRCAAPRDAGPRRRLPRQGPRLVLRPPARLRRSAPEGSMKSRIHSFGLKLLSRVRPSEVLLKSVTKDVSALEIVHPASINSRLVRRRLRHIAVRGASVHKKFLYGSVCLLPVTSVFMVLPLPNIPFFWVLFRAYSHWRALQGSERLELLVSDCSDKWKVLEEKINSVKDGKPSENARNSPWKLRPSEKLDRFLEGRNLDEGLDCDTILSICQEYDLDKIDVLKYRDLL

SEQ ID NO: 73426 - protein, 426 aa, Yersinia pestis KIM
MTPSDLVFDQQHIWHPYTSMTEPLPCYPVVGAEGVELQLADGRRLIDGMSSWWAAIHGYNHPVLNFAAHQQLDKMSHVMFGGITHPPAVKLCRQLVAMTPPPLECVFLADSGSVSVEVALKMALQYWQAKGERRQRILTLRHGYHGDTFGAMSVCDPQNSMHSLYQGYLAENLFANAPQCGFDDPWDPQDIANFVALITQHANEIAAVILEPVVQGAGGMRIYHPSYLREVRALCDKHQILLIADEIATGFGRTGKLFACEHAQIVPDILCLGKALTGGYLTLSATLTTRAVAETISKGDAGCFMHGPTFMANPLACAVASANLSLLAENSWQQQVSKIEDQLKRELLPLAQEDTVADVRVLGAIGVVEMKKPVNVARLQRSFVEQGVWIRPFGKLIYLMPPYIISQHALTRLTAAVAAAVVDRGS

SEQ ID NO: 73427 - protein, 287 aa, Phaseolus vulgaris
MAATAAGIASLFSSSINSVKCLRSKHCSMMDPLMTAMLSNRIFAPVSHLVVEPLSIGGTTSHRLWGPRISAAVAQEEVVVVDDAGLVEEEKVEENEGEEVVAEQDSDESFASTKLYFGNLPYSVDSAKLAGLIQDYGSAELIEVLYDRDTGKSRGFAFVTMSCIEDCNAVIENLDGKEYLGRTLRVNFSNKPKAKEPLYPETEHKLFVGNLSWSVTNEILTQAFQEYGTVVGARVLYDGETGRSRGYGFVCFSTKEEMEAALGALNDVELEGRAMRVSLAEGKRAQG

SEQ ID NO: 73428 - protein, 246 aa, Debaryomyces hansenii CBS767
MFMAKRAFTAPFMRFPQISRSIINSTRNLFIQTMETPNEHALKFLPSMQIMKENETREFLSGREAACSPLALKLFSIDGIKSIMFGSNFITIEKANEDLHWSLLKPEIFSILTEFLNNGTPILNEESELTDDMEISEDDDETVTMIKELIFTRIRPAIQDDGGDIEFVSFAEDNGTVYLRLKGACRSCDSSSVTLKNGIESMLKYYIEEVTTVEQVNDEDTTEIVEKFKSEDIHLKPSPRDDPPSL

SEQ ID NO: 73429 - protein, 578 aa, Triticum aestivum
MGGGNGIVDGFRRLFHRRTPSGSVLGSSNQSSAGEDSSDVEAAEGLDLVGLRSIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGTVSPQKSQDAAGVGQNGLSPTSLSSRTYLKSASISASKCVVVNPNKQPEYDDAISEETEGAVDGLSEKVSKMHA

SEQ ID NO: 73430 - protein, 337 aa, Oryza sativa Japonica Group
MHLSPWQWRSTNSPRIESLLRTQIKSYTYSEVRKMTKSFAHTLGKGGYGTVYKGSLSDGSEIAVKMLEDTKDDAEDFINEVVSIGRTSHINVVTLLGLCLHRSKRALVYEYMPNGSLDKYAVGVVDTVQGEKSLSWEKLYEILVGIAQGLDYLHRWCNHRVVHLDIKPQNILLDQDFRPKISDFGLAKLCKPKESKISIGGARGTIGYMAPEVFWRHHGAVTTKSDVYSYGMLILQMVGARENTNASMQTVSKYFPEWLYDNLNQFCGAATEGIDSRNTCISEVARKLVTIGFWCIQCTPEDRPSMSEVIDMFDRSMHELQLPPRMSCCGIDNPSIV

SEQ ID NO: 73431 - protein, 182 aa, Thiomicrospira crunogena XCL-2
MLCHKYKKLIMKQHPLAQYLEAVPDFPKEGILFQDISPLLRDHFVATIDAMSLLFSAKEWAEVDYLVGVESRGFIFASALALKHDKGFVKVRKPGKLPNVHASMEYGLEYGTDKLEMQKGNGKKVIICDDLIATGGSMQAAAKLCNEVGYEVVGMACLVDLKALNSFSHDGMTVRSVIQFDD

SEQ ID NO: 73432 - protein, 323 aa, Frankia sp. EAN1pec
MSTVAPPGVDAPTFDCRVDFAAELAALARVDERIVAVCNDSVGSSNLGAFRDEFPDRLINVGIAEQDLVGVGAGLANAGMVPFVCAAAPFLTGRATEQIKADVAYSERHVVLCGHSPGMAYGELGPTHHSIEDLAWMRAVAGLTIAVPADPAQTRAAVLWAAGYGRPVYLRIPRFKVPEVSRQGDPFLPGRAVLLREGSDVTLAAVGSMVSRAIWAAQILADDGISARVLNMTFVEPIDRDALISAAEQTAGIVTVEEATTSGGLGAAVAAVVGQTRPCPLRILGVPRQFAPTGSTQFLLDHFGLNADGIVGAAREVVGGTRA

SEQ ID NO: 73433 - protein, 892 aa, Arabidopsis thaliana
  misc_feature (817)..(817): Xaa can be any naturally occurring amino acid
MYYHSLSSYSILFFLFSLFHHLPCASSNQGLGWCESLFQCGNITADFPFWGGNRHKPCGHPLLELHCNNNNITSLYISNQEFYVRQINQTSNTLTLARSDLLGSFCSSYAYNTTTLPPEIFELSPTYKSLTVLYHCDPKLSYRSSYTCPALGTFSMSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDDGFFRRHRRFIATLVRYTFIALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCREGSRRAIIYEFLGNGSLDKFISDKSSVNLDLKTQYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLXGLWCIQSSPSDRPPMNKVVEMMEGSLDALEVPPRPVLQQISASSVSDSFWNSEESSSASDILVFSTNSKLESSSL

SEQ ID NO: 73434 - protein, 819 aa, Fusarium oxysporum f. sp. phaseoli
MDGPGYTSASSASAHTATSHRRKLIKKPPTYAYARSSSGFDGGAFDAQSLESKRSSQSLRRAPSAPPARSNPATVSDWQDSDRSHPQLSANSNTLRPVPSPISPQGDFTPANHWAPVPRHPDRLSDSHLRPLSKTAVPDDLIGAPFDGAAILNRIESIKIPSPKAAAPRQFPPQIVKAPTDSRLASPALRTSTSFSAMDSSLNEKSLGGPRAPTDGPSVNPKRYSDDGKDLKPAVLRKKSGFSGFMNSLVGSPKKPVISAPENPVHVTHVGYDSSTGQFTGLPKEWQRLINESGIPEKERRENPQTMVDILQFYKETTERPPEDQVLEKFHHAGQYATSPATAASPGMYPSNYMGSFENPRAPPPVPRGQVGKDLMPSRPAPKPPVSMSNRHMPQGAYSTKDSGIGMSQSGDESYGISKDAGPMLPEEHRSRSNSRVTGPTYAPTAPQPNPQLAQAQAAAYQQQLMQQQQEQAMAQAQAAMSGGIGRAPSKRTPHPQNPNMQAAPGYGRAPESNGMHNAPRQQAPGAAVPGARPRHRARQSAGLDIVAALKRICSEGDPRDIYRGFNKIGQGASGGVFTGHERGTNRLVAIKQMNLEQQPKKDLIINEILVMKDSSHPNIVNFIDSYLCGGELWVVMEFMEGGSLTDVVTFNIMSEGQIASVCRETLLGLQHLHSKGVIHRDIKSDNILLSLEGKIKLTDFGFCATINEAQNKRTTMVGTPYWMAPEVVTRKEYGRKVDIWSLGIMAIEMIEGEPPYLTESPLRALWLIATNGTPHIKNEQDLSPVFKDFLYFALKVDPEKRASAHDLLRVSPQCSPVK

SEQ ID NO: 73435 - protein, 677 aa, Magnaporthe grisea 70-15
MPRRRLNPFQILTAFFQPSTADSDGESFKKPRRTERAAHKAEESTAQPKTPVDTKQQLPSPITHNPTEGSFDAYKEGTVTPPEGRPSQVAHRSPVQGFSSPPQDTQATQAIPSQIVDPKAALSDEVEDEVKEGVWGYLFPLDTRYGGKCVVLRKRGSCPMPDTNGKSDDKPCDKASKDIVVDDPIVSNRHCLIFAEHKGNDTVVILEDLSSNGTFVNEAIVGRNQRRELLEQDEIAVKDTARFIFRYPKYRQTSAFSQQYTLLGKLGKGHFAEVFACVEKSTGQRYAVKIFSMVPGLEERSRTEGLQLEIAVLMGVSHPNVLCLKDTFHEGNAVYLVLELAPEGELFNFIVMKQKLSEAESRKLFTQLFHGVKYLHDRNIVHRDIKPENILLVDKDLHVKIADFGLAKIIGEESFTTSLCGTPSYVAPEILVDGRHRKYTKAVDVWSLGVVLYICLCGFPPFSDELTSESFPYTLTQQIKNGIFHYPSPYWDSVGDPALSLIDCMLVVDPEKRYTIDQCLAHPWMTQAQPSVHDSTDGLVGGFAGLEVNRRGIVRERTLLSSINSVQVTRVPAGPNQEPVKVFIKNPKDGKANRAPEPGPSQNRRPDEFIEMGGKGDQPLFGHDGGSNYPSADIASQKTAISQPALNGAETSKDDEVKEINANGKTKPTAAGKGKEH

SEQ ID NO: 73436 - protein, 381 aa, Chlamydomonas reinhardtii
MAFGLLGAALAPGLAEPGSALGLWDFSVAGWVALLLLLLRRVYDITFTPWLARRLLARPADGTILGAEAVEPACDVAPSPAGPVARTWDSASERDEEEKAEDVPTAVPAGGARLRRMVPRGDEVMAASSPGGKPATAAATSSTPAPAAASVDTETAEAVHKRAAATADSMWIAALNLALVLGAWWVIATHNGGCTPWSTWDCFGHWPNHPVMMSQRWYIVLSFAYYLYELAGTVLGCGTKLKNDMVAHHIVTMALLVLGYVTNIIRMQVTWQALFDISNPILHTAKALNASGVKAVARLKWGVFILFALSFLVCRVLAGPYSIIWPSFTVAPQWLPPSLCYPCWALMIFVYILQLIWFYKIVEIAVKGDKAVRKHTAVAKR

SEQ ID NO: 73437 - protein, 261 aa, Xanthomonas campestris pv. campestris str. ATCC 33913
MELRETVIAIARQAGDAIMEVYAQDFAVEIKADASPLTQADLAANRVIVEGLRRVTPDVPVLSEESVHVAWEERQYWTSYWLVDPLDGTREFVKRNGEFSVNIALIHMGAPVLGVVQAPVDGRVWYAARGENAYRRDGDRDEMLHSRTPAAAPLRVAASRSHRDARTAAALERMGQIDVVAQGSSLKFCRIAEGELDVYPRFGPTSEWDTAAGQCVLHAAGGALLAAGTGKPFRYNRRDTLLNGDFIALGDPGLPWRDWLV

SEQ ID NO: 73438 - protein, 94 aa, Triticum aestivum
MASGQEKGRSELDSLAREGQTVVPGGTGGKSYEAQEKLAEGRSRGGQTRKEQMGEEGYSEMGRKGGLSTNDESGGERAAREGIDIDESKFKTKS

SEQ ID NO: 73439 - protein, 335 aa, Nitrosomonas europaea ATCC 19718
MNVLVTGGAGYIGSHTCVELLTAGYEVVIFDNFCNSHPEALRRIEQITSKKITIVTGDIRNQVAIEKALKDYGCEAVIHFAGLKAVGESVEKPLEYYDNNVIGTHRLLAAMQNCGVYTLVFSSSATVYGEPQRLPLTEDHPLSATNPYGRSKLIIEEMLRDVYRADPRFRIAILRYFNPVGAHDSGLIGEDPQGIPNNLMPFVAQVAVGRREYLNVWGSDYPTHDGTGVRDYIHVVDLALGHLGALDYLTVPQCMAINLGTGIGYSVLDVIKAFEEASSRQIDYRLASRRSGDVAACYANPALAEKLLRWKAQRDLAVMCRDHWRWQKNNPAGYV

SEQ ID NO: 73440 - protein, 203 aa, Shewanella sp. MR-4
MSIKYVATSKLPTPWGVFAMHGFEDTETGKEHVALTFGTLSSDAPVLGRIHSECLTGDALFSLRCDCGFQLQTAMQNIAETGSGFILYLRQEGRGIGLLNKIRAYELQDKGANTVEANEQLGFPADMRKYDMIQPMLEQIGVKHVRLMTNNPRKVKAMKEIGIEVVERVPLQVGKNRYNEAYLKTKSTELGHMMSEYHFTDED

SEQ ID NO: 73441 - protein, 308 aa, Zea mays
MPPAGELQHSPGNQSNDTQPSESEATAEIFAAAADAEAAGLWTQIKAEARHDAEEEPALASYLFSTILSHSSLERSISFHLGNKLCSSTLLSTLLYDLFLNTFTSDPSLQNATVADLRAARVRDPACISFSQCLLNYKGFLAIQAHRVSHKLWTQSRKPLALALHSRVSDVFAVDIHPAAKIGKGILLDHATGVVIGETAVIGNNVSILHHVTLGGTGKACGDRHPKIGDGCLIGAGATILGNVKIGAGAKVGAGSVVLIDVPPRATAVGNPARLVGGKEKPTMHDEECPGESMDHTSFISEWSDYII

SEQ ID NO: 73442 - protein, 664 aa, Aspergillus fumigatus
MFHSRALLLSWLVGFTAAKDIHLDWNITWVWAAPDGFGRPMIGINNEWPCPIVNADLGDRLIVDVHNGLGNQSTGIHWHGFHQYMTGTMDGSNQVTQCALPPGSSMRYEFDVNQTGTYWYHSHEMGQYPDGLRGPFIVRDPSPPFAYDDEFTLTLTDHYHEQMSVLLQQYEADSVGAQAGVNEPLPAAALINEGFDTTTLRVEPNKTYLIHLVCVGNWPGHVIVFDDHEISVVEVDGTWVDAYPARDKKIRLATGQRMSILLKTKDNTDRNYAIWDSMDVNMMFFYQNRAIPEGFNPNTTAWLVYDEAKELPPAPDVHELDPNNDFVDDLVFVPASHEPLLEKVDRQIIFDTGVTQRDGRSVYTINGQTYVDPEEPTLYTALAASPENASNASIYGQVNPFVVQYGEVVEIIINNHHGNLHPWHMHGHQFQVLQRTIPEGGYFDGYFANISSTPVKRDTIMVQNHGHAVLRFRANNPGVWLIHCHIEWHVTKGLTGTLIEAPAQMHKISVPLDHQRICPSYGTPPGGTPSSPPHDAPRPDGASGSPQYPPKPWGEPDASAPEQDDSQPGGTPDSPEDFPQPWGEPEESPQEPPQPWSPSNNAQPPANTYAPEYPSGYVPVAPGPVIIDSELHYGGKSSHVECSGVNAGHTQDTTTGGDGCANAS

SEQ ID NO: 73443 - protein, 347 aa, Populus sieboldii x Populus grandidentata
MMVDKAMHPLVASLFIVIWFGGSLPYAYAQLSPTFYDEACPNVNNIIRGVLVQALYTDPRIGASLTRLHFHDCFVNGCDGSILLDNTDTIESEKEAAPNNNSVRGFDVVDDMKAALENACPGIVSCADILAIAAEQSVCLAGGPSWTVPLGRRDSLIANRSGANSALPSPFASLDVLKSKFAAVGLDTSSDLVALSGAHTFGRAQCSSFNLRLYNFSGSGNPDPTLNTTYLAELQQLCPQAGNESVVTNLDPTTPDTFDGNYFSNLQTNEGLLRSDQELFSTTGADTIDIVNNFSSNQTAFFESFVVSMIRMGNISPLTGTDGEIRLNCRRVNDNSTGSNALLVSSI

SEQ ID NO: 73444 - protein, 343 aa, Populus sieboldii x Populus grandidentata
MKLSKLMVVALFYAFLVGGPLAYGQLTPTFYDETCPYVISIIRGVIAETLIFDPRIGASLIRLHFHDCFVNGCDGSILLDKTATIDTEKEALANNNSARGFDVVDIMKERLEGVCPATVSCADILAIAAEESVVLAGGPWWPIPLGRRDSLTANRTAANAFIPGPQDTLERLRSRFTVVGLNNNTDLVALSGAHTFGRAQCRNFIDRLYNFNNTGLPDPTLDTTYLATLQRLCPQGGNGTVLADLDPTTPDGFDNNYFSNLQASKGLLQSDQELFSTPEADDIIELVDIFSTDETAFFESFVESMIRMGNLSPLTGTEGEIRLNCRAVNADLAGKDSVLVSSV

SEQ ID NO: 73445 - protein, 395 aa, Zea mays
  misc_feature (161)..(161): Xaa can be any naturally occurring amino acid
MQDMKPAAAAVAKVVAGDSPPSAASPAPAPAVANSNGTPQKPPPIPAAAFDMPKPNLRGLNKPKCILCGNIARSRCPFQCCKSCCYKAQNPCHIHVLKQTNTLPDKPSPATAPATTEQQSNNLPATSSASRLAALQKLPQHFLKFLQTKKSVTKKGHCLFXDVAGINKWRFMKLKEHMQGDTDAENEAYERYTQNVGLLEEAFCPMEEDADVDPEAEATSSSEEERMDLLVSAAKARLKSDNEAANSFRERVATILDQKLKDLRGSQSASEGDEPSGPSLDDRLTPTPMKFSTAQKMGRATELNELLGKLTGARSEDDLKPCRDIAEQLFGKENGSSVGNSNRVDTETEPGDQESAAAVARRYSVPTLCSRMEVGEDFASEMNDEFCSLTQVAQL

SEQ ID NO: 73446 - protein, 70 aa, Arabidopsis thaliana
MEIARKVMEEFLEIWNEALAKRSLPGKFVNKDLNFGEFGLGDNYTPQHTAVRNYALVMAHMIATVQAVSG

SEQ ID NO: 73447 - protein, 567 aa, Arabidopsis thaliana
IVLVVAVLTHTASAAVREYHWEVEYKYWSPDCKEGAVMTVNGEFPGPTIKAFAGDTIVVNLTNKLTTEGLVIHWHGIRQFGSPWADGAAGVTQCAINPGETFTYNFTVEKPGTHFYHGHYGMQRSAGLYGSLIVDVAKGKSERLRYDGEFNLLLSDWWHEAIPSQELGLSSKPMRWIGEAQSILINGRGQFNCSLAAQFSNNTSLPMCTFKEGDQCAPQILHVEPNKTYRIRLSSTTALASLNLAVQGHKLVVVEADGNYITPFTTDDIDIYSGESYSVLLTTDQDPSHNYYISVGVRGRKPNTTQALTILNYVTAPASKLPSSPPPVTPRWDDFERSKNFSKKIFSAMGSPSPPKKYRKRLILLNTQNLIDGYTKWAINNVSLVTPATPYLGSVKYNLKLGFNRKSPPRSYRMDYDIMNPPPFPNTTTGNGIYVFPFNVTVDVIIQNANVLKGIVSEIHPWHLHGHDFWVLGYGDGKFKPGIDEKTYNLKNPPLRNTAILYPYGWTAIRFVTDNPGVWFFHCHIEPHLHMGMGVVFAEGLNRIGKVPDEALGCGLTKQFLMNRNRN

SEQ ID NO: 73448 - protein, 374 aa, Xylella fastidiosa Temecula1
MTEHAILVLEDGTVFEGDAVGANGLSVGEVVFNTALTGYQEILTDPSYAYQLVTLTYPHIGNTGCTDQDDEANKVWAAGLIVRDVPRRPSNWRSQISLSDWLAARGVVAIAGIDTRKLTRILREKGAQHGALMAGEIDVGKAQDAAHQFAGIKGMDLAKVVSTKQGYSWYEGQLDLDRNECKRAAPQYKVVAYDYGVKLNILRMLAERGCDLTVVPAQTPADEVLALCPDGVFLSNGPGDPEPCDYAVAAIKTFIMRRVPIFGICLGHQLLAQAVGARVVKMSHGHHGANHPVQDLRSGRVMITSQNHGFAVDEATLPNNVRVTHRSLFDGTNQGIELLDVPAFSFQGHPEASPGPHDVDVLFDRFITMMAAQS

SEQ ID NO: 73449 - protein, 400 aa, Nostoc sp. PCC 7120
MSKKTVASLSAADISGKRALVRVDFNVPLDDQGNITDDTRIRAALPTIQDLTQKGAKVILASHFGRPKGVDEKLRLTPVAKRLSELLGQEVIKTDDSIGDEVAAKVATLQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIENIPDGWMGLDIGPDSVKVFQAALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 73450 - protein, 195 aa, Zea mays
IKAAAAKPFFSPRPAARIPAPSPHPPPPPASARGLCAPPHSGGEGMGSDAGAGARKRRDPAVNGLAKDVPPPATAPPRLLTLPTVLTIGRVAAVPLLISTFYMEGPWAATATTGIFLAAAVTDWLDGYIARKMQLGTPFGAFLDPVADKLMVAATLVLLCTKPLETSLLNDGPWLLTVPSIAIIGREVVTLPICI

SEQ ID NO: 73451 - protein, 365 aa, Picea sitchensis
MASAAAENSELNMKIVNDDEWLLCMELGNFSCLPMAMKAAIELDVFQIIANAGNGVQLASTQIVARIQTTNPDAAISLNRILKVLASHSVLSCSVTMDENGKAECLYGLTSLCKYLVKNRDGISLAPWVLMNQDKVFMESWHYLKDAVLEGSQPFTKAHGMNVFEYLAMDRRFNKVLNRTMSEHSTTLMCKILDMYQGFKYVQKLVDVGGGVGSTLNLIVSRYPHITGINFDMSHVVSEAPHYPGVTHVEGDMFDSIPTGEAIFMKWILHDWSDDDCVKLLKNCHKAFPEKGKVIVVDTILPMAAETSPYARHAFHLDLLMLAYSPGGKERTEQEFRELGHAAGFTGGVQLICCVDGVWVIEFHK

SEQ ID NO: 73452 - protein, 547 aa, Oryza sativa Indica Group
MERMSRVAVAVLLLLCLQLQLGISGGGGGGHGARRDDQLVQECSGFCLADLCVRPAARLIHAKKSSSSSQQQQQRSRHAGSKAGWPSTSSTPSNPFGLPMLLPPPPPLKDWPPWLDMPPVQGPSSSPSPSPSPAPSPASSAAVAEHAAPPRRGEEHARPRSIALPPASSSGDAGETSRPEVTDGSATRRGGGGGKTNYVLVAAAGASVLLAASAAAFAACYRSSKVVRSVRPWATGLSGQLQRAFVTGVPALRRAELEAACEDFSNVIGSLPEYTMYKGTLSSGVEIAVVSTTKTSPKDWSKKCEAHFRKKITSLSRVNHKNFVNLLGYCEEEQPFTRMMVFEYAPNGTLFEHLHARDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 73453 - protein, 77 aa, Oceanobacillus iheyensis HTE831
MAEVFDRVKEIIIDRLDVEESKVTMEASFKDDLDADSLDVVELVMELEDEFDMEIADEDAEKINTVGDAVDYINSKA

SEQ ID NO: 73454 - protein, 193 aa, Solanum ochranthum
FVFAGVGSAIAYGKLTTNAALDPAGLVAIAVCHGFALFVAVSVSANISGGHVNPAVTCGLTFGGHITFITGSFYMLAQLTGAAVACFLLKFVTGGCAIPTHGVGAGVSILEGLAMEIIITFGLVYTVFATAADPKKGSLGTIAPIAIGLIVGANILAAGPFSGGSMNPARSFGPAMVSGNFEGFWIYWIGPLV

SEQ ID NO: 73455 - protein, 660 aa, Sporobolus stapfianus
MVGMRVPYGGSYTNNGSNESQPPGAAPEVPAMVEVHKVVPPPPQSTASKLKTRLKETLFPDDPFRGFQGQPARVQWVLAVKYLFPILDWLPAYSLSLFKSDLIAGLTIASLAIPQGISYAKLANLPPLIGLYSSFVPPLVYAVLGSSRDLAVGPVSISSLIMGPCCASRQPHCGADAVPAARLHATLFAGIFQASLGILRLGFIIDFLSKATLVGFMAGAAIIVSLQQLKALLGIVHFTTEMGIVPVMASVFHHTKEWSWQTILMGVCFLVFLLVARHVSIRWPRLFWVSACAPLVSVIISTLVVFLFKAQNHGISIIGQLKCGLNRPSWDKTNIDTTYLGLTMKTGLVTGIISLTEGIAVGRTFASLKEYQIDGNKEMMAIGLMNVVGSCTSCYVTTGAFSRSPVNHNAGCKTAMSNVIMALTVMVTLLFLMPLFVYTPNVVLGAIIIAAVIGLIDIPAVYHIWKMDKMDFLVCVCAFAGVLFISVQEGLAIAVGISVFRVLLQITRPKITVQGNIMGTDIYRNLHQYKDAQRIPGFLILATEAPINFANSNYLNERIKRWIEEESSAQTKQTELRFVILDLSAVPAIDTSGVAFLIDIKKSIEKRGLELVLVNPTGEGHGKNTASERGTQAFQVGIACILTTGEAVASLSALAKMASP

SEQ ID NO: 73456 - protein, 85 aa, Glycine max
  misc_feature (37)..(37): Xaa can be any naturally occurring amino acid
  misc_feature (52)..(52): Xaa can be any naturally occurring amino acid
MASSMISSPAVTTVNRAGAGMAAPFTGLKSMAGFPSXKTNDDSTSIATNGGXVQCIHVWPPIGNTKFETPSDLPDLDDAQVAKEI

SEQ ID NO: 73457 - protein, 496 aa, Synechococcus sp. RS9916
MGQDLPKSAKASVSTPLIPVILCGGTGTRLWPLSRASYPKQYWALGGSGDDTLLQQTQQRLEGLEDLANPLVICNEDHRFIVAEQMRQIGIKPSAILLEPMGRNTAPAVAIAALQATSRGEDPLLLVLAADHVIRDGAQFRTTVEAGRAAAEAGQLVTFGIVPTAPETGYGYIEATAPLQAGTLSPTPIARFVEKPDRAKAEGFLATGRFTWNSGMFLFRASAMLAELERLAPEVVSCCRAALEQDAADLDFRRLDKSAFARCPNVAIDVAVMEQTQLGAVLPLDAGWSDVGSWSALWDTSDKDSEGNVLRGRVISEGSSNCYLRSEHRLVVGLGIDNLVVVETDDAVLVASRDQAQNVKRVVGQLEADGSPEGKAHRRIYRPWGHYTGVMEGSRWQVKRISVKPGASLSLQMHHHRAEHWVVVRGTALVERDGEEQLVGENQSTYIPMGCHHRLSNPGRIAVEMIEVQSGEYLGEDDIVRFDDVYGRSDQKSIAS

SEQ ID NO: 73458 - protein, 533 aa, Mycobacterium sp. MCS
MSASLLAVLVVAVLLAAVARRADVSAPLALVVAGLAVGLIPGVPDIQLDPDLVLYVVLPPLLWSAGLESSYVALRRNVRSIGMLAVGLPLATTFAVGVVAYWAVPELTIAAALTLGAIVAPPDAVSATAVGRRLGLPRRLMTLLGGESLLNDATALTAYKVALGLAIGGSASWTGGLWTFALAAVGGVVGGGALGAVIVYVRSRLRDPLVESALGLVAPFGIYLLAEEVHGSGVLAVVVAALILGQHSTNASYATRLQDSAVWKAVQLLLESFAFLLIGLQLPKVIEELAGISAAVLVVSSLAVLATVIAVRIVWVYLFAYLPRLVSPALRYREPSPRPAQVFVVAWAGMRGVVSLAAAFAVPATTLSGAEFPGRPQLVFLTFVVVVGTLLLHGLTLPWLIRRLGVQGDEAHTDAVAAAAAQDRAARAAAERLDELLEQQRTDGTVDDVHERAAEVLRGWNTRRRNSAWEQLGRDEADIGESPAAAFRRLRLEMLAAERATLIAERDSGHIDDEVLRSVLHGLDLEEATLNRR

SEQ ID NO: 73459 - protein, 297 aa, Brassica napus
MGLGKRVYGLCIVSLVLMAVVTMATIEEEAAKDESWTDWAKEKIGLKHEEHNVPTTHTTTTVQDNVYGATDKAKDAKEAARRKAEEAVGTTKEKAEGAYETAKSKAGETIGSVKDKASQSYDSAGQVKDDLTHKSKQVKDSLSGDNSDESWTDWAKEKVGIKHGDDESYPNVGDTVSEKAKEAKDAAKRKAGDAKVRLEETVEAAKEKASDLTSAAKEKAERLKEEAERESKSAKDKSKESYETAKSKADETLESAKDKSSQSYDSAAKKTEQAKDSVSHKSKKVKEDTLNDDDAEL

SEQ ID NO: 73460 - protein, 356 aa, Nitrosomonas europaea ATCC 19718
MKIALLAGDGIGPEIMAQAERVLRYFQQEGLQIELEPGLLGGCAVDATGEPFPEATRQLAIEADAILLGAVGGTQYDGLPREKRPEQGLLAIRKELNLFANLRPVVLYPELSNASTLKPEVVAGLDILIVRELTGDIYFGRPRGIEYRDGQKVGFNTMIYSESEIRRIAHVAFQAAGRRNGRLCSVDKMNVLECTQLWRDVVTETAQSYPDVTLSHMLVDNAAMQLVRNPRQFDVVVTGNMFGDILSDEASMLTGSIGMLPSASLDDRNKGLYEPIHGSAPDIAGKGIANPLATILSAAMMLRYSFNQETAASRIEHAVQKTLQQSYRTEDIYEAGMKKVGTVEMGDRVLANLQSR

SEQ ID NO: 73461 - protein, 379 aa, Schizosaccharomyces pombe 972h-
MSKGPGDFKKSWNGFAAQTPQNTPSSDVHLSKAALEKARQTLQSQLEDKSAHDEVSGLLRNNPAMLSMIEGRLSSLVGKSSGYIESLAPAVQNRITALKGLQKDCDAIQYEFRQKMLDLETKYEKKYQPIFSRRAEIIKGVSEPVDDELDHEEEIFQNNLPDPKGIPEFWLTCLHNVFLVGEMITPEDENVLRSLSDIRFTNLSGDVHGYKLEFEFDSNDYFTNKILTKTYYYKDDLSPSGEFLYDHAEGDKINWIKPEKNLTVRVETKKQRNRKTNQTRLVRTTVPNDSFFNFFSPPQLDDDESDDGLDDKTELLELDYQLGEVFKDQIIPLAIDCFLEEGDLSDFNQMDEEDSEDAYTDEEDLSSDDEEILSSEISD

SEQ ID NO: 73462 - protein, 286 aa, Chlamydomonas reinhardtii
MATMHPLLKRVLHDFIAPNILQPHSTPSLEDFVVTIWIAIAILIVRIIFERAVIPGFRAYLERIKGPGQGKAAFAILDNMWIAAFAGGLTGFAWWVTVFQNGGCTPWSTWDCFGHWPNHPVMLSQRWYMVLSFAYYLYELAGTVLGCGTKLKLDMVAHHLATMTLTILAYTTNLKRMSVMWQALFDISNPILHTAKALHASGVKALEPVKWAMFNLFALSFLVCRVLAGPYSILWPSFTVAPQWLTPAICYPCWALMVFVYVLQLIWFYKIVEIARKGDKAAEKED

SEQ ID NO: 73463 - protein, 168 aa, Bacillus sp. YN-1
EFIEVSEESFKGQWSVLCFYPADFTFVCPTELEDLQNEYAALKELGVEVFSASTDTHFTHKGWHDSSETIGKITYAMIGDPSQTLSRNFDVLNEVSGLADRGTFIIDPDGVVQAAEINAEGIGRDASTLVNKIKAAQYVRNNPGEVCPAKWQEGDETLKPSLDLVGKI

SEQ ID NO: 73464 - protein, 392 aa, Prochlorococcus marinus str. MIT 9515
MKAMILAAGKGTRIQPITHIIPKPMIPILQKPVMEFLLELLKEHGFKEIMVNVSHLAEEIENYFRDGQRFGVEIAYSFEGRIEDGEMIGDALGSAGGLKKIQDFQNFFDETFVVLCGDALVDLDLTEAVRNHKQKGALASLITKKVTREQVSSYGVVVSDENGRVKAFQEKPTVDTALSDSINTGIYLFEPEIFDYIPSGEKFDIGADLFPKLVEMDLPFFALPMDFEWVDIGKVPDYWSAIRNVLLGKVRQVEIPGKEIKPGVFTGLNVAANWDQVDIKGPVYIGGMTRIEDGATIIGPSMIGPSCCICEGATIDNSIIFDYSKIGKGVQLVDKLVFGRYCVGKNGDHFDLKDASLDWLITDSRRLDLTEPSPQQKAMAELLGSDLINIPD

SEQ ID NO: 73465 - protein, 1399 aa, Vibrio vulnificus YJ016
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADEHGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAIRLVADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYALDKVELVTGVKADDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVVDITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 73466 - protein, 278 aa, Yersinia pestis KIM
MIRLIERSQRTCSLKYDGHIPNLIGVNVMAVTKLVLVRHGESQWNNENRFTGWYDVDLSEKGRSEAKAAGKLLKDEGFTFDFAYTSVLKRAIHTLWNILDELDQAWLPTEKTWKLNERHYGALQGLNKSETAEKYGDEQVKQWRRGFAITPPALEKSDERFPGHDPRYAKLTDAELPTTESLALTIERVIPYWNDVIKPRIASGERVIIAAHGNSLRALVKYLDDLGEDEILELNIPTGVPLVYEFDENFKPIKHYYLGNADEIAAKAAAVANQGKAK

SEQ ID NO: 73467 - protein, 491 aa, Zea mays
  misc_feature (263)..(263): Xaa can be any naturally occurring amino acid
MSMDYLAAAVPVTLALGVGSILLVLRWTYCRRRTSAEEVRLPPGSRGLLFLGETLHYLAASSTPGVLPPFFQRRLERYGPIFRTNLVGEDLVVSLDAELNAHVLKQEERGFQIWYPPSFMRVFGADNITAKLGVLHHYMRTLVLRLFGHQTVRSVLLHDVQRSARDELRSWLGRPDVEVRTATSRMIFGVTAKKLISHDDAASGETLWRCFHDWTSGLLSFPVSIPGTTFYRCMQGRKKVMTMLKQQLVERRRNAAERETEDXFFDLVIDELNKPDPMMDESTALDLLFTMLFASHETTSMVLTVILKYLTDNPKALQELTEEHERILESRANPGSDLTWEEYKSMKFTSHVVHESLRLANIALAMFRKANQDVHINGYTIPKGSKIMMCPLASHLNTEVYEDPSVFNPWRWKDIPEPVGTSKDFMAFGGGLRLCAGADFSKMQMAMFLHYLVTNYRWKPVGGGTMLFYPGLQFPEGFHIQLLPKIPNVVP

SEQ ID NO: 73468 - protein, 873 aa, Clostridium symbiosum
AKWVYKFEEGNASMRNLLGGAGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 73469 - protein, 868 aa, Xylella fastidiosa Temecula1
MSASPTAERWIVLKFGGTSVSRRHRWDTIAMVVRKRLEEHGTRVLIVVSALSGVTNELTAIAQGVVDSAKRVTALEQRHRDFLVELGLDAQAVLGTRFAMLSDLLQDARAVTRSLDWQAELLGQGELLSSTLGAAYLGASGIDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNAVAAVDQCYYAIKANPHPAILRTLIEEGFGLECVSLGELRHVFEVVPHLVPSRVLFTPSFASRVEYEQAFLLGVNVTLDNVEALRLWPEVFRERTLWLRIDLGYGDGHHEKVTTGGKTSKFGLSVTRIDEFIDVAKTLNITVTGLHAHLGSGVESGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLTRLDETPHVLCDVVGPICESSDVFGRRRHLPAATASGDLMLIADAGAYGFSMASTYNLRGLPAEVVLDA

SEQ ID NO: 73470 - protein, 356 aa, Mycobacterium leprae TN
MSLSLGIVGLPNVGKSTLFNALTRSNVVVANYPFATIEPNEGVVSLPDPRLAKLAELFGSERILPAQVTFVDIAGLVKGASEGAGLGNKFLAHIRECDAICQVVRVFSGDDITHVTGRVDPQSDIGIIDTELILADLDTLERALPRLEKEARNHKERKPIYAAAINAQQVLNVGTTLFAAGVDGSALRELNLLTNKPFLYVFNADEAVLTAAAWVAELRQLVAPADAVFLDAAIEAELAELDDESAAELLESIGQTERGLDALARAGFRTLALQTFLTVGPKEVRAWTIHQGDTASKAAGVIHTDFEKRFIKAEIVSYDDLIATGSMSAAKAAGKVRTEGKDYVMADGDVVEFRHG

SEQ ID NO: 73471 - protein, 253 aa, Mesorhizobium sp. BNC1
MGRLQEKTCIVTGGAGSIGSATARLFLQEGARVLLVDRDAAGLQRLAAELGGRERLAWAAADVSDAAQTAAYVEKAVQTFGPVDVLFSNAGNFGVVRPIADYPDEVFEAVMAVHVRGAYLAAKHTVPKMRDGGSIIITSSVAGVRGDAGVYAYITAKHAQVGLMRCLAKELAPRGIRVNTIHPGPVENGFQLSVEEGVGKALDVDGAEFFNRLIPLARHATPQEIARSVLYLASDESSFTTGTTLMVDGGMSV

SEQ ID NO: 73472 - protein, 483 aa, Mesorhizobium sp. BNC1
MDVLGLTIDGEERAASDGRVFERYNPVTGDVATRAAAVNVDDAIAAVDAAAAAFPAWSQTSPGERRAILTAAADRLQAMSDDIVAAMAAEIGATAGWALFNVGLAADMLREAAGLTTQIKGEIIPSNRPGSLAMAIRQPAGVVLSIAPWNAPIILGVRSLAAPLACGNTVVMKTSEICPRTHSLIVQALNEAGLPKGVLNAVSNAPEDAAEIVETLIAQPAVRRVNFTGSTRVGRIIAELSGRYLKPALMELGGKAPLVVLDDADLDAAVAAAAFGSFMNQGQICMSTDRIVVDEKVADEFVGALAAKAKTLKASDPREGNTPLGCVVDAGAASRISQLISDAVAKGAVLSAGGGVDGTIIQATVLDKVTPSMRIYSEESFGPVVAVLRVGSVEEAVRVANDTEYGLSAAVFGRDVNRAMSVARRIQSGICHINGPTVHDEAQMPFGGVKASGWGRFGGSAGIHEFTELRWVTIQDGPLHYPF

SEQ ID NO: 73473 - protein, 516 aa, Zea mays
METAYVVVLSFFFIVAIHRLLNRGESKNMSKQPLPPGPRAIPVLGHLHLLEKPYHLAFMRLAARYGPVFSLQLGSRAAVVVSTADCARECLAEHDATFANRPTYPTLHLMTYGGATIGHSAYGAHWRHVRRVVSLHLLSPQRVLSSMVPTITAEVRAMARRMYRAAAGGAARIELKGRLLELSLSTLMETIAQTKTYRPADDADTDMSPETQEFKQLLDAIISLLGLTNVLEFLPVLQTFDVLGLKKKIAAAAGRRDAFFQRLIDAERRRLDDGVEGQKKSMLAVLLALQKSEPENYTDEKIMALCFSMFIAGTDSTATAMEWAMSLLLNHPEVLKKAREEIDAHVGSSRLLGADDVPSLGYLHCVLNETLRLYPVGPTLIPHESTADCTVGGYRVPSGTMLLVNVYAIHRDPATWPDPDVFRPERFEDGGGSAEGRLLIPFGMGRRKCPGETMALQIMGLALGTMIQCFDWGAVGGGGAPKVDMTQGGGLTLPRAVPLEAMCKPRQVMLDVLQKL

SEQ ID NO: 73474 - protein, 496 aa, Pseudomonas fluorescens Pf-5
MAIAPLLAATTAFIQRAPRMLIGAHWTEAGDGQTMPLRNPATGEQLCLVPRATVDDVDRAVLAARQAFDDSPWTRTRPRERQNLLWKLADLMQRDAELLAQLECLNNGKSAAVAQAMDVQLSIDFLRYMAGWATKIEGSSVEVSLPLMPDDQFHSFIRREAVGVVGAIVAWNFPLLLACWKLGPALATGCTLVLKPADETPLSALKLAELVQEAGYPDGVFNVVTGTGITAGSALTRNPLVDKLTFTGSTAVGKEIGKIAMDSMTRVTLELGGKSPTIVMADADLASAAAGAASAIFFNQGQVCCAGSRLYVQRKHFDNVVADIAGIANAMKLGNGLDASVEMGPLISARQQERVYRYIEMGRESGATIACGGEQFGPGYFVKPTVIVDVDQKHSLVQEEIFGPVLVAIPFDDEADALRMANDSPYGLGASIWSNDLAAVHRMIPRIKSGSVWVNCHSALDPALPFGGYKMSGLGREMGHAAIEHYTELKSVLIKL

SEQ ID NO: 73475 - protein, 339 aa, Ralstonia metallidurans CH34
MAETLLLTGATGYIASHTWVALHEAGYNVIGLDNLCNSSAEVVNRLAKITGTTPHFVEGDVRDRALLDRLLAEHKINGAIHFAALKAVGESVSKPLEYYGNNLEGLITLCSAMQSAGVRQLVFSSSATVYGNPHAMPILENFPLSATNPYGQTKLMGEQILRDLEISDPEWKIAFLRYFNPVGAHESGTIGEDPGGIPNNLMPYVAQVAAGRREKLSVYGGDYPTPDGTGVRDYIHVSDLADGHVAALAYLGKNSRGMTVNLGTGRGYSVLEVVKAYERASGRPIPYEIVARRPGDIAECYADPGIARTLLGWSARHDLDRMCEDSWRWQSLNPVGFTA

SEQ ID NO: 73476 - protein, 532 aa, Streptomyces griseus
MSVVEESPLNSAAPADGHLRDRAAELAALHERVRRGPGERATEAQHAKGKLTVRERLALLFDEGTFTEIEELRRHRATGFGLEQRRPHTDGVVTGWGEVDGRTVFAYAHDFRIFGGALGEAHAEKIHKLLDLAESAGRPVVGLCDGAGARIQEGVTALAGYGGIFARNVRNSGVIPQISVILGPCAGGAAYSPALTDFVFMVRGTSQMFITGPDVVQAVTGEVITHDALGGADAHASVSGVAHAAYDDEESCLADVRHLLSLLPSNNRELPPAAPGADPASRRTEALLDLVPADPGRAYDMRAVITEIVDDGEVFEIQESWATNIVCVIARLDGQAVGIVANQPAAFAGVLDIHASEKAARFVQTCDAFNLPLVTLVDVPGFLPGVDQEHGGIIRHGAKLLYAYCNATVPRVQLILRKAYGGAYIVMDSRSIGADVSLAWPGNEIAVMGAEGAAGVVFRREIAAADDPEATRARLVKEYRAELMHPYYAAERGLVDSVIDPAETRSRLIGALTMLRAKHAPLPTRKHGNQPQ

SEQ ID NO: 73477 - protein, 313 aa, Zea mays
MAALLELFLGSSSAPVDWEAEAYPAYGDFAVLPLLVAFFPAVRFLLDRLVFEVLARKLIFGKEHDKLAETDDSRKKINKFKESAWKFVYFLSGELLSLSVTYNEPWFKNTRYFWIGPGDQIWPDQMIKLKLKAVYMYAAGFYTYSIFALLFWETRRSDFGVSMSHHIATVVLIVLSYIFRFARVGSVVLALHDASDIFLEIGKMAKYSSCEWLAVVAFLLFVASWILLRLVIFPFWILRSTSYEVLLTLDKEKHQFYGPIYYYVFNCLLFSLLVLHIYWWVLIWRMLVKQIQSKGHVGDDVRSDSEGEEEHED

SEQ ID NO: 73478 - protein, 263 aa, Pseudomonas syringae pv. syringae B728a
MNVAQKNTKETDKLFSKQSHHYAAFRFDYPAELYDFIQRNSPDTQQVWDCATGSGQAAINLATTFRHVTATDISAEQISHAPRVPNISFQVLAAENARFAHQQFDAVCVAQAIHWINTSSFYALVDHCLVSEGLLLIVGYAFNEPLTPALDQVINDFQFGVLKDFWPAQTEILFAGLKDLPFPYPRLPTPEMHIQRSWSLQDYVNYTRTWSATQLYIDQHGTDPCIELAERLAEVWPQDKKHLEFRWKLFVLAGNKPACEGRP

SEQ ID NO: 73479 - protein, 393 aa, Oryza sativa Japonica Group
MHQPAIMQRALAVVALLAAAAAIAAAQGESPELLPFAVGAAPEGCDVGEGEWVFDEAARPWYAEEECPYIQPDLTCQAHGRPDAAYQRWRWQPRDCSLPSFNATGMLEMLRGKRMLFVGDSLLRGQYTSLLCLLHRGAPGGGGGSRSFETVDSLSIFRAKDYDATIEFYWAPMLAESNSDGAAVPDDRLIRGAPMNKHSSFWKGADVLVFNSYLWWMTGDKIQILRGADEDMSKDIVEMEAAEAYRLVLHQVTRWLEGNVDPKSARVFFVTASPSHAGAGGECYDQTTPVGAADAASYCGSTSRRMVQVAGEVLGASRVPVGVVNVTRMSELRRDAHTQVYREQRWAKPTAEQLAADPRSYADCTHWCLPGVPDAWNELLYWKLFFPARDEAI

SEQ ID NO: 73480 - protein, 464 aa, Synechococcus sp. RS9916
MLVPLELAQLSPMLSELSSHDLEVAETLIGVVRFLLIFVAARTLAEVLVRFQLPTILGELLAGVIIGASGLHLLVPPETQAHLSDSFSQLIGGLASIPPDAIPEIYNETFPSLQAVATLGLYALLFLTGLESELDELVAVGGQAFTVAVAGVVLPFAIGTAGLMAIFHVDLIPAVFAGASMTATSIGITASVFGELGYLKTREGQIVIGAAVLDDILGIVILAVVVSVAAGGTFSMAPILKLVVAAIVFVVAAIGLSRTAAPAFDWLIDKLKAPGEVLVASFVILTLSCFAATAIGLEAALGAFAAGLILSGSKHNHAIQQAVLPIVTLFATIFFVLVGAGMDLSVINPLDPASRSALVVAGFLLVIAILGKIAAGWAFVSKQPTNRLVVGLGMMPRGEVGLIFLGLGTSAGLLSPSLEAAILVMVIGTTFLAPVLLRLVLGGNTPDGGDKVDDSVAADPVGLV

SEQ ID NO: 73481 - protein, 386 aa, Oceanobacillus iheyensis HTE831
MNIHEYQGKQVLREYGVKVPNGYVAYTVDEAVQAAEKLGTSVNVVKAQIHAGGRGKAGGVKVAKSLDEVRTYADEILGKTLVTHQTGPEGKEVKRLLIEEGCDIQKEYYVGVVLDRATSRVVMMASEEGGTEIEEVAEATPEKIFKEVIDPVVGLTPFQARRLAFNINIPEDLLGKAVKFMSGLYDAFVAKDCSIAEINPLVTTGDGEVLALDAKLNFDDNALYRHKDIQDLRDFEEEDEKEIQASKYDLSYVSLDGNIGCMVNGAGLAMSTMDIIKHYGGDPANFLDVGGGATAEKVTEAFKIILSDKNVKGIFVNIFGGIMKCDVIAEGVVEATKQIGLEIPLVVRLEGTNVDAGKKILDESGLNITTATSMADGAEKIVAAVK

SEQ ID NO: 73482 - protein, 368 aa, delta proteobacterium MLMS-1
MVIVPVILAGGRGTRLWPLSRELHPKQLLPLADGESMLQQTLRRLSALPPMTPPVVVCLEEHRFMVAEQVRALELEAVILVEPVGRETAPAVALAALEAQRRTAEQEVLLLVLPVDHQLERLEQFRLALERALPAAAAGHLVTFGIVARRPETAYGYIEPGEALNGDAEIFAVRRFVEKPDAAGAAACLVAGCLWNSGILVVSAATYLAELARFEPEMAARVAQCYQRRRRERDFVYLDHDSLAASPSRSLDHAVLERTARAAVVPLACGWDDIGSWPSLAGSGAEQRDSAGNTARGPVVIKNSRNCQAWSSGRLLTLLGVDDLVVVETADAVLVAHRDQVQDIRQLVAELKEQGWPEVISHPAGHRN

SEQ ID NO: 73483 - protein, 483 aa, Pseudomonas stutzeri
MNTKLFINNVWVNSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQRVQEAGLPAGVLNYLNSSPDRSPEIADALISAKEIRRINFTGSTRVGSIIAQKAAQHLKRCLLELGGKSPLIVLDDADIDAAVKAAVFGSFLVQGQICMSTERLVVDEKIADEFAAKFAEKAKRLSAGDPCVTGDCIIGPMVSPNSGERINGLFKDAIDKGATVACGGMAQGAVMPATILDHVKSNMRIYDEETFGPITVVIRCSGEAEAIRIASDSAYGLSSGVFGRDINRALRVGMSIEYGSVHINGSTVQSEAQAPYGGTKNTGYGRFDGRAVIDEFTELKWLTIEPFEQQYPF

SEQ ID NO: 73484 - protein, 704 aa, Mycobacterium sp. MCS
MSLMRQAVRVPDQTDSRVSAIYVASPEGDTGKSTIALGLLDRLTATAPRVGVFRPITRSGPARDYILELLLAHSTAGLTYEDSVGVTYHQLHEDPDSALADIVDRFHRVADRCDVVLIVGSDYTDVASPSELSMNARIAANLGAPVVLAVKARGRTPDDVVQVVEVCLDEIAAQHAYTAAVVANRCDPDQLTEVREALKRDGAPQVYVLPEEPLLVAPSVAELRDAVDGSMVSGDESLLDREALDVLVAGMTAEHVLERLTEGVTVVTPGDRSDVVLAVVSAHAAEGFPSLSSIILNGGLELHPSIAKLVAGLGLRLPIVATGYGTFETASRVAGTRGRVTAASVRKIDTALTLMETHVDTAELLSRLAIPIPTVVTPQMFTYQLLDQARSDRKRIVLPEGDDDRILKAAGRLLQRGVADLTILGEEGPVRARAAELGVDLAAATVLDPRTSELCDQFAEQYAELRRHKGVTVEQAREIIHDVSYFGTMLVHNDMVDGMVSGAAHTTAHTVRPAFEIIKTLPDVSTVSSIFLMCLADRVLAYGDCAIVPDPTAEQLADIAISSARTAAQFGIEPRVAMLSYSTGTSGTGADVEKVREATDLVHKREPDLLVEGPIQYDAAVEPSVAKTKMPDSPVAGRATVLIFPDLNTGNNTYKAVQRSAGAIAIGPVLQGLNKPVNDLSRGALVEDIVNTVAITAIQAQGDR

SEQ ID NO: 73485 - protein, 99 aa, Nostoc sp. PCC 7120
MATFKVTLINEAEGTKHEIEVPDDEYILDAAEEQGYDLPFSCRAGACSTCAGKLVSGTVDQSDQSFLDDDQIEAGYVLTCVAYPTSDVVIQTHKEEDLY

SEQ ID NO: 73486 - protein, 874 aa, Anaplasma phagocytophilum HZ
MDDRLIYHFGRSRCDGGAHLAHLLGGKGAGLAEMCRIGINVPPGFTIATSVCNLYQESGSVPENVVQQLPEALSLLGQEVDLEFGNPDRPLLVSVRSGSVQSMPGMLDTVLNVGLNDEVAVKLGAMRGGRFAYDSYRRLIQMYAASVLQLEDRIFEERYKEKQKELSLSTGESITNQEALRELVEEFKQLVRTHTGQEFPQDVQVQLRNAIGAVFKSWMNQRAVAYRNMYGIPSDAGTAVNVQAMVFGNINQNSATGVVFTRNPSTGEKEIFGEFLCNAQGEDIVSGQKDPSPIKLMESSMPQVYGELVEVCEKLEKHNKDMQDIEFTVQDGKLWILQTRRGKRSAHAAVNLAVSMVKESLISKEEAILRIDASTLGGLFHPILEENCSNVVVGRGLPASPGAASGYVAFTSSDAEELKRQGKSVILVRQETSPEDIRGMISAAGVLTLRGGMTSHAAVVARGMGKPCICGASSLCIDESGQFFFNEDNVKIGRSDSITINGSTGEVMLGAVQTVTPSLPEAFYELMGWIDEIRTVGVMANADTVEDMGTANLFGADGIGLCRTEHMFFSDNRITIVREMILASNKQERDRALKKIEVVQKDDFLAMFKLMQNKKQITVRLLDPPLHEFLPNSMEALESISLGMGRSLEYIKHRVSALSEKNPMLGHRGCRLAVSYPEIYEMQIRAIFQAVKELRDSDGITVIPEIMIPFVMDEQEIVIIGDLVKCISAQFDNAQYRIGAMIELPRAALLADKLSQHVQFFSFGTNDLTQTTLGISRDDSSKFVEHYISSGVFASDPFELLDVSGVGRLIKIAMELIHKSPNKVKTGLCGEHGGTLAAMQLCSELDIDYVSCSPYKVPVAKLIAAQCAIRNKML

SEQ ID NO: 73487 - protein, 326 aa, Rickettsiella grylli
MANKIEKFFIESFVVGKFMLNHVKRTIFNQLWKNYSVHVKEIESIQYYMKEQFQETFIQDHFALIDLPGPHTGIEVLTCLFSYLGYEKRGQGYLAEKQNNFRWLSEAIKQDTLAINAPPQIVVADFRREALSPKILEIIDYYAGFAPALEVNQLKFLHQRTVQQDENAADQLSHFILNYLQTRDWPLPTVKEYEIVKSQNELLAWVLVMGRHVNHFAWSIHLSKKFRHLSHFNDILNSQLMISLNQKGGVIKGNRTKGIEQSSTQASMRSVELADGQIDLADRFIEFVWRFPKKVGDNRFWDDYFTGFVADNARHVVESLYLLSES

SEQ ID NO: 73488 - protein, 256 aa, Nostoc sp. PCC 7120
MKTEFIVILSQREIEKMRQAGRLAAKLLQHLEPLVKPGVSTLELNDEAERWTQAHGAKSAPLGYKGFPKSICTSVNEVICHGIPNAKQILKDGDIINIDVTPIVDGYHGDTSKTFIVGNAAPKIKKLVEVTQECLHLGIAEVKPGAKIGDIGAAIQEYAEAEGFSVVRDFVGHGISNIFHTAPDVPHYGTRGKGKRLRPGMVFTIEPMINEGTYEVEMLGDGWTAVTRDRKLSAQFEHTIVVTEDGVEILTLPESE

SEQ ID NO: 73489 - protein, 92 aa, Rickettsiella grylli
MSTIEERVKKVVVDQLEIKEEEATMEASFVDDLGADSLDTVELVMALEEEFDTEIPDEEAEKIRTIQQAVDYIKQYQKQHQEAEDDKKEKQE

SEQ ID NO: 73490 - protein, 348 aa, Oryza sativa Japonica Group
MASRILLPILLFLLCSRGGSGAPAARRGMRVPPLGGDPVKFDFSPFLIEYKSGRVKRLMGTDVVAASADVLTGVSSRDVAIDPANDVRARLYLPSFRATAKVPVLLYFHGGAFVVESAFTPIYHAYLNTLAAKAGVLAVSVNYRLAPEHPLPAAYDDSWAALKWVLANAAPGTDQWVSQYGDLSRLFLAGDSAGGNIAHNLALRAGEEGLDGGARIKGVALLDPYFQGRSPMGADAMDPAYLQSAARTWSFICAGKYPIDHPYANPLALPASSWQRLGCSRVLVTVSEQDRLSPWQRAYYATLRSSGWPGQAELYETPGEGHVYFLTKLSTPQAQAEMATLVAFINRN

SEQ ID NO: 73491 - protein, 519 aa, Polaromonas sp. JS666
MSAQGLTPADYLKKILTARVYDVALESALEPAKNLGRRLNNTVLLKREDQQPVFSFKLRGAYNKMAHLSSAQLKKGVICASAGNHAQGVALSAQKLGTRAVVVMPTTTPQVKIDAVKGWGAEVVLHGDSYSDAYAHAVLLEKKRGLTFVHPFDDPDVIAGQGTIAMEILMQLQSLGSRRLDAVFVAIGGGGLIAGVANYIKAVRPEIKVIGVQMNDSDAMMQSVTAKKRVTLNDVGLFSDGTAVKLVGEETFRISRELVDEFMTVDTDAVCAAIKDVFVDTRSIVEPAGALAVAAIKQYVATHKTKGETYAAILCGANMNFDRLRFVAERAEVGEEREALFAVTIPEERGSFRHFCELIGELPGGPRSVTEFNYRISDDEKAHVFVGLTTSAKGESSKIAANFSRHGFKALDLTHDELAKEHIRHMVGGHSALSKDERLLRFIFPERPGALMKFLSSMQPGWNISLFHYRNQGADYGRILVGLQVPKADNKAFKAFLDTLGYPHVEETDNPVYRLFLQS

SEQ ID NO: 73492 - protein, 503 aa, Mesorhizobium sp. BNC1
MSVLNENIARAVEYLKPFREGGVLNHVGGAQVPAASGETFETVSPVDMSTLAKVARGGAADTDKAVAAASEAFKTWSKTSGAERRKILIKVAEGIEARAEEIAFIECMDTGQALRFMSKAAIRGAENFRFFADQAPGSEDGRALRTPAQMNVTSRRPIGPVGVITPWNTPFMLSTWKIAPALAAGCTVVHKPAEFSPLTANLLVQIAEEAGLPKGVLNVVNGYGEEAGRALTEHKGIKAIAFVGESRTGSMIMKQGADTLKRVHFELGGKNPVIVFDDADLDRAVDAAAFMIYSLNGERCTSSSRLLVQESIYEEFTRRVAEVARGIKIRHPLDPETVIGPLIHPSHEKKVLSYFEKAKEEGAIIATGGEKYGEAGCFVRPTLFTNARNDMAIAQEEIFGPVLTAIPFKDEDEALAIANDVNYGLAAYLWTRDLGRAMRMTDNLEAGMIWVNSENVRHLPTPFGGVKASGIGRDGGDWSFDFYMETVNVSFPRREHKVSKLGG

SEQ ID NO: 73493 - protein, 404 aa, Arabidopsis thaliana
MVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 73494 - protein, 385 aa, Buchnera aphidicola str. Sg (Schizaphis graminum)
MEDALGQLAVLVLEDGTRFHGRSIGAKGTTVGEVVFNTSITGYQEIITDPSYSHQIVTLTHPHIGNIGTNCNDEESSKIHIRGLIIRDMSPISSNYRSEKSFSSYLKENNIVAISDIDTRKLTRILRTKGSQNGCIIEDKKENYSVAYQKAKKFLSLQGLDLAKKVSTKFIYNWDKGSFFINKSKSKLEKKKKFLFHIVVYDFGVKRNILRMLVDRGCYLTVVPAKTDPKIALNLNPDGIFLSNGPGDPRPCDYAIHAIQCFLKKNIPIFGICLGHQLLALASGANIIKMKFGHHGGNHPVKEIKTNRVIITSQNHSFTVDAKNMPNNIAITHSSLFDGTLQGLCLTDKLAFSFQGHPEASPGPHDASSLFDHFIKLLNQVKFSN

SEQ ID NO: 73495 - protein, 449 aa, Vibrio vulnificus CMCP6
MSALNVAKFGGTSVANFEAMSRCSAIIENNPETRLVVSSACSGVTNLLVELANGVQSQERRAELLAQLAEIHDAILNQLEDATEAAAEVYAILDTITSLAEAASIQASNKLTDHLVACGELMSTHILAQLMRERGVNAVRFDIREVLRTDDNFGRAEPDVAKIAELAQEKLLPLCRDYVVVTQGFIGSDEEGNTTTLGRGGSDYSAALIAEGVKASGLEIWTDVPGIYTTDPRIAAKAAPIPEISFAEASEMANFGAKILHPSTLVPALRHDIPVFVGSSKEPEKGGTWIRHEAQSSPLFRALALRCNQTMVTLRSAKMFHAYGFLAKVFEILAKHKISVDLITTSEISVSLTLDKTDTSGGAPELPQAAREELEELCTVEVEHNLCLVALIGNHMETKGYAKEVFSTLGDFNLRMICYGASDHNLCFLVDAHDSKSVIQKLHQDLFER

SEQ ID NO: 73496 - protein, 247 aa, Thiomicrospira crunogena XCL-2
MSQALENKEGQTVPSVVWPTRQNNEWVNVKSDDIFKGRTVVVFSLPGAFTPTCSSSHLPRYNELAPVFFENGVDEIVCLSVNDTFVMNEWAKDQECTNVTLIPDGNGEFTDGMGMLVDKSDLGFGKRSWRYSMLVKDGVVEKMFIEPNVPGDPFEVSDADTMLKYINPNAQPKKVATIFTKPGCPFCAKAKAALEDAGIEYEEITVSHADVTSRTLRAVANADTVPQVFIEGQHIGGSDDLEAYLAK

SEQ ID NO: 73497 - protein, 456 aa, Thiomicrospira crunogena XCL-2
MQYDYDLIAIGAGSGGLSVVERAVEYGKKCAVVEAKKMGGTCVNIGCVPKKVMWFGAHIAESLRDAPDFGFHVERKGFDWSELVKRREQYISNITTWYGGYFKELGIDVLEGWGSFVDEHTVSVDGKLVTAETIVIAPGGTPFIPNETENADLGITSDGFFALTEQPNKVAVIGSGYIAVEIAGVLQALGTQTTLISRKDLVLRGFDDMVRETLTDAMIESGIHKEYHFKVKKLMKADDGTLIIESEDGQHLEGFDEVIWAVGRETLTEPLALDKVGITPNGRGYIDVNDYHQTQVPNIYAIGDVTGQAQLTPVAIRAGRYLAERLYNNQPELKMDLSKVPTVVFSHPPVGVIGLAEHDARKEYGHDNVQVYSSVFTPMRYAFTEHQIKTALKLVCVGEEQKVVGIHIVGDGADEMLQGFAVAVQMGATKADLDATIAIHPSSSEELVTMRPMILK

SEQ ID NO: 73498 - protein, 153 aa, Oryza sativa Indica Group
MTSSSSPSRKALSKIACNRLQKELAEWQMDSYDSPNRWVIEVTGAAGTLYAGETYQLQVDFPEHYPMEAPQVIFLNPAPMHPHIYSNGHICLDILYDSWSPAMTVSSVCISILSMLSSSPAKQRPQDNDRYVRNCRNGRSPKETRWWFHDDKV

SEQ ID NO: 73499 - protein, 193 aa, Solanum chmielewskii
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAVPTHGVGAGVSILEGLVMEIIITFGLVYTVFATAADPKKGSLGTIAPIAIGFIVGANILAAGPFSGGSMNPARSFGPAMVSGNFEGFWIYWIGPLV

SEQ ID NO: 73500 - protein, 140 aa, Arabidopsis thaliana
KANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 73501 - protein, 135 aa, Zea mays
  misc_feature (83)..(83): Xaa can be any naturally occurring amino acid
MAEKEAAATWGGDDKLILRGLQFHGFHGVLQEEKTLGQKFVVDIDAWIDLAAAGESDCIADTVSYTDIYSIAKDVVEGTPRNXLLESVAHSIAEATLLKFPQISAVRVKVGKPHVAVRGVLDYLGVEITRHRKKE

SEQ ID NO: 73502 - protein, 304 aa, Streptomyces avermitilis MA-4680
MSHGPTRKHTALPKAQILIEALPWLTRHNGKTVVVKFGGNAMIDEELKAAFAQDIVFLHHAGLKPVVVHGGGPQISAALDRHGIVSEFKAGLRVTTEDAMDVVRMVLAGQVQRELVGLLNQHGPLAVGLTGEDAHTITATKHQPEIDGELVDIGRVGEITEIDTGAIEALLADGRIPVVSSIARSQDDGHVYNVNADTAAAALAAALGAETLMVLTDVEGLYEDWPDSDEVISRLTASELEKLLPELASGMVPKMEGCLHAVRNGVTTARVIDGRVQHSILLEIFTDEGIGTMVVPDEEEGDAV

SEQ ID NO: 73503 - protein, 403 aa, Streptomyces avermitilis MA-4680
MTGTATNAELTERWQGALMNNYGTPRLPLVRGAGTRLWDADGKEYLDFVGGIAVNALGHAHPAIVEAVSTQIASLGHVSNLFVAEPPVALAERLLQLFGRDGRVYFCNSGAEANEAAFKIGRLTGRSHMVATQGGFHGRTMGALALTGQPGKQEPFLPLPGDVTHVPYGDAQALAAAVTEETALVVIEPIQGENGVVVPPAGYLKAARAITAATGSLLVLDEVQTGIGRTGHWFEYQAHEGVLPDVVTLAKGLGGGLPLGATVAFGRAAELLQPGHHGTTFGGNPIACAAGLAVLETIQAEGLLENVKSASEKLRDGIESLGHPLIAHVRGSGLLLGIVLTEPLAPQAQQAAQDAGFLVNAPAPDVVRLMPPLNLGDDEVDAFLRALPGVLDAVTNGDGRAKE

SEQ ID NO: 73504 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 73505 - protein, 275 aa, Streptococcus suis 89/1591
MQVAYLGPRGSFTHQVAQQAFPTADLQAFETITEVIKAYETGDVTYSVIPVENSIEGSVHETIDYLFHQAEIHAVAEIVQPIAQQLLATSADKAVEVIYSHPQAIAQGKKYIQEHFPQARIEITASTAYAARFVAEHSGQPFAAIAPQAAAVEYGLEVIAQDIQEISENFTRFWILGDKAPSIALKQVAKKVSLALTLPDNLPGALYKAMSVFSWRGISLTKIESRPLKTALGEYFFILDLDNQSEELLAYSQKELTSLDITYKVLGNYLVYMTS

SEQ ID NO: 73506 - protein, 466 aa, Xylella fastidiosa Temecula1
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLSVSRARKIERFFSQPFHVAEVFTGAPGKYVPLKDTIRGFKAIVDGEYDHLPEQAFYMVGNIEEVIEKANKMTA

SEQ ID NO: 73507 - protein, 540 aa, Vibrio sp. Ex25
MTGIFLQAFVYLIAAVIAVPLAKRLGLGSVLGYLIAGVVIGPIIGLVGEETTTIQHFAEFGVVMMLFLVGLELEPKMLWSMRNRLMGLGGLQVGGTIAAIMGIALYFEQPWTIALAIGLIFALSSTAIVLQTFSEKGLTKTEGGQNAFSVLLFQDIAVIPMLAFIPLLALPELVEQAQNAVQTAAQHHDDLNLVADLPGWAYGIVITASIAIVVVGGHFLSRPLLSYVASSGLREIFTATALMLVIGIAALMSLVGLSPALGTFLAGVVLANSEFRHELESNIEPFKGLLLGLFFITVGAGINFSVLFGDLWLIMALTISVMVLKALVLFILALIFRVKGSNRWLFTLSLAQAGEFGFVLLSFSVQNHVIPFELSQTLALVVAISMFLTPGLFILFDKLILPRFETQSNERESDTIEEKGTVIIAGIGRFGQIVNRLLVSNGVTTVVLDHQANQVDNMRQIGTRAYFGDATRPDMLHTAGIEHAAALVVAIDNQESSVELVKYVKHTYPKVTVIARAFDRGHGYLLRQAGADIIESETYH

SEQ ID NO: 73508 - protein, 327 aa, Pseudomonas syringae
MKITSLKNRNLLTMNEFNQSELSHLIDRAIECKRLKKDRIFNLGLNHLNICGIFLKPSGRTSTSFVVASYDEGAHFQFFPADNIRFGHKESIKDFARVVGRLFDGIAFRGFEHEVAEELAKHSGIPVWNALTDTHHPTQVLADVMTVKEEFGPIEGVTIAYVGDGRNNMVTSLAIGALKFGYNLRIIAPNALHPTDAVLAGIYEQTPERNGSIEIFTEVAAGVHQADVIYTDVWISMGESVSVEERIALLKPYKVTEKMMALTGKADTIFMHCLPAFHDLDTEVARETPDLVQVEDSVFEGPQSRVFDQGENRMHTIKALMLETVVP

SEQ ID NO: 73509 - protein, 110 aa, Triticum aestivum
  misc_feature (18)..(18): Xaa can be any naturally occurring amino acid
  misc_feature (92)..(92): Xaa can be any naturally occurring amino acid
  misc_feature (100)..(100): Xaa can be any naturally occurring amino acid
MDANRRQGGIQQLLAAEXEAQQIVNAARAAKSARLRQAKEEAEREIAEYRAQMEAEFQRKVAESSGDSGANVKRLEEETTAKIEQLNQQAAXISPDVIQXLLRHVTTVKN

SEQ ID NO: 73510 - protein, 437 aa, Bacillus halodurans C-125; identical to SEQ ID NO: 1587

SEQ ID NO: 73511 - protein, 312 aa, Rhodobacter sphaeroides 2.4.1
MSSQKVTTAIFPIAGMGTRFLPATKSIPKEILTLVDKPLIQYAVEEAREAGIEDFIFVTSRGKGALEDFFDVNQTLERALRAAGKTELLATLEATNIDSGHVTYVRQHEALGLGHAVWCARRLVGDEPFAVILPDDMVVADKPCLAQMIEAHEEVGGSIIATMEVPAEKASSYGVLDIEERQGALIRPRGIVEKPKAGTAPSNMAVIGRYILGPRVMQHLDRRTVGAGGEIQLTDAIAHELATHPGSVHGFRFQGERFDCGSKAGFLQATVALALEREDLRGEFSTFLRAIAEQHGLGAPSAAPLRSVAAAS

SEQ ID NO: 73512 - protein, 260 aa, Rhodobacter sphaeroides 2.4.1
MTNADYALGARALLRSLALSGTTADRVVLHTDVPEEALAPLRALGARLVRVELLPTSPEFNAAHAREALHARAAFTKGGKPPFHTPLDNFAKLRLWQLVDYRSVVFIDADALVLRNVDRLFDYPEFCAAPNVYESLSDFHRMNSGVFTARPSTDTYARMLEALDVPGAFWRRTDQSFLQQFFPDWQGLPVFCNMLQYVWFAMPELWSWEQIRILHFQYEKPWQEHDKADRLRPLIDLWRAYAGDGPVPALSDMPDPCGLR

SEQ ID NO: 73513 - protein, 489 aa, Polaromonas sp. JS666
MSFDLILFGGTGDLVWRKIMPALFQAFRHGSLPPGGRIVGVARDALSDDQYRALIKSRFDQVELAKRPSEEEFSRFAALLSYLRMDLSNPADYASLAAKLQQRPAEVVVMYVATAPSLFTTVCEQMAAAGLNGPQTRVVLEKPLGHDLASNRAINKTVRSVLQEDQIFRIDHYLGKPSVQNLFALRFGNSLFEPLWRRETIANIQITIAEDLGVEKRGAFYDSTGALRDMVQNHALQLLCAIGMEPPINSHADAIRDEKLKVLRSLKAWTPETLSQHVVRGQYAAGSIDGEAVPGYRDEKGVDPDSATETFVALRTEIANWRWAGVPFYIRTGKRLAGRDAHIEVNFRPAPHAIFQSPLVESNVGNRLVINLQPKDGLELHLLAQGSHQRHDRGTPSLVPVQLDLDFDKRFGAERVGAYERLLLDVIAGRLNLFVRSDEQEEAWRWVEPILDSWSSQPAGPRPYAAGTWGPSAASAMIARDGYCWSEEC

SEQ ID NO: 73514 - protein, 76 aa, Zea mays
  misc_feature (19)..(19): Xaa can be any naturally occurring amino acid
  misc_feature (35)..(35): Xaa can be any naturally occurring amino acid
SSRPVKTHVKIGLDDYNYXYIQTRSVQPLLHICSXGMDFSYLVALPNERRHLKDLQHAQEHGGHSPPHVGFCDAGD

SEQ ID NO: 73515 - protein, 525 aa, Polaromonas sp. JS666
MSQSMKRLRCDQTPAWAALQASFEAGGKSFDLREAFAGDAERFFRFSQEAPYVFADLSKNLLDVTSEALLLDLAVQCQLEQHRDAMFAGDRINSTEQRAVMHFLLRQPALPALEQAQSAIKNTAHELSQVHATLDAMLAYAEEVRADEAITDVVNIGIGGSDLGPQMAVLALGEFATTGKRFHFVSNVDGQELAGVLAQCQPHSTLFLVASKTFTTNETMSNAHSAKRWFEAGGGRDINRHFAALTTNVVAANAFGIRSTFGFWDWVGGRYSLWSAIGLPVAIAIGAVGFRELLAGAHAMDEHFRTAALARNLPVRLGLLDVWYRNFHGFGSRSIAPYSSALRRLPAYLQQLEMESNGKRVDTDGQPLPFATAPVLWGEPGTNGQHAYFQMLHQGTSVVPIEFVAVRKAAHGLPGHHEQLLANVLAQAQALMQGKNDEGGHRHFPGNRPSTFLLLDQLTPASLGALIALQEHRVFVSGALWGINSFDQWGVELGKVLAKDIEPRLRSGDTSGLDGSTAGLLQRLR

SEQ ID NO: 73516 - protein, 572 aa, Mycobacterium leprae TN
MFLSADVSCIEIVDINCSELRNDRRIPPQLALFCTNAANKAESAVTSHGQLPIMANRRWAPHTRRQSGRATSTCSSLMRFSASESRAHSRFECYTLVRWSIRGQGGRAISKLGFWSVVMLGINSIIGAGIFMTPGEVIKIAGPFAPIAYTLAGIFAAVLAIVFATAAKYVKTNGSSYAYTTAAFGHRIGIYVGVTHAITASIAWGVLASSFVSTLLRVAFPEKIWADNDELISVKTLTFLVFIAVLLAINIFGNLVIRWANGISALGKIFALSVFIAGGLWTIITQHVNNYVTSRSAYQPTTYSLLGVTEIGKSTAASMTLATIVALYAFTGFESIANAAEEMNTPDRTLPKAIPLTILTVGVIYILALVVAMLLGSDKIVATNHTVKLAAAVGNNTFRTIIVVGALVSMFGINVAASFGAPRLWTALSDGRILPTRLSSKNRFGVPIVAFGITAFLTLAFPLSLRFDSLNLTGLAVIARFIQFIIVPIALFALARSRTTNSVYVKRNVFTDKVLPITAVVVSAGLMVSFDYRSIFLTRGGPNYFSISLIAITFIGIPAVAYLHYYRTSGIK

SEQ ID NO: 73517 - protein, 510 aa, Vibrio vulnificus CMCP6
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAVFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 73518 - protein, 179 aa, Thiomicrospira crunogena XCL-2
MSIRRYKEFTPEINKTAWVDSSAVVIGQCQLTEDVSVWPNATLRGDVNAIKIGARSNIQDGSVCHTTHDSPLTKGSQCLVGADVTIGHNVVLHGCVIEDECLIGMGSVVLDNAVVQKHVLVGANSLVPAGKVLESGYLYVGSPVKQLRPLTDDEKAFFKYSAEHYVRLKNDFQQSVEEI

SEQ ID NO: 73519 - protein, 548 aa, Morganella morganii
MTEITVNGMTCTSCATHVKDALEKIPGVNAAVVSYPESRAQVMADTAVSHNQLLAAIAALGYQGSIRVGDFKDEPKIRDALEGAGLHIAIIGSGGAAMAAALKAVEQGATVTLIERGTIGGTCVNIGCVPSKIMIRAAHIAHLRRESPFDGGIAATVPAIDRSKLLAQQQARVDELRHAKYEGILDGNPAITVLHGEARFKDDQSLVVRLNEGGEREVTFDRCLVATGASPAVPPIPGLKESPYWTSTEALVSDTIPARLAVIGSSVVALELAQAFARLGSQVTILARGTLFFREDPAIGEAVTAAFRAEGIEVLEHTQASQVAHVNGEFVLTTGHGELRADKLLVATGRAPNTRSLALDAAGVTVNAQGAIVIDQGMRTSNPNIYAAGDCTDQPQFVYVAAAAGTRAAINMTGGDAALNLTAMPAVVFTDPQVATVGYSEAEAHHDGIETDSRTLTLDNVPRALANFDTRGFIKLVIEEGSGRLIGVQAVAPEAGELIQTAVLAIRNRMTVQELADQLFPYLTMVEGLKLAAQTFNKDVKQLSCCAG

SEQ ID NO: 73520 - protein, 319 aa, Gluconobacter oxydans 621H
MTSKTPIESNSRTHSDKLPDVASVVNAEEAQQQAAILSSALPFLRRYAGDTIVVKYGGHAMGEGKLAHAFGYDISLLKLVGINPIVVHGGGPQISAMLDRLKIRSEFIDGLRVTDKSMVDVIEMVLSGSVNKQVTQLINRAGALAVGISGKDGGLIQARRLTRTKRDPDSEIEKVIDLGFVGQPEKIDPRVLYALLGAGLIPVIAPVGVGEDGETYNINADTAAGAIAGAVHASRLLMLTDVPGVLDENGKLIEELSADEAMRRIADGSISGGMIPKVETCLEAVRKGAKAAVILDGRVPHSCLLELFTRAGPGTLIKA

SEQ ID NO: 73521 - protein, 553 aa, Zea mays
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDEKGDIKTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 73522 - protein, 142 aa, Triticum aestivum
MATVLSSLRLPFSVCPAAPSAPMAASRVALPLSSTAARGMRLRAQATYKVKLITPEGEVDLEVPDDVYILDHAEEEGIDLPYSCRAGSCSSCAGKVVSGQLDQSDQSFLDDDQIEAGWVLTCAAYPTSDLVIETHKEEELTA

SEQ ID NO: 73523 - protein, 415 aa, Mycobacterium sp. MCS
MNPPGGPALSRRLGLVDAIVIGLGAMIGAGIFTALAPAAAAAGGGLLVGLAVAAVVAYCNATSSARLAARYPESGGTYVYGRERLGPFWGYLAGWGFVAGKTASCAAMALTVGVYVWPGGARLIAVAAVVALTAVNYAGIRKSALLTRLIVAVVLAVLAVVVVIVLGFGDPVGDRLDFGADVTVGGALQSAGLLFFAFAGYARIATLGEEVCDPARTIPRAIPIALGLTLAVYAVVAVTVLAQLGPAALAGSTAPLADAVRAAGFPGWVPVVGAGAAVAALGSLLALILGVSRTALAMARDRHLPSGLAAVHARHGTPHRAEVAVGVLVAALAATVDLRDAIGFSSFAVLMYYAIANASAWTLGARVVPAVGLAGCLLLAFALPWTSVLAGVAVLAVGALAYAVRRARSTGNGAR

SEQ ID NO: 73524 - protein, 322 aa, Streptococcus suis 89/1591
MAFTDLKLFALSSNQKLAEQVSKKIGIPLGKSSVRQFSDGEIQVNIEESIRGTHVYILQSTSSPVNDNLMEILIMVDALKRASAESVNVVMPYYGYARQDRKARAREPITSKLVANMLQTAGVNRLLTIDLHAAQIQGFFDIPVDHLMGAPLIADYFERRGMVGDGYVVVSPDHGGVTRARKLAQFLKTPIAIIDKRRSVDKMNTSEVMNIIGDIKDKTCILIDDMIDTAGTICHAADALADAGATAVYASCTHPVLSGPAMDNISKSAIKKLVVLDTIEIAEDRLIDKIEHISTAELLAEAIIRIHEKRPLSPLFEASRVK

SEQ ID NO: 73525 - protein, 198 aa, Prochlorococcus marinus str. MIT 9515
MFLVIDNYDSFTYNLVQYLGELSVDHNITKELLVKRNDEITLEEISQINPDGILLSPGPGNPDQSGICLPILQNLSKEIPTLGVCLGHQALAQAYGGKVIVGKELMHGKTSKIIHNKKGLFKDIASPFVATRYHSLIVDSDSLPSCFEITATLEDSTIMAISHKKYKNLHGVQFHPESVLTQFGHKLISNFLKMAEQK

SEQ ID NO: 73526 - protein, 392 aa, Streptococcus suis 89/1591
MDLLNRFNKNLNRIEVSMIRQFDQSISDVPGILKLTLGEPDFTTPDHVKEAAKAAIDANQSYYTGMAGLLELRQAAAEFVAEKYNLHYNPENEILSTIGATEALSASLVAILEAGDTVLLPAPAYPGYEPIVNMVGADIVEIDTTANDFVLTPEMLEEAIIEQGDKLKAVILNYPANPTGVTYSREQIQAFADVLRNYPVFVLSDEVYAELTYTGQPHTSIAEFLPEQTILIQGLSKSHAMTGWRIGLIMSQAPIIAQIIKSHQYLVTAASTAMQYGAVEALKNGKDDALPMRAEYVKRRDYIIEKMTDLGFKIIKPDGAFYIFAKIPAGYNQDSFSFLQDFARKKAVAFIPGAAFGQYGEGYVRISYAASMEKIQTAMACLKEYLEENGTN

SEQ ID NO: 73527 - protein, 184 aa, Crocosphaera watsonii WH 8501
MTISHYQLSMNLPNSITISRLIGLPFLFYFLTTPTPSHRWLSLVIFLLAASTDWVDGYLARKLNQVTELGKFLDPLVDKLLVLAPLLSLISLQQVPAWGVFLILGREIAIAGWRINPNLTGNTTIQGANIWGKLKTVSQITAIALLIAPLPQPWETISITVFWLSVFLTILSGVIYLLPNFSSN

SEQ ID NO: 73528 - protein, 330 aa, Pediococcus pentosaceus ATCC 25745
MSILVVGGAGYIGSHMVKRLVEQNRDVVVVDNLSTGHRGAVDKGVKFYEGDIRDHAFLKEVFDQEAIDTVVHFAAFSIVPESMEKPLKYFDNNTAGMVALLEEMRDHDVKRIIFSSTAATYGVPEKSPIEETDRQAPINPYGESKLMMEKIIKWADQAYGIKFVALRYFNVAGAYPDGSIGEDHGPETHLTPIILQVALGKRDQLQIFGDDYHTPDGTNVRDYVHVLDLADAHILAIDYLKAGNDSDVFNLGSSTGFSVKEMVEAAREATGEAIPAKIAARRPGDPDSLIAASQKARKILKWNPQYDDVKEIIKTAWNWTQKHPNGYEDH

SEQ ID NO: 73529 - protein, 376 aa, Rhodobacter sphaeroides 2.4.1
MRTRAAVAVEAGKPLEIMEVNLEGPKAGEVMVEIKATGICHTDEFTLSGADPEGMFPAILGHEGAGVVVEVGPGVTSVKPGDHVIPLYTPECRQCPSCLSQKTNLCTAIRGTQGQGLMPDGTSRFSMLDGTPILHYMGCSTFSNYTVLPEIAVAKVRPDAPFDKICYIGCGVTTGIGAVINTAKVEIGAKAVVFGLGGIGLNVIQGLKLAGADMIIGVDLNNAKKEWGERFGMTHFVNPSEIDGDVVAHLVNMTKTPFDQIGGADYTFDCTGNVKVMRQALEACHRGWGQSIVIGVAPAGAEIQTRPFQLVTGRVWKGSAFGGARGRTDVPKIVDWYMEGKIQIDPMITHILSLEEINKGFDLMHAGESIRSVVVF

SEQ ID NO: 73530 - protein, 176 aa, Helianthus annuus
GVRGMEIQGNFVKFTGIGVYLEDKAISSLAVKWKGKTAQELTDSVEFYRDIVTGPFEKFAQVTMILPLTGKQYAEKVSENCVAVWKALGIYTDADAKTIDKFLEIFSDQNFPPGSSILFTISPAGSVTISFSKDGSIPETGNAVLENDKLGEAILESMIGKHGVSPAAKQSLASRL

SEQ ID NO: 73531 - protein, 135 aa, Zea mays
KAKSSEKGWGLNLGELARIWKGGCIIRAIFLDRIKKGYDRNPNLANLLVDPEFAQEIIDRQAAWRRVVCLAINNGVSPPGMFASLAYFDSYRRDRLPANLVQVQRDYFGAHTYERVDMPGFFPPEWFKIGGNSKI

SEQ ID NO: 73532 - protein, 165 aa, Hordeum vulgare subsp. vulgare
GGHINPAVTFGLFLARKLSLTRAVFYIIMQCLGAICGAGVVKGFQQGLYMGNGGGANVVASGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAIYHQ

SEQ ID NO: 73533 - protein, 429 aa, Anaplasma phagocytophilum HZ [sequence omitted]

SEQ ID NO: 73534 - protein, 509 aa, Mesorhizobium sp. BNC1
MIKEALLQTTMKSLEGSRQELFIGGRFRAPSSGRFIPSFDPTTGEVWYEFAEADAADVDAAVTSATKAFHNPAWRRMTQTDRGKLIRRLAELVLEHADELALMETRDNGKLIKEMMAQMRAMPDSYIYFAGMADKLQGDTIPVNKLDSLNYSQREPLGVVGMITPWNSPLMLLTGTLAPCLAIGNTVVVKPSEHATASTLALAELVVEAGIPEGVVNVVTGTGAVTGEALTRHPGLAKIVFTGSTATGRRIAANAAENLIPCQMELGGKSPHVVFSDVDIERAVNGVVSGIFAAAGQTCVAGSRCFVEANIYDRFLEALVERTRHIRVGHPMEESTDVGPLAMKSQLEKIEGYVASGARDGAKIAVGGRRPKDGDLARGWYFEPTVMADARNDMKFMRDELFAPVVGVMPFRDEAEMITLANDTEYGLASGIWTRDIDRAMRFASQIDAGTVWINTYRSAAYMSANGGFKNSGYGRRGGFDVMREFSRSKNVLIDYSGAMQDPFVIRLK

SEQ ID NO: 73535 - protein, 180 aa, Acinetobacter sp. ADP1
MMYKFQGYHPKTKTHPWNGWIAGNATVIGHVELGDEVSIWFGAVIRGDNSLIRLGDYTNVQENAVLHTDAGIELHIGNYVTVGHQAMLHGCHIGDNTLIGINAVILNHAVIGKNCIIGANALIPEGKVIPDNSVVMGSPGKIVKTLDEEGAAKLRLSALHYAEHYKKYIQLEPYFFDDYE

SEQ ID NO: 73536 - protein, 451 aa, Arabidopsis thaliana
LLTREENPNFQLWSKIGRMRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 73537 - protein, 212 aa, Glycine max
MSDENGEEPRENRPVPRLNERILSSLSRRSVAAHPWHDLEIGPGAPMIFNCVVEITKGSKVKYELDKKTGLIKVDRVLYSSVVYPHNYGFIPRTLCEDNDPIDVLVLMQEPVLPGCFLRARAIGLMPMIDQGEKDDKIIAVCADDPEYKHYTDFKELPPHRLMEIRRFFEDYKKNENKEVAVNDFLPASTAVESIQYSMDLYAEYILHTLRR

SEQ ID NO: 73538 - protein, 256 aa, Vibrio sp. Ex25
MRRPVVMGNWKLNGSKAMVTELLTGLNAELEGVEGVDVAVAPPALYIDLAERVIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAKAKA

SEQ ID NO: 73539 - protein, 420 aa, Polaromonas sp. JS666
MIEFKLPALGADMDEGTLLKWHVQPGDAVKRGQVVAVVDTSKAAVDVEIWQDGVMTELRVQPGEKVPVGTVLARLLAPGEVAAPAATSLTASTVPTVPVAVPQSVPAAPPQPALPRVPEIEKALPAARHPVSPSARRHAREHGIDPDSVHGTGPQGSVTLADIEAAVAARRPPLPVAAAPDRQTEMRKAIAATMSRSKREIPHYYLSEPIPMARALAWLLQRNEGLPITERILPAVLQLKAVAAALQRVPQLNGLYRDGAFQLSTAVHAGVAISLRGGGLVAPAIHDVGAKPLELLMRELADLVKRARAGSLRSSEMSDPTITITNLGDQGVEAVFGVIYPPQVALVGFGRVADGPWVEEGEVRALPLVTATLAADHRVSDGHQGALFLAELRDLLQQPQALAERVTPAPGQGGQAGGPT

SEQ ID NO: 73540 - protein, 388 aa, Vibrio sp. Ex25
MKIAVAGTGYVGLSNAMLLAQNHQVVALDIIEKKVELLNNKCSPIVDKEIEDFLSNRKLDFTATTDKAFAYKGADFVVIATPTDYDPQTNYFNTASVEAVIKDVMAINPSAVMVIKSTVPVGYTARIKQELGCENIIFSPEFLREGKALFDNLHPSRIIVGERSARAETFANLLVEGAIKEDIPVLFTDSTEAEAVKLFSNTYLAMRVAYFNELDSYAEAHNLDSRQIIEGVGLDPRIGNHYNNPSFGYGGYCLPKDTKQLRANYQDVPNSIIGAIVEANRTRKDFIAESILKREPKVVGIYRLIMKAGSDNFRASSIQGIMKRIKAKGIEVVVYEPVLQEDEFFNSRVINDLNEFKQSADVIVSNRMVEELADVADKVYTRDLFGSD

SEQ ID NO: 73541 - protein, 277 aa, Triticum aestivum
MAQAQATRGDPMKAQQEQPEPIQYGHVFAVTGDLAVQAIAPRDAEAMRTAEESVQGVPVPQASGGGFSAAVAMETAAAYNQAVGAVRPGQASDAATKQGITVTQTAVPGGRIVTEFVAGQVVGQYSVADQAMMQQQQQQVVEEDASKVTIGEAMEAAALSAGDRPLEEADAAAIRAAETQAQGADEVMPGGLADQAWAAASANAWAERDEDKITVGDVLSDATTKLADDKPAAREDAARVVQAETYSDAGARTKAGGVGAAVTTAARLNQEDDDDDA

SEQ ID NO: 73542 - protein, 475 aa, Staphylococcus aureus subsp. aureus MW2
MRDYTKQYINGEWVESNSNETIEVINPATEEVIGKVAKGNKADVDKAVEAADNVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPKKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 73543 - protein, 311 aa, Ustilago maydis 521
MALDKSLEAILHSECSHLGSQFTSRNATCVIAKPSGRSLFAKVSSSVEQTIGEAESLKALTLALGTETNEARLTPEVHSSGKTADGRAYLVTDYLQLRPSIGRAGQKRLGKRLAEMHKRGINRDGCFGFDVATFCGVTRQDNSWNTSWPKFWEDQRIGDLVNRIFAEQGDSELKDLETQMRDKVYPVLLAPLEGKVKPSILHGDLWSGNAGTVVDSGEPALFDLTHRLSSADLLSLVPHISSSYYGHNEAELGIMNMFGGFTQDFFEAYHEVIPRTEPYYKERLRLYELYHHSSSLVLQEFDGSTMEHEDT

SEQ ID NO: 73544 - protein, 517 aa, Glycine max
MLPFSTLFQTPLTTEYWYNHPTTTLLAFLLISLVTCYAWLKPKAQRLPPGPSGLPFFGNLLSLDPDLHTYFAVLAQIHGPIFKLQLGSKLCIVLTSPPMARAVLKENDTVFANRDVPAAGRAASYGGSDIVWTPYGPEWRMLRKVCVAKMLSHATLDTVYDLRREEVRKTVSYLHDRVGSAVNIGEQVFLTVINVITNMLWGGVVEGAERESMGAEFRELVAEMTQLLGKPNVSDFFPGLARFDLQGVEKQMNALVPRFDGIFERMIGERKKVELEGAERMDFLQFLLKLKEEGGDAKTPLTITHVKALLMDMVVGGTDTSSNTIEFAMAEMMHNPEIMKRVQEELEVVVGKDNTVEESHIHKLSYLQAVMKETLRLHPVLPLLVPHCPSETTIVGGYTIPKGSRVFVNVWAIHRDPSIWKKSLEFDPTRFLDAKLDFSGNDFNYFPFGSGRRICAGIAMAEKTVLHFLATLVHLFDWTVPQGEKLEVSEKFGIVLKKKIPLVAIPTPRLSNPDLYQ

SEQ ID NO: 73545 - protein, 312 aa, Triticum aestivum
  misc_feature (209)..(209): Xaa can be any naturally occurring amino acid
  misc_feature (223)..(223): Xaa can be any naturally occurring amino acid
  misc_feature (240)..(240): Xaa can be any naturally occurring amino acid
  misc_feature (250)..(250): Xaa can be any naturally occurring amino acid
  misc_feature (254)..(254): Xaa can be any naturally occurring amino acid
  misc_feature (269)..(269): Xaa can be any naturally occurring amino acid
  misc_feature (279)..(279): Xaa can be any naturally occurring amino acid
  misc_feature (286)..(286): Xaa can be any naturally occurring amino acid
  misc_feature (295)..(295): Xaa can be any naturally occurring amino acid
  misc_feature (306)..(307): Xaa can be any naturally occurring amino acid
GMGRTHRIETTFPRLADPLGYVPKEDILYAIKAIVVTQRENGRRDDRRYSRMKYLLDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVXGIKDEESVVVRITXGCPNGCARPYMAEVGFXLGDGPNSYQXIWLXRNTKPRHLWQETLMXKVNFQDIEKXWDHCFPXWDNTPPRRXPLGASQTRMGXXQLKEW

SEQ ID NO: 73546 - protein, 345 aa, Arabidopsis thaliana
MGRFKNNKKSRVIGKPIAKKNQEDVSHVTGDKIPKSFVFSRMKLAGPVKQLQMDLRKLMLPYTALSLKEKKRNTLRDFLNVSGPMGVTHFLMLSKTASSLSLRVARTPQGPTLTFKIHQYSLASDIAQSQLRPRCPQDLFKSPPLIVLSGFGSQELHLKLATIMFQNIFPAIDINTVKLSTCQRLVLLNYNKDTKLIDFRHYSIRLQPVGVSRRIRKFVQNHQVPDLRNLQDVSDFVTKAGYGSESEGDEEAATVTLSSDLGRVNKGATKSAVKLQEIGPRMTMQLVKVEEGLCTGGIIFSEYDVDGKKEKLKKKQDEEEEEDSEEEGEEGSEEDGEDMDEDFED

SEQ ID NO: 73547 - protein, 545 aa, Yarrowia lipolytica CLIB122
MLGRTLLVSDHCVDITASIFPGSSHPFTTTNPAMNTFHLLIALATFVVVYILSSSFVYQRRTNALEKQWKCGKPLYYASFPRSLWHFYVFLRESRKHKLLEGFQRSFEAKKPFLTNKVNIFGKDIFNTCDPENLKAMLATQFKDFCLGERHAQLFPVLGDGIFTLDGNGWQHSRAMLRPQFARDQVSDVHMVETHLKFLTSRITGSKPVDMQELFFNLTLDTATEFLFGQSVGCQIAESDPGAYSSDMPLDLRKSFQKDFNKAQEHLGERVRLQMLYWLWNPKELQTAGARVHAFVDHYVSKALVEAEEKVDDDKYVFLRELARETKDPKVLRDQALNILLAGRDTTASLLSWCFYLMARDDRVWQKLRSEVIEHFGDGENLENITFESLKRCDYLRYVLNEVLRLYPSVPANMRFATKDTTLPRGGGPVGQDPIVIRKGNVISYHVFTTHRLTQYWGEDAEEFVPERWAEGKARGWEYLPFNGGPRICLGQQYALTEAGYVLVRLAQMYDTLENADDKPEPPVKLHALTMSHLTGVHVKLYKKN

SEQ ID NO: 73548 - protein, 152 aa, Ustilago maydis 521
MRIATKRLQKELSEIKVKGAPEGCEVIKADDLQEWQFSIQVLGNSLYQDQKFGLRFRFSDSYPMESPEVVFMVTDGFQAPVHPHVYSNGHICASILGNEWSPVLTISSVLLTLQSMLASCKQLQRPPDNDAYVKRAPISPKDSRFVYDDDTV

SEQ ID NO: 73549 - protein, 292 aa, Photorhabdus luminescens subsp. laumondii TTO1
MDNQPIIRLADGNHMPQLGLGSWASDDQQIAETIHAALDIGYRAIDTAAIYNNEKGVGNALQETDIPREDIFVTTKLWNDRHLDARAALTESLEKLQLDYVDLYLIHWPAPPQDQYVGAWQQLIELQKEGLIRSIGVSNFQPEHIQRLINETGVHPVINQIELHPLLQQRQLHAWNATHNIVTESWSPLAQGGENVFDNQLVQHLTQKYGKTPAQVVIRWHIDNGMIVIPKSTTLSRIKENFDVFDFKLEKEDLTAMTTLDIGKRLGPTPEIFVDFSEFIQLLEQNSANNQC

SEQ ID NO: 73550 - protein, 287 aa, Schizosaccharomyces pombe 972h-
MSASKIAFLGPRGTFSHQAALLARPDSLLCSLPSFAGKLIFALKFILICFLAVLEALSSRQVDYAVLPIENSTNGAVIPAYDLLKGRDDIQAVGEVLVPAHHCIIGKSLENVQKILSHPQAFGQCSKWISANVPNAEFVSVSSTSQAAALASKDITGTIVAISSELCAVENQFNLLVKNIEDDSNNRTRFLLLRSGGFQDDLSPLKEKSLLQFYLSHPKKLSAVFEVFAAHKVVITNLVVRPSCKFPWTYIYFVECLGMEKHLIDRVGKYCDTFTFMGSYTNQISYF

SEQ ID NO: 73551 - protein, 285 aa, Helianthus annuus
NNFTDVSFKPDNPGALPVFLLVDRGGCYFTNKAWNAQNAGVAAILVTHETDDLITMDMPEHDPNATYLQNLTLSSVFITHSLGVSLKKKIYEKPNPILVTLDWTEALPHPDERVEYEFWTNTNDECGLKCDNQLNFVKTFKKVAQHLNKMGHAIHTPHYIFWYCPEEYTSSDKCKSQCINHGRYCAPDPEEVLVRVYWEEVVVQNLIQACFYKVANESGKPWLWWDYVTDFSTRCQMKEHKYDQECAHEVIKSFGVDTKKIDECVGDTTADTENAVLKAEQHAQV

SEQ ID NO: 73552 - protein, 386 aa, Bacillus halodurans C-125
MNIHEYQGKELLRQYGVAVPNGKVAFSVDEAVEAAKELGSNVCVVKAQIHAGGRGKAGGVKVAKNLDEVRTYADEILGKTLVTHQTGPEGKEVKRLLIEEGCDIQKEYYVGLVLDRATSRVVMMASEEGGTEIEEVAEKTPEKIFKEIIDPVVGLQGFQARRLAFNINIPKELVGQAVKFMLGLYKVFVEKDCSIAEINPLVTTGDGKVMALDAKLNFDSNALYRQKAILEFRDLDEEDPKEIEASKYDLSYISLDGNIGCMVNGAGLAMATMDIIKHYNGEPANFLDVGGGATAEKVTEAFKIILSDESVKGIFVNIFGGIMKCDVIAEGVIQATKEVGLSIPLVVRLEGTNVDLGKKKLEESGLNITAADSMADGAQKIVSLVK

SEQ ID NO: 73553 - protein, 518 aa, Pycnoporus cinnabarinus
MSRFQSLLSFVLVSLAAVANAAIGPVADLTLTNAAVSPDGFSREAVVVNGITPAPLIAGQKGDRFQLNVIDNLTNHTMLKTTSIHWHGFFQHGTNWADGVSFVNQCPIASGHSFLYDFQVPDQAGTFWYHSHLSTQYCDGLRGPFVVYDPNDPQASLYDIDNDDTVITLADWYHVAAKLGPRFPLGADATLINGLGRSPGTTTADLAVIKVTQGKRYRFRLVSLSCDPNHTFSIDGHTMTVIEADSVNTQPLEVDSIQIFAAQRYSFVLDASQPVDNYWIRANPAFGNVGFAGGINSAILRYDGAPEVEPTTTQTTSTKPLNEADLHPLTPMPVPGRPEAGGVDKPLSMVFNFNGTNFFINNHSFVPPSVPVLLQILSGAQAAQDLVPDGSVYVLPSNSSIEISFPATANAPGTPHPFHLHGHTFAVVRSAGSSEYNYDNPIFRDVVSTGQPGDNVTIRFQTNNPGPWFLHCHIDFHLEAGFAVVLAEDTPDTAAVNPVPQSWSDLCPIYDALDPSDL

SEQ ID NO: 73554 - protein, 100 aa, Zea mays
  misc_feature (63)..(63): Xaa can be any naturally occurring amino acid
MAAAGGGAGGKVSFKIILTSDPKLPFKVFSVPEAAPFTAVLKYAAEEFKVPPQTSAIITNDAXGIGINPQQSAGNVFLKHGSELRLIPRDRVGAVVMSSG

SEQ ID NO: 73555 - protein, 262 aa, Streptococcus pyogenes M1 GAS
METKYAFARQIIKEAGLFIKSKMSEQLDIQVKTQFDDLVTNVDQETQQLLMDRIHQTYPCDAILAEENDVRHPINQGNVWVIDPIDGTVNFIVQGSQFAVMIAYYEQGIGQFGLIYDVMADQLLAGGGDFEVTLNGDKLPAYQEKPLERSLIGCNAGMFARNDRNLAHLIAKTLGVRVYGGAGICMVKVMKQELLAYFSFIQPWDYAAAKVLGDKLGYVLLTIDGYEPDFQTRQKIMFVPKCQLTRIASFLTKDSAITLEDQ

SEQ ID NO: 73556 - protein, 402 aa, Prochlorococcus marinus str. MIT 9515
MSKLSLSSLDKSKLEGKKVLVRVDFNVPLNDDGQITDDTRIRAAIPTIKYLINNSAKVILAAHFGRPKGKVNERMRLTPIAARLSEILGKKVNLTESCIGEEALEKSNNLNNGDVLLLENVRFYEEEEKNDLNFAKNLAAHADMYVNDAFGAAHRAHASTQGVTKFLEPSVAGFLLEKELKYLQGAIDAPNRPLAAIVGGSKVSSKIGVLDSLLDKCDKIIIGGGMIFTFYKARGLDVGKSLVEEDKLELARNLEEKAKTKGVELLLPSDVVLANEFSPTAESKVSQIDSISGDWMGLDIGPQSIKVFQNALAECKTIIWNGPMGVFEFDKFAEGTNSIATTLADLSSFSEVCTIIGGGDSVAAVEKAGLAEKMSHISTGGGASLELLEGKNLPGVAALNEN

SEQ ID NO: 73557 - protein, 581 aa, Pediococcus pentosaceus ATCC 25745
MSYQALYRVWRPQKFDDMVGQDVVTRTLKNALITEQTSHAYLFTGPRGTGKTSAAKIFAKAVNCHYLKDGEPCNECVTCKAITEGTLNDVIEIDAASNNGVEEIRDIRDKAKYAPTEADYKVYIVDEVHMLSTGAFNALLKTLEEPPANVIFILATTEPQKIPLTIISRTQRFDFKRITPAQSYDRMVYILDQKGIQYDQKALAIIAKAAEGGMRDALSILDQVISFGNEEVTLDNALLVTGSVNQKLLDQYLTQIFKQETSAALETLHQILDEGKDGQRLIEDLIAVQRNLLLYQEDPQLVQEQSLNDLSEAFTEEAAMVTGVELYQMIDTLNSIQQQMRFTTHPDVYLEVLTIKLSQRKTAKVSTEAPTGSVDNQEVEQLRSEVSQLKQAIQKLQQNVKNTPSNSQSAQPKPKKKAVGAKQVKTPANLTKIYPILENATKASLNTMQELWRDLMDMLSVTERALMHVSKPVAASKEGVVVAFNYDFLFEKAVDNEVLRTELQQNLAKLTGSDFKVVYVTVEEWPEVRSGFLNTHHFDKNQEKSEPEASEQSTPKADEDNQAVKKAVELFGSENVNIKND

SEQ ID NO: 73558 - protein, 441 aa, Yersinia pestis biovar Microtus str. 91001
MRFRRESILTPVLLEAVPMTLLALGINHKTAPVSLRERVTFSPESMDQALNSLLQQPLVQGGVVLSTCNRTELYLSVEQQENLHEQLTAWLCNYHKLSPDDVRQSLYWHHGNDAVRHLMRVASGLDSQVLGEPQILGQVKKAFAESQRGQSLSSELERLFQKSFSVAKRVRTETEIGASAVSVAFAACSLARQIFESLSELHVLLVGAGETIELVARHLREHQVKHMIIANRTRERAQSLASEVGAEVITLPEIDARLADADIIISSTASPLPIIGKGMVERALKTRRNQPMLFIDIAVPRDIEPEVGKLSNAYLYSVDDLQAIIQHNMAQRQAAAVQAESIVQQESMNFMTWLRAQGAVETIRDYRSQAEQVRSEMTAKALVAIEQGANVEQVINELAYKLTNRLIHAPTKSLQQAASDGDMERLQLLRDSLGWISISFL

SEQ ID NO: 73559 - protein, 228 aa, Acinetobacter sp. ADP1
MSKPYLIAPSILSADFARLGEDVERVLEAGADVVHFDVMDNHYVPNLTFGAGVCKALKNYGIQAPIDVHLMVSPVDRMIGDFLDAGADIITFHPEATDHIDRSLQLIKAGGAKAGLVFNPATPLHYLDYVLDKVDQILLMSVNPGFGGQKFIPMTLEKLRQARKMIDASGLDIRLEVDGGVGPANIREIAEAGADMFVAGSAIFGKPDYKAVIDEMRVELAKVGSHTA

SEQ ID NO: 73560 - protein, 245 aa, Polaromonas sp. JS666
MTSSSPARPPVAAASTPSDAKVALGWLHTAKFLTTAPELKHLPRLDVPEIAFVGRSNAGKSTCINTLTQQHRLAFASKTPGRTQSINLFSLGKQGVTDAVLADLPGYGYAAVPKEAKYRWQQVMGNYLQTRDNLKAVVLLCDPRLGLTELDEILLDVLRPRVEEGLKFLVLLTKSDKLNKTEAAKALSIVRLQAGGGDVKLFSSLKRKGVEEVAQHLWDWAHPPEKPAKKPKAEPAAEAATGDEG

SEQ ID NO: 73561 - protein, 533 aa, Nostoc sp. PCC 7120
MTKAPVAPVVLVILDGWGYCEETRGNAIAAAKTPVMESLWTAYPHTLIHTSGKAVGLPEGQMGNSEVGHLNIGAGRVVPQELVRISDAVEDGSILSNSALVKICQEVRNRNGKLHLVGLCSEGGVHSHITHLFGLLDLAKEQRISEVCIHAITDGRDTAPTDGINAISALEDYINHVGIGRIVTVSGRYYAMDRDRRWDRVQRAYDVMTQDGVGDGRKAVDVLQASYAEGVNDEFIVPVRIAPGTVEPGDGVIFFNFRPDRSRQLTQAFVSPEFTGFARQQIKPLSFVTFTQYDSDLSVSVAFEPQNLTNILGEVIANQGLNQFRTAETEKYAHVTYFFNGGLEEPFAGEDRELVSSPMVATYDKAPAMSATAVTDTAIAAIQKGIYSLIVINYANPDMVGHTGQIEPTIKAIETVDRCLGRLLEGVSKAGGTTIITADHGNAEYMLDEAGNSWTAHTTNPVPLILVEGEKVKIPGYGTNVELRSDGKLADIAPTILDILQLPQPPEMTGRSLLQPAEYEVELSRTPIPVGLN

SEQ ID NO: 73562 - protein, 315 aa, Buchnera aphidicola str. Sg (Schizaphis graminum)
MPDMKLFAGNSIPKLAKFIAHRLYINLGNAAVGRFSDGEISVQINENVRGSDVFIIQSTCSPTNDNIMELVVMVDALRRASAGRITAVIPYFGYSRQDRRVRSARVPITAKVVADFLSSIGVDRVLTVDLHAEQIQGFFDVPVDNVFGSLILLEDMLQRELKNPIVVSPDIGGVVRARAIAKLLYDTDMAIIDKRRPRPNISQIMHIIGDVANRDCILVDDMIDTGGTLCKAAEALKERGAKRVFAYATHPIFSGKASENLKKSVIDEVVVCDTIPLEEKIRLLPNVRTLTLAGMLAEAIRRISNEESISAMFEH

SEQ ID NO: 73563 - protein, 1097 aa, Oryza sativa Indica Group
MDNPEAEPDDAVLFVGVSLVLGIASRHLLRGTRVPYTVALLVLGVALGSLGANINPDLLLAVFLPALLFESSFSMEIHQIKKCMAQMVLLAGPGVLISTFFLGSALKLTFPYNWNWKTSLLLGGLLSATDPVAVVALLKELGASKKLSTIIEGESLMNDGTAIVVYQLFYRMVLGRTFDAGSIIKFLSEVSLGAVALGLAFGIASVLWLGFIFNDTIIEIALTLAVSYIAFFTAQDALEVSGVLTVMTLGMFYAAFAKTAFKGDSQQSLHHFCLFEGSLMWSYLDGQCPEVSHLAGASWGFLLLLYVFVQISRILVVVILYPLLRHFGYGLDLKEATILVWAGLRGAVALSLSLSVKRASDAVQTHLKPVDGTMFVFFTGGIVFLTLIFNGSTTQFLLHLLGMDRLAATKLRILNYTKYEMLNKALEAFGDLRDDEELGPPADWVTVKKYITCLNDLDDEPVHPHAVSDRNDRMHTMNLRDIRVRLLNGVQAAYWGMLEEGRITQATANILMRSVDEAMDLVPTQELCDWKGDSEVARIVIDESNAEGEEARKFLEDVRVTFPQVLRVLKTRQVTYSVLTHLSEYIQNLQKTGLLEEKEMAHLDDALQVAGIFCLSFNYYYADFVVSVTNHNGNTNSSQFTWQTDLKKFKRNPPLVKMPRVSDLLNTHPLVGALPAAMRDPLLNSTKETVKGHGTILYREGSRPTGIWLVSIGVVKWTSQRLSSRHSLDPILSHGSTLGLYEVLIGKPYICDMITDSVVHCFFIEAEKIEQLRQSDPSIEIFLWQESALVVARLLLPMMFEKMATHELRVLITERSTMNIYIKGEEIELEQNFIGILLEGFLKTKNQTLITPPGLLLPPNADLNLFGLESSAINRIDYCYTAPSYQVEARARILFVEIGRPEIEADLQRSASLISQTLELPRTQSKEHSGLLSWPESFRKSRGAQNGASLTEIRDHPASFSARALQLSMYGSMINDMKSGQGQGQRRQRHRHTKASSNKAHSSSYPRVPSRSSNTQRPLLSVQSEGANMTTARQAAAAGASLPPEPEEAGRRRRRQRKAIEEDEDNSSDESAGEEVIVRVDSPSMLTFRQPSSAADR

SEQ ID NO: 73564 - protein, 567 aa, Ustilago maydis 521
MPPVAAMYSSSSAASPLTPSKRDNTHAQHSVVNEQVKPLKNHELSRINDSSNDFDSQPDPKGSWRSWRRGDGLQPWENEIVRSIEVQRKANVAQLYFLNYYFDNLRYIADRKARHARFQDSTRARGLLPESDHDEPSPEYLKERSSYFGRERVLLRKRRTKLRVNQFHIITQVGAGGYGEVFLARKRDTGEICALKRLKKRILVKMDEVRHVLTERDILTATKSPWLVRLLYAFQDPDHVFLAMEYVPGGDFRTLLCNNGALKEEYARFYMAEMLVSVNELHRLGYIHRDLKPENFLVDSSGHVKLTDFGLASGALNPGKIESMKAKLDAVKDTDFVYRTPAERGSMYKKMIQHTQHRANSIVGSPDYIAPEMLRGRQYSFGVDYWSLGCILYEFLCGFPPFSGSNPDETFANLKNWQKVLQRPVYDTPENLQFNLSDVAWDAITKLVDTPERRYSSLEPVQAHPFFRPLDLNRLRELKAPFIPELENEEDTGYFDNFEDPADMARYKDVHEKQKNVEAVSENGSGAGGRALWVGFTFGKNHLGANGKPLFPPSTSKDASDAFATMF

SEQ ID NO: 73565 - protein, 515 aa, Oryza sativa Indica Group
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTEGMIVLFVMEMLEFHENDPRRTRIANAYFSLFMALGNILGYATGAYSGWYKIFPFTVTPSCSISCANLKSAFLLDIIILVVTTCITVASVQEPQSLGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSQYPNGVVLCGMLVITYVARIWIIHLVEYTNRHVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 73566 - protein, 709 aa, Buchnera aphidicola str. Sg (Schizaphis graminum)
MSRIIMLIPLNKKVSLTTISLSILYFFNKKEQKNCFKSFSYLPLIKSDNINFIRAYFSKKINVLDDINFFKKNFNSDEYSYLLDKIIKECFNKKKINEFILIKGISRKEHDDADQINFDIAQNIDAEVIFIDNLKDFSLGCFKRKERKINVFLQQKKYKNFLGLIFSDINSPFIFNKMKYNFFDKLIILKNTKKNTCIHAIKKNIFFNSFFRVIAFIPWNKKLVKSSVINIFKFLNATLVNTISIKDAFIKNITIFDEDSSVILKKSYANTLVLISSSRMETFFKTLYLVCKSKKIGAILLTGVLKLSENSIKLLKFLTNQGVPVFFIKENTVETLSQLQKFNFNINVQNKYFINKLLEYTSSFFNKNHLISLKKKTTNFYKKTYSPKEFCYRLKILSKSKHKRIILPESYEPRILKAASICHRLGIAECILLGDPKKIYNIANENKIDLNKNIEIKDPILIRDQYVPRLLEIRKNKKIDEIFARKQLKDNVILATLILESGKVDGLVSGTINTTANTIRPALQIIKTDPIYSLVSSIFFILLPNEVLIYGDCAINIEPNSKELAEIAIQSANSAKMFGIEPRIAMLSYSTGFSGTGWQVEKIRDATSIVKSKRPDLLIDGPIQYDAAISKEVAKLKIPYSSILGSANIFIFPDLNSGNITYKAVQRSADLICIGPMLQGLKKPVNDLSRGASVEDIVYTIALTSIQSL

SEQ ID NO: 73567 - protein, 523 aa, Bordetella pertussis Tohama I
MPENAQPHAVIPAADLQLSAQSPQWRVFAAAAAGAPLVARPLRVIEAAGIYVDLSMQRHSSALAQAGLALLQARDVLGARAALFAPGAQDAAHGRYPVLRAGYGAHPEEQCDIEVEIEYARMLEFVRELDRGGAYPAVLYLGGGAGQWALRLALQAFGGPAQRRQLRLVSGGDAAALHEALAGLDPRRTLVVAASRGFEPSETLDNARAAIDWLRRAGIDDVSAHLVAVTGNESAARALGVAAARVFRLPSWLQPRHELWSVGALPVALALGVDMLKALRSGAAAMDQHFLQAASAVNAPMQMALAAVANTSAMHWPTHALAVYSARLAALPACVQQLEMTLAGRAPASLPAYPVVWSPAGAPGPGAFFEWLHRAPAGAPVDFIAGLDEYPASPPAHRALLANCLAQREALLRGLPAGPGQPAAGGGRPSTLVVLRQVDPRAVGALLALYEHKAFVQAALWGAALGGADEAQACQRLAQDIARQLAVPPEAGPVDWGHDSSTAFWIDRYREQGGAGAAAGRTA

SEQ ID NO: 73568 - protein, 347 aa, Escherichia coli K12
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 73569 - protein, 124 aa, Helianthus annuus
VKKINQYFGNTEADADNSVLKKARIGKGSCGDVTILLTLVINNRQHRGKLDPICSGFFEGAIEPVVCLIDDTHTNECLKNNGGCWIIKKETLEDIDRAKKMVCQCLECKYKNTWVPIYECGCRC

SEQ ID NO: 73570 - protein, 440 aa, Vibrio campbellii AND4
MNDFSYITETQQSAIKQTRLIQIRGRVTQVTGTIIKAVVPGVRVGELCELRNPDQTLSLLAEVVGFQQHHALLTPLGNMFGISSNTEVSPLGKMHEVGVGDHLLGKILDGLGRPFDGTQNSEPTAWYPVYRDAPPPMQRKLIEKPISMGVRSIDGLLTCGEGQRMGIFAAAGGGKSTLLAKLIRSADVDVTVLALIGERGREVREFIEHDLGEEGMAKSVLVVATSDRPAMERAKAAFVATSIAEYFRDQGKRVLLLMDSVTRFARAQREIGLAAGEPPTRRGYPPSVFAALPKLMERAGQSDKGSITALYTVLVEGDDMTEPVADETRSILDGHIILSRKLAAMNHYPAIDVLRSASRVMNQIVDKTHQASAAHMREMLAKYEEVELLIKIGEYQHGADSRADMAIAQGDDIREFLRQGTHEPSELGETITQLSGIAGL

SEQ ID NO: 73571 - protein, 459 aa, Escherichia coli K12
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLIAMNVVQYTLINWLPTIFMTQGINLKDSIVLNTMSMFGAPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 73572 - protein, 317 aa, Bordetella pertussis Tohama I
MSGSSHYPVANWNLDGIVSGLRGARQEWRGPRGRLREESESGVREFPSQESLRDIMRQLFGALFPMRLGPIDLREEVEDFYVGHTIGAALDALLHQVCLELQHLGRDDPQPYGQVLERAVDIVRRFGAELPAVRKALDLDVTAAYQGDPAARSVDEVLLCYPGVTAMIHHRLANVLYRLGAPMLARIVAEIAHSDTGIDIHPGATIGRSFFIDHGTGVVIGETAIIGERVRLYQMVTLGAKRFPPGENGELKKGLPRHPIIEDDVVIYAGATILGRITIGQGSTIGGNVWLTHSVPPNSTVTQAGVINDMPDCGLGG

SEQ ID NO: 73573 - protein, 451 aa, Shewanella sp. ANA-3
MAQHFDYICLGAGSGGIASANRAAMRGAKVLLIEAKHVGGTCVNVGCVPKKVMWYGAHIAEAMNLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLNLENGESVTVDCLIWAIGRSPATGNIGLENTDVQLDSKGYVITDAQQNTTHKGIYCVGDIMAGGVELTPVAVKAGRLLSERLFNGMSDAKMDYSQIPTVVFSHPPIGTMGLTEPEARAQYGDDNVKVYTSGFTSMYTAVTSHRQACKMKLVCAGKEEKVVGIHGIGFGMDEILQGFGVAMKMGATKADFDAVVAIHPTGAEEFVTMR

SEQ ID NO: 73574 - protein, 479 aa, Gluconobacter oxydans 621H
MAERMLQFVTHPQVLPEKRDAAERRQDFGEIYRGFARSRAEEQASRCSQCGIPFCSVHCPLGNNIPDWLKLTAEDRLEEAYEMSSATNTFPEICGRICPQDRLCEGNCVINKGFESVTIGAVERFITENAFEQGWVKPALPDRDLGRSVGIVGSGPAGLACAERLRAQGYEVHVYERQDRVGGLLTYGIPSFKLEKHVVARRHALLEEQGIVFHLSTPVGSGEGETSLEDLRARHDAVFLATGVYRSRDVKVPGAGLEGVVDAIDFLTASNRRGYDEDPGEDAALHAKGRRVVVIGGGDTAMDCVRTSIRQGAERVTCVYRRDRANMPGSRQEVYNAEEEGAHFEWLGSPEAFLGDSSVSGVRVLKMRLGAPDASGRRSIEGTGQHDVIEGDLVIKALGFDPEDLPGQFNEPELAVTRWGTLTVPPGGFETSLPGVFAGGDIVRGASLVVWAIKDGRDAADAIHHYLTETVTGSLEAAE

SEQ ID NO: 73575 - protein, 553 aa, Solibacter usitatus Ellin6076
MRRILALLLMAATIPLWAAQPVRARHGMVVTRERHATQAGLQVLKNGGNAIDAAVAVGLALAVTHPSAGNIGGGGFMLIRLADGRTTFIDFREHAAQTASRNMYLDATGKATQDSVTGYRAAGVPGTVRGLEYANHKYGTRPWAELVHPAVELAAKGFPVSYALAQSLRGSRGLAAFPESQRIFLKGGKFYEPGELLTQPDLARTLERIEKQGSKDFYEGETARLLAKDMATHGGLITEADMKMYAVHERAPLTGMYHGYTVVTAPPPSSGGVGILQMLGMLDGTGYEKGGAGSASVVHYMTEAMRRFFADRSEHLGDPDFVKVPMTSLLDPKYIARQRASIDPERATPSAQIKAANFTGHESMETTHYTVADEAGNVVAVTYTLNGGFGSKVTATGLGFLLNNEMDDFASKPGEANMYGLIQGEFNAIAPGKTPLSAMTPTIVLKDGKPVLAVGSPGGPTIINTVLEVVVNVLDFGMGVQDAVNWPRFHHQWMPDELRMEPGYSPDTIALLEKRGYIIKRTNAQGEAAAIRWNNGWLEGAPDPRTEGTAEGH

SEQ ID NO: 73576 - protein, 489 aa, Bordetella pertussis Tohama I
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVPEAAGEIAYAASFLEWFAEEAKRIDGDILQSPKGGQRLMVLKQPIGVTAAITPWNFPAAMITRKVGPALAAGCTMVVKPAQQTPLTALALAVLAVLAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGEPHALGGSFFQPTVVRDVTQSMRFAVEETFGPVAPLFKFDSEDEVIGMANNTIFGLAAYFYTRDYARIWRVSEALEYGIVGINTGIISNEVGPFGGVKQSGLGREGSKYGIEDYLELKYLCVDLGA

SEQ ID NO: 73577 - protein, 421 aa, Bordetella pertussis Tohama I
MKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAVELGKRLMDRLEGLRAKCPAIADVRGLGSMVALELNDPATGKPDAEAVKRIQQQAIERGLILLSCGVYGNVLRFLYPLTIPDDQFARALDILAEIIAA

SEQ ID NO: 73578 - protein, 217 aa, Photorhabdus luminescens subsp. laumondii TTO1
MNQTLLSEYGTSSERVEHAINALRDGKGVMVLDNEDRENEGDIIFAAETMTVEQMALTIRYGSGIVCLCLTEERRQQLQLPMMVENNSSPFQTAFTVTIEAAQGVTTGVSAADRITTIRAAIADNAKPSDLNRPGHVFPLRAQPGGVLVRQGHTEAAIDLVSLAGFKPAGVLCELTNDDGSMARTLEVVQFAKLHNMPVVTIEDLVIYRQAIEQKAS

SEQ ID NO: 73579 - protein, 151 aa, Oryza sativa
  misc_feature (71)..(71): Xaa can be any naturally occurring amino acid
MTMEGSLRLGFLLVLCILAFLRPAAAIRFVIDREECFSHNVDYEGDTAHVSFVVIKAETPWHYTEDGVDLXEHFSALFEQIAKLDEALYNIQFEQHWLEAQTDRQAILNENMSRRAVHKAFFESAALIAASVVQVYLLHRLFERKLGTSRV

SEQ ID NO: 73580 - protein, 909 aa, Cryptococcus neoformans var. neoformans B-3501A
MPSSRPATSSTVPFTPKPRKRASSSKFTFTDKELNQFAGTLASVRKVRPGAILEELEQSGEGSGILHRYESSLHRGNPEAQKRSASARSVENERDRSHFRTRPSSSASITQREYNPSFLRAMSGSRDLLPESDHKSREKVNEPAKIEPVLERPTPMTELSAERRLLDKVPLEVQEAWICEDLLFVLQGVEGVLIRYDEGYDPFDEEQRVKGAKWRVNPLLDASLLSLVKRLLPLASFFTAVEASMELRTAPEYGMVSHALCSGIRAMLKEFRVLTAQLESLFLTSPTFTLQTLYLHLHPTLHTMSLLASLCHALEADQAGQGTDDLSDDDDGLGGMAEELGLGGAGLKGLMKNLKAREGLIGDGGDVLGGEVLGIICEREATMSGDPTASTLHSSLLLHASQPYCKMLIQWIATGHLSDPFDEFMVKESGHITKGVLESDYTDEYWERRYTLRDGAIPGSSKVSARNSTPSISAGVPPPRQGTNRLPGGACIPQFLQPWKHKILLAGKYLNVIRECGIEVKKPGEVDEKEMVAMNDPNFYKRIEDAYIYANKTLLKLMVEEQELIPHLRSMKHFFFLNQSDFLTNFLDLAASELRKPAKSASIIKLQSLLDLAVRNPSSSSSNDPFKDDLKVVMQSQGLYDWLLKIVSKTGSLTEEGELDFALGDIHEEEGSKREKERPLIAIDALAFDYSVKFPLSLIISRKTIARYQLIFRFLLHLHHLESALSAMWLEHKSPSWRNNSGNEDIERWKARIFSLRTRMLAFVRQVLAFATGEVLEPNWKALEEKLAKVQTVDQLLRDHVDFLDTCLKQCMLTTSKLLNIYAKLMTTISVFVSYQSSLNSALNKFLVDPIAESDPAKSKLRWTALSKFEINFNHHAKLHLDAVTYNAGSENVALLALVTRLHQITLRI

SEQ ID NO: 73581 - protein, 530 aa, Nicotiana plumbaginifolia
MADIEGEPGSSMHGVTGREPVLAFSVASPMVPTDTTAKFSVPVDTEHKAKVFKFYSFSKPHGLTFQLSWISFFTCFVSTFAAAPLVPLIRDNLNLTKMDVGNAGVASVSGSILSRLVMGAVCDMLGPRYGCAFLIMLSAPTVFCMSFVSSAGGYVAVRFMIGFSLATFVSCQYWMSTMFNSQIIGLVNGTAAGWGNMGGGATQLIMPILYDIIRKAGATPFTAWRIAFFIPGWLHVVMGILVLTLGQDLPDGNRGDLQKKGGVSKDKFTNILWYAATNYRTWIFVLLYGYSMGVELSTDNVIAEYFFDRFDLKLHTAGIIAATFGMANLLARPFGGFSSDFAAKRFGMRGRLWVLWILQTLGGVFCVLLGRSNSLPIAVTFMILFSVGAQAACGATFGIIPFISRRSLGIISGMTGAGGNFGSGLTQLLFFTSSKYSTATGLTYMGMMIIGCTLPVTLCHFPQWGSMFFPPTKDPVKGSEEHYYAAEYTEAERQKGMHQNSLKFAENCRSERGKRVGSAPTPPNLTPNRV

SEQ ID NO: 73582 - protein, 308 aa, Crocosphaera watsonii WH 8501
MTTTLQGRDILGIGDLSAEEMTAVLDLGAKLKSGQPSPRCQKILGLLFDKASTRTRVSFSAAIYQLGGQVLDLNPSVTQVGRGEPAKDTARVLDRYLDILAIRTFEQSKLETFAKYAQIPVINALTDLEHPCQIIADFMTIKECFGKLKGSTVTYLGDGNNVAHSLILGGALMGMKIRVATPKDYQPLPMIIEQAHKLAKPGFEIIITDDPVAAVKDSNVLYTDVWASMGQEDLAQSRIPIFQDYQINDELLSKAEQDAIVLHCLPAHRGEEITNSVIEGKQSKVWDQAENRMHAQKALMVSLLGIEN

SEQ ID NO: 73583 - protein, 576 aa, Vibrio sp. Ex25
MRILIFSLSVVASLSYAAKPTPFPITPDNNGQDFMVSATNPYVSSTGYSILKEGGNAVDAMVAMQMVMSVVEPDMTGIGGGTFALFYQHGKQKFLALDGRDEAPSSAHPEMFIENGKALSRDEILGPRSVAVPGTLRLLYSTHEQYGKLPWSELVQPAIKLARDGYAMNSYTYDIVVREQTRLARDPEIKALYWQDDEVKPTGTLMKNPKMAETLEKIAQQGDRYLYGGALGQHIVDTVNSRINDQHEKLSLEDFKNYQVKSRDIIESDYRGNKIVSFGYPASGGVMVAQSLKLLEPYDISQMALTDVEPWRLMTEAMRLAKADRIAYAGDPDYVEAPVEQLLSKTYLDQRRDLIPDNGTSKENPKAGQITQTQYAQYQGFESKDTGHISIVDREGNAIAMTSTVGTGMGSGVMVDGVILNAQMANFSPQPTVNGKPTQNSIEAGKRPRSAITPLMVMDSDDNLRLVVGSPGSSQIPGYVLKTVVGVLDWKLSAQDAIDLPNIQYGTKIDRTKSYDPTGLLVEKKTFAEMLVPEFMELGYPVHVIPVVSGLNAIELKDGKLYGATDRRRASSSMGE

SEQ ID NO: 73584 - protein, 463 aa, Crocosphaera watsonii WH 8501
MANLNPTASYSLALTIELPNIAGTLANVTQAIAGAQGSFGQISLIEHNLKITQREITVEASSEEHAEQIVSAVREIPNVKILKVSDRTFELHRKGKITIESRLPLHSQGDLAMAYTPGVGRICKAIATDPSEVYNLTIKNNTVAVVTDGSAVLGLGNLGPEAALPVMEGKAMLFKEFAKVDAFPICLATQDTEEIIETVKRIAPVFGGINLEDIAAPRCFEIEKRLRQELDIPVFHDDQHGTAIVTLAALFNALKLVHKTLEGVRIVINGAGAAGVAIASLLRAAGATTIWLCDSKGLISHNREDLNPQKKAYAVSASGTLADAMQGADVFLGVSAPGVVTPEMVRSMNKDPIVFAMANPIPEIQPELVTNDVAVMATGRSDYPNQINNVLAFPGVFRGALDCRAKNITERMYLEAAKAIASLVHSNQLNAEHIVPSVFDERVSHAVASAVELAARQDGVANQ

SEQ ID NO: 73585 - protein, 194 aa, Glycine max
MELEPKKGPVHDQYDDLVGSFSSSSSSTSSSVSGISSGSSLESDSFEEVTSSASSSSSSAADDQLVVVADPLGDMTSLFQQLPIKRGLSKFYQGKSQSFTSLTNVRSLEDLAKPENPYNKRLKSCKSYAGGLAESHSTRAVSKRGMVHSTSSRGSCSSFRRGSATTNFMGSRPPIPPHRSTSTNTIPNQTVLFA

SEQ ID NO: 73586 - protein, 313 aa, Vitis vinifera
MAVANHAEDDPATSRSLASASSRSEFNKKASRIGLGIHEACLKISRLAKLAKKSSMFNDPIMEIQELTALIKDDITALNIAVSDLQTLQNLEIADGNYSDDRVVHSNTVCDDLKNKLMGATKQLQDVLTTRTENIKAHENRKQIFSTNVSRENPFQQHAKTVTEPPPWSSLSKTSGNLQPSVLSSNGVQVGNQLRRRLAVDNTPSNHMEVSMLQQVVPRQENYTQSRALALQNVESTISELSGIFTHLATMVAQQGELAIRIDDNMDESLANVEGAQSALLKHLNQISSNRWLLLKIFAILIFFLMIFIFFVV

SEQ ID NO: 73587 - protein, 300 aa, marine gamma proteobacterium HTCC2143
MSLTRDAATNIANVLTEALPYIQRFIGKTIIVKFGGNAMVDDDLKIQFARDVVLMKLVGMNPIVVHGGGPQIGKLLKQLNIESRFVDGMRVTDGQTMDVVEMVLGGSVNKEIVSLLNRNGGKAVGITGKDGELIRARKMNVSQKTPEMIEPEIIDIGHVGEVESIDISVLEMLTSSNFIPVIAPIGVGEDGSSYNINADLVAGKIAEVMQAEKLMLLTNVAGLMNKNDEVLTGISTKEVDELIADGTIYGGMLPKIRCAQEAVNGGVTSAHIIDGRVPHAVLLEIFTDEGVGTLITNRRL

SEQ ID NO: 73588 - protein, 487 aa, Acinetobacter sp. ADP1
MSETTQPDQLQRKLGARHLNMIAIGGSIGTGLFLASGSTIANAGPGGALLAYVLIGIMIYFLMTSLGELATHNPTSGAFFTYGNRYVEEGFGFALGWNYWYNWAITVAFELVAVQFIMKFWFPDIPGFYWSAIFLVVIFAINAMTVKGFGESEFWFSMVKVVAIIAFIIIGMAMIIKIMMTPNMATFGNWTYKDAPFVGGLQAMIGVAMIAGFSFQGTEMVGVAAGESKDPKRTIPLAIKQIFWRILLFYVVCIFIIGTLVSYDDPRLLQAAHSSDIALSPFTLLYEKAGFAFAASLMNAVILTAILSAGNSGMYSSTRMLWDMAKEGRAPKWFAKLDRRGVPMNALYATTAIAALCFLTTFIGEQEVFNWLLNMSGMCGFIVWLGIAISHYRFRKGYIAQGYKLEDLAYRAKFFPFAPWFAFILCSIIILGQNYQAILGGKIDWTGLLSTYISIPLFLIIWLGYKWKYKTKLIPYQEMNVKAGKED

SEQ ID NO: 73589 - protein, 368 aa, Zea mays
  misc_feature (156)..(156): Xaa can be any naturally occurring amino acid
MALHAAAPACAVFCRLPSPSPSHAGSRRSLPAVASPRGVVSAAPLRTRAVPTKAIVNSDGIPETSDSPHVVCFGELLIDFVPTVNGVSLAEAPAFKKAPGGAPANVAVGIARLGGSSAFIGKVGDDEFGYMLADILKQNNVNNQGLLFDPHARTAXLAFVSLRSDGEREFMFYRNPSADMLLEEKELDLDLIRKAKIFHHGSISLITEPCKTAHIAAARAAKDAGVLVSYDPNLRLSLWSSPEDARDGILSVWRTADIFKVSEEEVSFLTNGEDPYDDAVVKKLMHSNLKLLLVTEGPDGCRYYSKDFSGRVGGLKVSAVDTTGAGDAFVAGVLSQLATDFSLLQEVDETMFEVFLQPATEPSSTLLL

SEQ ID NO: 73590 - protein, 586 aa, Ralstonia metallidurans CH34
MLSDGRNPGASRKARIPNSWLRWLPGVAMARDYQASWLPRDLTAGLVLTTMLVPVGIAYAEASGVPGVYGLYATIVPLLAYAVFGPSRILVLGPDSALAAPVLAVVVQMSGGDPARAIAVASMMAIVSGLFCIVMGLLRLGFITELLSKPIRYGYMNGIAFTVLVSQLPKIFAIRVEDTGPLRELVLLGQALVAGQVNWYSAAVGAGSLVLILALKRFERVPGILIAVIVATLCVIMFDLDQMGVKVLGSIPQGLPAFAVPWASGLDFVKIVAGGCAVAMIAFADTSVLSRSFAARHHHRVDPNQEMVGLGAANLAAGFFQGFPISSSASRTPVAEAAGARTQLTGVVGALAVAALLVVAPDLMRYLPNSALAAVVIAAALGLFEFADLKRIYRIQQWEFWLSMVCFVAVAVFGAIPGIGLAVVLAIIEFLWDGWRPHYAILGQVEGLRGYHDLERYPHGKRIPGLVLFRWDAPLFFANAELFQERLQEAIDESPAPVYRVVVAAEPVTSVDVTSADMLRELSRTLGEHGIALHFAEMKDPVRDKLRRFELMDVIGEDRFHPTVGSAVDDYVGRQGDWPEAWGRNE

SEQ ID NO: 73591 - protein, 198 aa, Buchnera aphidicola str. Sg (Schizaphis graminum)
MTLVTQKAPNFIAPAILKNGKIMNNFDLKKYSNGQITVLFFWPMDFTFVCPSEIIEFNKTFEAFEKRNVKIVGVSIDSVFVHQAWQNTFPENGGIGKIKFPMVSDIKHEIQKSYHIEHPELNIALRASFLIDENWIIRHQVVNDLPFGRNIDEMIRMIDALNFHNKYGEVCPVNWKHGQEGMKASQEGVSSYLKKYFS

SEQ ID NO: 73592 - protein, 567 aa, Debaryomyces hansenii CBS767
MSEVSLGRYIFERLRQLLVQTVFGLPGDFNLSLLDKIYEVDGLRWAGNANELNAAYAADGYSRVKGLACLITTFGVGELSALNGIGGAFAEHVGLVHIVGVPSISSQAKQLLLHHTLGNGDFTVFHRMSNNISQTTAFISDIKSAPKEIDRCIREAYIFQRPVYIGLPANLVDINVPAVLLNIPIDLSLRENDPEAQEEVIDNILQLISEASNPVILVDACTSRHNCNGEVEALVNKTQFPVLTTPMGKSSFNESHPRFAGVYVGTMSHVEVKNLVDGADLILAVGALLSDFNTGSFSYSYKTKNVIEFHADCIKIKQGTYPGVQMKEVLNVLIDKIDPAVKHYNPIAIPSPTFLTNSVTNSDVLSALLTQEWLWSKVSAWFREGDIIITETGTSAFGIVQTKFPNNTIGISQVLWGSVGFTVGATLGAVMAAEEIDPNKRVILFVGDGSLQLTVQEISTMVKWETRPYLFVLNNDGYTIDRLIHGMSATYNDIQPWNNLALLPLFNAKYYDAIQVSTTDELEKLFCDEEFAINSKIRMIEVMLPRMDAPINLIKQMEFISKMNADT

SEQ ID NO: 73593 - protein, 320 aa, Rhizobium leguminosarum bv. viciae 3841
MSHKPGRGRIYSSITETIGDTPLVRFDKLAREKGVVANLIGKLEFFNPIASVKDRIGVAMIEGLEAQGKITPGKTVLIEPTSGNTGIALAFAAAAKGYRLILTMPETMSVERRKMLALLGAELVLTEGPKGMKGAIAKAEELASSLDDAVIPQQFENPDNPEIHRKTTAEEIWNDTDGTVDIVVSGIGTGGTITGVGQVLKSRKPEIKIIAVEPADSPILSGGNPGPHKIQGIGAGFAPKILDTGIYDEVVTVTNDEAFEQARLVARLEGVPVGISSGAALTAAIKVGIRPENAGKNIVIIIPSFAERYLSTALFEGLGS

SEQ ID NO: 73594 - protein, 481 aa, Helicobacter pylori 26695
MIVRTQNSESKIKEFFEFCKENEVEFVDFRFSDIKGTWNHIAYSFGALTHGMLKEGIPFDASCFKGWQGIEHSDMILTPDLVRYFIDPFSADVSVVVFCDVYDVYKNQPYEKCPRSIAKKALQHLKDSGLGDVAYFGAENEFFIFDSIKIKDASNSQYYEVDSEEGEWNRDRSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQVFSEEFIQAYQSLKFNAEVFPWESKPHPFEFITTYSC

SEQ ID NO: 73595 - protein, 459 aa, Vibrio vulnificus CMCP6
MTAPFNTLSLKPELLSTLDTLGYTEMTPIQAQSLPLVLDGKDVIGQGKTGSGKTATFALGLLSNLNVSRFRVQSLVLCPTRELADQVATEIRTLARGIHNIKVLTLCGGMPMGPQILSLEHGAHILVGTPGRILDHLSKGRIDLAELNTLVLDEADRMLEMGFQDAIDAIIDVAPTQRQTLLFSATFPEQIETIASKVMQNPEMVKVESTHQKSTIEQRFYQLENTEERDNALEALLLTHRPESTVVFCNTKKEVQNVTDELNHRRFSVIELHGDMEQRERERALTMFANKSISILVATDVAARGLDVDNLDAVINFELSRDPEVHVHRIGRTGRAGAKGIAISFFSEKELYRVERIEEYMGIDVHPAKLPQPENPKPYYPSMRTIQILGGKKQKVRAGDILGSLTKEAGIDGKLIGKINILPMVSYVAIDNSVAKIAEQQLQNGKMKGRNFKARIMKG

SEQ ID NO: 73596 - protein, 79 aa, Triticum aestivum
RAGAQAATIATLAAAVPTLASVSMLPWARAHLNPTGQALIISTVAGMAYFIVADKTMLSMARKHSFEDAPEHLKNTSFQ

SEQ ID NO: 73597 - protein, 346 aa, Synechococcus sp. RS9916
MAKLLVTGGAGFIGSHTCIALLEAGHEITIIDDFSNSSELALKRVQDISLKSLEYIKGDICDNYFLDQVFSIASKQGAPFEGVIHFAGLKSVGESVNNPLKYWNVNVCGSYSLLSAMSNNNCNTLVFSSSATLYGDPVEVPIKETAPIKPINPYGYTKAAVEQMLTDLFDSNSQLWRIACLRYFNPVGAHPSGLIGENPLGTPNNLFPYISQVAIGRRNSVSVFGGDWPTPDGTGIRDYIHVMDLAEGHVETLNYLLNDKPQLVTLNLGSGSGYSVLQLIKEFEIASGNSIPYEIVEKRNGDAAITIADPTLAADKIGWRCVRDITDICRDGWSWQSKNPDGYKNT

SEQ ID NO: 73598 - protein, 247 aa, Saccharomyces cerevisiae
  misc_feature (1)..(1): Xaa can be any naturally occurring amino acid
  misc_feature (167)..(167): Xaa can be any naturally occurring amino acid
XRTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 73599 - protein, 247 aa, Saccharomyces cerevisiae
  misc_feature (167)..(167): Xaa can be any naturally occurring amino acid
ARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 73600 - protein, 430 aa, Prochlorococcus marinus str. MIT 9515
MKETIDFLIDTIEARQVLDSRGNPTVEAEVFLECGAIGRAIVPSGASTGAHEAHELRDGGTKYMGKGVLDAVNKIHETISPALCGLSALDQTIIDKLMIEIDGTPNKSNLGANSILAVSLANARAASKALDMPLYRYLGDPLSNLLPVPLMNVINGGAHAPNGLDCQEFMLVPHGVKTFSEALRMGTEIFHSLKSLLDKKGLSTAVGDEGGFAPELSSCEAAGDLLLEAIQKAGFIPGKQVSLALDVASTEFYRDGFYKYEGTNLTSSQMISYLSNLVSNYPIVSIEDGLGEDDWEGWAALNKEIGHKVQLVGDDLFVTNTERLRKGILEKSANSILIKVNQIGTLTETLEAMDLAKSAGFTSVISHRSGETEDTTIADLSVATRAGQIKTGSLSRSERIAKYNRLLRIEEELGNQARFAGDLGLGPKNI

SEQ ID NO: 73601 - protein, 445 aa, Glycine max
MSCSSSSGSEEGDEGFDSYRKGGYHAVRVADQFAAGRYIAQRKLGWGPFSTVWLAYDTKTESYVALKIQKSSAQFAQAALHEIELLSSIADHNPTNSKFVIQLIDHFKHTGPNGQHLCMVLEFLGDSLLRLIRYNRYKGLPLNKVREICKCVLTGLDYLHTDRGMIHTDLKPENILLCSTIDPAKDPLRSGLSPILERPEGNTNGGVTSLIEKRLRRRARTAVAKISGRRASMGGIGDAAKTGRNIDGIDVRCKVVDFGNACWADKQFAEEIQTRQYRAPEVILQAGYSFSVDMWSLACIAFELATGDMLFTPKGGQGFSEDEDHLALMMELLGKMPRKIATAGAQSKDFFDRHGDLKRIRRLKFCPLDKLLTDKYKFSVNDAQEFSEFLLPLFDFAPEKRPTARQCLQHPWLNYMESPPNEMRNESAVEKVDVGMSNLKIRVGK

SEQ ID NO: 73602 - protein, 320 aa, Brucella melitensis 16M
MAFLLEMLKKSPPVLALSPAMEPAMTTLENPEMQAQLLSAALPYMQRYENKHVVVKYGGHAMGNPELGKAFARDVALLKQSGVNPIVVHGGGPQIQAMLTKLGIESRFEGGLRVTDEKTVEVVEMVLAGSINKEIVALINAEGEWAIGLCGKDGNMVFAQKAHKTVIDPDSNIEKVLDLGFVGEPAEVDRTLLDLLARSEMIPVIAPVAPGRDGHTYNINADTFAGAIAGALAATRLLFLTNVPGVLDKDKKLIKELSVADAQALIRDGTISGGMIPKVETCIDAIRRGVEGVVILNGKTPHSVLLELFTEHGAGTLIVP

SEQ ID NO: 73603 - protein, 241 aa, Brucella melitensis 16M
MSEQDKKQAAIKAAQAAADAVREAQAALAEEGRLLFKKSWIFIRGVPSMKFLPPEGPVEIAFAGRSNVGKSSLINALVGKKGLARTSNTPGRTQELNYFVPDGYSGENGDLPPLALVDMPGYGFAEAPKAQVDAWTRLVFDYLRGRTTLKRVYVLIDARHGIKKNDAEVLDLLDKAAVSYQIVLTKIDKIKPAGVPRLLEETHKLTYKRAACFPGIIATSSEKGQGLDDLRAAIALLLKEY

SEQ ID NO: 73604 - protein, 421 aa, Gluconobacter oxydans 621H
MPDTIEVTRLDNGLTIITERMDRVETVSFGAYVSIGTRDETADNNGVSHFLEHMAFKGTERRSASRIAEEIENVGGYINAYTARETTAYYVKLLKNDLALGVDIIGDILTHSTFLDAEIERERGVILQEIGQANDTPDDIIFDQFQERAFPEQPMGRPTLGSEERVSTMTRDTLMSYMREHYTTHNITIAAAGNLHHQQVVDLVKDHFRDLPTHQTPRPRAASYEGGELRTTRELDQAHLVMGFPSVSYMHPDHYAVMILSTLLGGGMSSRLFQEIRERRGLVYSVYSFASPFSDSGLFGLYAGTGEEQTAELVPVMIDELKRLQDGLSAEELSRARAQLKSSLLMSLESTGSRCEQLARQIQVHNRPVPTAETVGKIDAVTEEDILRVARTIFSGTPTFTAIGPIDNMPSLEDITARLAA

SEQ ID NO: 73605 - protein, 192 aa, Triticum aestivum
  misc_feature (47)..(47): Xaa can be any naturally occurring amino acid
  misc_feature (76)..(76): Xaa can be any naturally occurring amino acid
  misc_feature (85)..(85): Xaa can be any naturally occurring amino acid
  misc_feature (101)..(101): Xaa can be any naturally occurring amino acid
  misc_feature (111)..(111): Xaa can be any naturally occurring amino acid
  misc_feature (118)..(118): Xaa can be any naturally occurring amino acid
  misc_feature (135)..(135): Xaa can be any naturally occurring amino acid
  misc_feature (142)..(142): Xaa can be any naturally occurring amino acid
  misc_feature (145)..(145): Xaa can be any naturally occurring amino acid
MAATIQSVKARQIFDSRGNPTVEVDVCCSDGTFARAAVPSGASTGVXEALGTEGMVDSDYLGKGCIQSCLDNVNSXIAPVWIGKXDPNSSNWSSDNYMVQXQLDGTKNEWXLCKQELXANATWLCQQLFCKAGSXVQEDPPXQHXQPGWNNGLPVLHQTMVQAGNNCIRISTRPSGGRNGLCQTSYRLSQGK

SEQ ID NO: 73606 - protein, 490 aa, Solibacter usitatus Ellin6076
MHSNILSIPLMAKKTPITVAHGDGIGPEIMNATLQILEAAGAALEIETIEIGEKVYLRGNSAGIEPSAWDSLLRTQVFLKAPITTPQGGGFKSLNVTTRKTLGQYANVRPCVSYHPFIDTKHPNMDVVIVRENEEDLYAGIEYQNTPEVMSCIKLISRPGSEKIVRYAFEYARLHNRKKVTCFMKDNIMKMTDGLFHKVFDEIGAQYPDIEKEVWIVDIGAAKMADTPEAFDVIVMPNLYGDILSDVAAQIAGSVGLAGSANIGEKCAMFEAIHGSAPRRAGQNLANPSGLLLGAVLMLVHINQPEAAAKVHNAWLRTIEDGVHTYDVFTEGVSSKKVGTKEFAAAVIERIGQKPNILKPVTYAHRPEKAAPAVQAERPAVAMELKGIDVFVYWPSRNPNTLAEAVGKLAVDGVKLQMIDNRGVKVWPAGRAETFCTDSFRCRFMADGATDMGKLLDVARRISDAGIDIAVTETLRNFDGVAGFTLAQGQ

SEQ ID NO: 73607 - protein, 77 aa, Bacillus halodurans C-125
MADTLSRITKIVVDRLGVDEAEVKPEASFKDDLGADSLDVVELVMELEDEFDLEISDEEAEKIATVADVVEYIEGRQ

SEQ ID NO: 73608 - protein, 284 aa, Glycine max
MAKDVEVAERGSFSGKDYQDPPPAPLIDAEELTKWSFYRALIAEFIATLLFLYITVLTVIGYKHQTDHADACGGVGILGIAWAFGGMIFILVYCTAGISGGHINPAVTFGLFLARKVSLIRAIMYMVAQCLGAICGVGLVKAFQKSYFNKYGGGANSLADGYSTGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAAKALGSFRSNPHN

SEQ ID NO: 73609 - protein, 551 aa, Prochlorococcus marinus str. MIT 9515
MNIINGFHLKNIRGDILGGITAAVVALPLALAFGNAALGPGGAIYGLYGAVVVGFLAALFGGTPSQVSGPTGPMSVTVAGVVAGLAAVGVPRDLSAGQILPLVMAAVVIGGLLQILFGILKLGKYITLVPYSVVSGFMSGIGVIIITLQIGPLLGISTRGGVIESLSTVFSNFQPNGAAVGVAIMTLGIVFLTPRKISQWVPSPLLALLIVTPISILIFGDGALDRIGEIPRGVPSLSFPSFNQYFPIIFKAGLVLAVLGAIDSLLTSLVADNISQTKHNSDRELIGQGIGNAIAGLFSGLPGAGATMRTVINVKSGGSTPISGMVHSIVLLIVLVGAGPLAEQIPTALLAGILIKVGLDIIDWGFLRRAHKLSLKTSVVMYGVLLMTVFWDLIWAVLVGVFIANMLTIDSITETQLEGMDKDNPLSNEDQQSQNLLPADEKALLDRCSGEVMLFRLKGPLSFGAAKGISERMMLVRNYKILILDITDVPRLGVTATLAIEDMMQEAKNNSRKAFVAGANEKVKERLSKFGVSGIIETRKEALEAALNELA

SEQ ID NO: 73610 - protein, 433 aa, Xylella fastidiosa Temecula1
MSGMVADKQGGPTLARIAVVGLGYVGLPLAVAFGRQRPTLGFDIDICRVQQLCAGHDITCEIELEELQAARHLRYSSDPRELSDCQIFIITVPTPIDVVEQPDLGPLRSASMLVASVLKPGDLVIYESTVYPGTTEEVCVPLLEAGSGLRFNVDFHCGYSPERINPGDRKRRLQDICKIISGSTPDITAVVDALYSQIIVAGTWCAPSIRVAEAAKVVENIQRDVNIALVNELALIFDRLGIDTLDVLEAAETKWNFLPFRPGLVGGHCIGVDPYYLLHKSESVGYYPDLIHTARRVNNRVSRHVVDRVVALLGELSVPMTRAVVLVLGVTFKEDCPDLRNSRALDLVRMFRTLGAQVDVCDPCADPQQALEHEAVTLCTEPKAGAYDAIVLAVAHAQYRMYDVATIAALGKSQAVVYDVKSVWPRAAVTDRL

SEQ ID NO: 73611 - protein, 303 aa, Sulfitobacter sp. EE-36
MTSILGIGECMIELSSAGDDLWRQRFSGDVFNALWYARAHSADDADVAFHTAVGTDPMSDQMLTFIRSGGIRCAQTPRIADRRPGLYTIQLNGAERSFTYWRDTSAAQMMVRHPGPLWRDVAGADVVYFSGITLAILPPDDLETLLAGLVEHKKQGGLLAFDPNIRPHLWADKDRMLDVISRTAGLSELVLPSFDDETTAFGDRTPQDSAKRYADLGAGHVVVKNGPADTIHLQDGQLTAFPVAPVGDIIDTTAAGDSFNGAYIACLLRGLPTEAAISAAQRCAGQVIRHKGAIISRNDLGLV

SEQ ID NO: 73612 - protein, 208 aa, Xylella fastidiosa Temecula1
MDDVTKALNLVPMVVEQTSRGERAYDIYSRLLKERLIFLVGPIDDYMANLIVAQLLFLEAENPEKDINIYINSPGGVVTAGMAIYDTMQYIKPAVSTICVGQAASMGALLLASGASGKRYALPNSRVMIHQPLGGFQGQATDIDIHAREILALRARLNEILAKHTGQSLETIAHDTERDNFKSAVDAQAYGLVDQVFGQRQEELIQSS

SEQ ID NO: 73613 - protein, 228 aa, Pediococcus pentosaceus ATCC 25745
MDQNELKKLVGEEAVKFIEDGMTVGLGTGSTVKFMVDALGERVKNENLNIVGVPTSDRTAEQARSLGINVKSVDEVDHIDLTIDGADEISSDFQGIKGGGAAHLFEKIVATNSKKVMWIVDESKMVDHLGAFPLPLEVIPYGSKQVFKKLEKEGLHPEFRKNDAGEYVLTDSKNYVIDLHLGEIKHPHQLADYLIKQVGIVEQGLFLDMVNTVIVGRQNGPEVLTARP

SEQ ID NO: 73614 - protein, 174 aa, Nostoc sp. PCC 7120
MATGRRKANRTKKEETNWQERVIQIRRVSKVVKGGKKLSFRAIVVVGNERGQVGVGVGKASDVIGAVKKGVADGKKHLIDIPITKSNSIPHPIDGVGGGAKVMMRPAAPGTGVIAGGAVRTVLELAGVRNVLAKQLGSNNPLNNARAAVNALSTLRTLAEVAEDRGIAIEKLYI

SEQ ID NO: 73615 - protein, 388 aa, Anaplasma phagocytophilum HZ
MNVHEFQAKGILSGFDVRVPKGVVVRSVEEVDSALGSLAAGIVAVKAQIHAGGRGKAGGVKIGKAREEVADLVKSMLGSVLVTHQTSAAGQKVHAVYLEEGVSIKKEYYLGAVVDRKAGMVSVIFSSEGGMDIEEVAHSRPEMVVVVNVDPVYGFLDFHGRKLCYGLGLKKEQVVQITAMARKVCRALMETDASQVEINPLVETTCGEFIALDAKMTFDDNGLFRRPEIVKLTDPHEYSEEELEAAKYGLSYIKLDGNIGCMVNGAGLAMATMDIVKYYGGEPANFLDVGGGASKDTVREAFKIILRSGVDGILVNIFGGIMRCDVIAAGIIESAKEIGVSVPMVVRLSGTNYKIGKEMLDASGLSIVTAENLDEAARFVVDLVGKRG

SEQ ID NO: 73616 - protein, 226 aa, Pediococcus pentosaceus ATCC 25745
MAKLVLIRHGESTANRDNIYTGWSDVPLTPLGIKQAQRAGKLIAKLGINFDMVHTSMLKRAIVTANIVLDDLNQNWLPINKTWRLNERHYGALRGQNKDETRQIYGKEQVALWRRSFDAVPPLLEHPDDDRRYAVNGILNEPLGESLHMAYNRLLPYWIDQIAPRLMEGQNQLVVAHGSSLRALIKYLENISDQGIDGVEVENGEPIIYELKSDLSIQNKIILKEA

SEQ ID NO: 73617 - protein, 488 aa, Polaromonas sp. JS666
MGKITGFMEYQRIEEGYKPVPERLKNYKEFVIGLNDAQAGKQAARCMDCGTPFCNSGCPVNNIIPDFNDMVFRADWKNAIDTLHSTNNFPEFTGRICPAPCEAACVLNVNNDPVGIKSIEHAIIDRAWSEGWVKPELPKHKTGKKVAVVGSGPAGMAAAQQLARAGHDVTLFEKNDRIGGLLRYGIPDFKMEKIHIDRRVEQMRAEGVTFRAGVMIGSLPKDSKVTNWAKETISAEQLQKDFEAIILTGGAEQSRDLPVPGRDLDGVHFAMEFLPQQNKINAGDKVKGQIRADGKHVIVIGGGDTGSDCVGTSNRHGAASVTQFELMPQPPEEENRPMTWPYWPIKLRTSSSHEEGCEREFAISTKELMGEKGKVTGLKTVRVEWKDGRMVEVPGSEQTLKADLVLLAMGFVSPVASVLEAFGVEKDNRGNAKAGTDFTGGYATNVPKVFAAGDIRRGQSLVVWAIREGRQAARAVDEFLMGYSDLPR

SEQ ID NO: 73618 - protein, 362 aa, Buchnera aphidicola str. Sg (Schizaphis graminum)
MGFKCGIIGLPNVGKSTLFNVLTKGNSAVANFPFCTIKPNIGIVSVPDNRINNLSKIILPKKITNAFIEFVDIAGLVKGASKGEGLGNQFLSNIRDTHAIAHVVRCFKDDNVSHIYNQLQPKIDVDIINSELILADFETCEKSILKLQKKLNFNKKEIEEKLVVLSKCLDHLKKFLMLKTLELDENEKKIISYLRFLTLKPTMYIANINEQKESCFFLNELEKMAKKEGSSVIPINSNLELDLIKMNEDEQKYFMKSFNITNLGLNNIIKSGYKILNLITFFTAGIKEVRAWAIPNGSTSLQAADKIHSDFRRGFIRAQIINYLDFIKYKSETKVKEAGKYRSEGKFYQIQDGDIINFLFNV

SEQ ID NO: 73619 - protein, 299 aa, Oryza sativa Japonica Group
MAPEGDGDGGVVVTARVLRTGETVEVAGDLLVAADGCTSAIRRRFLPELKLRYSGYCAWRGVFDFSGKEGCTTMVDIRRAYPELGNCLYFDLAYKTHAVLYELPKNRLNWLWYINGDEPELMGSSVTMKVNEATVSEMKEEAERVWCPELARLIGETAEPFVNVIYDAEPLPGLSWAGGRVALVGDAAHPTTPHGLRSTNMSILDARVLGCCLARWGGDGNAEPTSTPRRALAEYEAARRPVVAAQVLHARRLGRLKQGLGMGSAGDGEGFDARTATEEEISQLRQSSMPYFSGAPTIE

SEQ ID NO: 73620 - protein, 251 aa, Photobacterium sp. SKA34
MTDTTQDTTHFGFRTVAKDEKATMVAEVFHSVAAKYDIMNDLMSMGIHRVWKRFTIDCSGVRKGQRVLDLGGGTGDLTAKFSRIVGETGQVILADINNSMLNVGRSKLRDSGIVGNVGYVQANAEELPFPDNYFDCITISFCLRNVTDKDKALRSMYRVLKPGGRLLVLEFSKPSLEPLSKIYDAYSFHLLPKMGEIIANDAESYRYLAESIRMHPDQETLKGMMDEAGFDQTSYYNLTGGIVALHRGYKF

SEQ ID NO: 73621 - protein, 338 aa, Picea sitchensis
MAYSWKMKYIVAVSAIALYSTVSVVAAEEDSDCSGKENCINKSTVILPVKIGAIASIIVGITIGVCLPLLGRTFTSPRPDRNTYFVIRAFAAGLFLATALVQILPDVFESPTRESSSWHNFPLPGFVAMFTSLSILIVDALATGYSHLKNQKNPSDEGKDLAGNAKDSGGYAHGSNTIDEDSRFRHRVISQVLELAIIAQSAVVGISLGGAENPWMVIRTLVAAFTYQQFLEGMGLGGCLIQEGFNNKFPVVSTISAFLAGVTTGIGLLSSASSPTAGIVERVFNTGSAGILVYMCLVDLFAAFYFKSKMQKRGALEIWAYMALLLGMGAFFLYIKWT

SEQ ID NO: 73622 - protein, 814 aa, Buchnera aphidicola str. Sg (Schizaphis graminum)
MKLLKFGGTSLANAKKFLCVADIIEKKNKKEQIAVVLSAPAKITNYLATIIENKIDDEVLKKINLAKNIFIELIQDIKRIQPLFPYENTKSTIEIEFNKLKKIINGILLIKQCPEGIKPIIISRGEILSVDIMKNILQSRNHEVTILNPVTNLLSIGNYLDSTIDIKESKKRIKKINIDQKNIILMAGFIAGNKEGELVVLGRNGSDYSAAILASCLNAKCCEIWTDVDGVLTADPRIVSNTYLLDYISYQEAMELSYFGAKVLHPRTIEPISQFQIPCVIKNTNNTESKGTWIGKENNPSDNSLKGVTYLDNIIMFNISGSCLKDSGNTIARIFTILSRESMKIILIIQSSSENQINFCTFEKDIDYILLILKKEFTLEIKEGLLNDFNIVKNLTILSVIGSNISEKNNIASKIFSSLGSSKINVLAIAHGSSKHSISIVIKKENLLQGIQNIHNTLFFKKTIINVFLIGIGGVGKALLKQILKQEKFLDQKNIKIQFRMIANSKKLLFLKNSINLNNWEENFKKSKEKFNLTILNELLKNTCDSNSVIIDCTSDYILSKQYISFIKKGFHIITSNKKANTDSLKYYSEIRTTALKENKKFLYETNVGAGLPVINTLQSLFSTGDCLISFKGILSGSLSFIFGKLEEGVLLSEATKEAKKLGFTEPNPFDDLSGIDVARKLLVLAREIGYSIELKDISIEPILPERFKKYQNSEEFLFKLKELDSFFSERVNKARDIGNVLRFIGSIEKNGKCSVKIEEINSNNPLYKVKNGENALTFYTNYYQPIPLVLRGYGAGNDVTASGVFSDLLRIIL

SEQ ID NO: 73623 - protein, 504 aa, Saccharomyces cerevisiae YJM789
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVNEKENTFKQDTKHENSELLKGPTEPNITKMSPVSSSPPGHDINVNDGTNQNTNEDDSDFFFDLEKEIELFRR

SEQ ID NO: 73624 - protein, 470 aa, Oryza sativa Japonica Group
MENSQVWLLWGALSVAVLFYLSTLRRRHAGGKPLPPGPTPLPLIGNLHLAGGTSFHHKLRDLARVHGPVMTLKLGLATNVVISSREAAIEAYTKYDRHLAARATPDTFRACGFADRSMVFIPSSDPRWKALRGIQGSHVFTPRGLAAVRPIRERKVGDLMAYLRAHAGEEVLLGQAMHTGLLNLVSFSYFSIDIVDMGSQMARDLREVVDDIISVVGKPNISDFYPFLRPLDLQGLRRWTTKRFNRVFSIMGDIIDRRLAHIRDNKPSHNDFLDSLLELMAAGKIDRVNVLDMLFEAFVAGADTMALTLEWVMAELLKNPGVMAKARAELRDVLGDKEVVEEADAARLPYLQAVLKEAMRLHPVGALLLPHCAVEDGVEVGGYAVPKGSTVLFNAWAIMRDPAAWERPDEFVPERFVERAPLLDFRGKDAEFMPFGSGRRLCPGLPLAERVMPFILASMLHTFEWSSPAA

SEQ ID NO: 73625 - protein, 625 aa, Pasteuria ramosa
MNKYKKIFISCSFSVFMLCGNFHLVSAEKYGENWMIDIRKKIETIFSESHIGLDHKIFEVFMTLAQDTNFKNIFSGPVGPPGPAGPMGPPGREGPPGIPGRPGKKGDIGIPGPQGYPGEPGPQGRQGEAGLPGPPGKQGEPGLSGPKGEKGDPGEPGPQGRQGEAGLPGPPGKQGEPGLSGSKGEKGDPGESGPQGRQGEAGLPGPKGDQGEAGMPGPKGDQGEAGMPGPKGDQGEAGMPGPKGDQGEAGMPGPKGDQGEAGMPGPKGDQGEAGIPGPKGDQGEAGMPGPKGDQGEAGMPGPKGDQGEAGIPGLKGDQGEAGMPGLKGDQGEAGMPGPKGDQGEAGIPGSKGDQGEAGIPGPKGDQGEAGIPGPKGDQGEAGIPGPKGDQGEAGIPGPKGDQGEAGIPGPKGDQGEAGMPGLKGDQGEAGMPGLKGDQGEAGMPGPKGDQGEAGIPGSKGDQGEAGIPGPKGDQGEAGIPGPKGDPGEAGMPGPKGDRGFVGPRGEVGSPGPRGDRGLVGLRGAQGDIGKRGLPGVPGLNGAPGAPGAPGRRGEPGPQGAQGEKGDKGEKGDKGDKGDKGDKGDKGDKGDKGYKGDKGDKGYKGYKGDKGDKGDKGESILLALKG

SEQ ID NO: 73626 - protein, 823 aa, Zea mays
  misc_feature (191)..(191): Xaa can be any naturally occurring amino acid
PPPPQLSVDGDARTPANDRDPAGLLQHDDTENQQQQQACWERFLLKETLNVLLVESDDSTRQVVSALLRCCMYQVISAENGQQAWAYLEDKRNNIDLVLTEVFMPGVSGISLLSRIMSHNICKNIPVIMMSSSDAMSTVFKCLSKGAVDFLVKPIRKNELKNLWQHVWRQRCHSLSCVFEKKKKFTYLELXSSGSGSESGIQTQKCTKSKGANESGNNSGSNDDEAGMGLNARDDSDNGSGTQAQNSWTKLAVEIDSPQAMSLDQLADPANSTCAQVIHSKSEICSHRWLPGSSNRNCKKQKYTNDDFKGKDLEIDGPGNLYMDHQSSPNERPIKAADHENNSKESMMGNLGDATVRAADLIGSMAKNMDAQQAARAADTPNFSSEVPEGKGKNDDFKGKDLEIGGPRNLYMDHQSSPNERPIKAADHENNSKESMIENLEEPTVRAADLIGSMAKNMDTQQAARAAEDTPNFSSKVPEGKGKNDQHDNYVLPSLELSLKRSRSCGDGANDTVNDDEQRNSALRRSNLSAFTRYHTSAASNQGGTGLVGSCSPHDNSSEAVKTDSTYNMKSNSDAAAIKQGSNGSSNNNDMGSTTKDVVTKPSTNNERVMLPSAIKANGYTSTFHPVQQWMVPDNATAGKAKADEVANNAGRNSHPGDVQSNLTQQHRPTLHYVHFENSGSGALQCGSSNVFDPPLEGQATNNYGVKAGSNSGSNKGQNNGSTAGASTAAANAGRTDTEIRAIDKSGPGGGSGSGNDTYVRRLAASMTPRQEQLKKYREKKKDRNFGKKVRYQSRKRLADQRPRVRGQFVKQAVQNQEGDGER

SEQ ID NO: 73627 - protein, 505 aa, Arabidopsis thaliana
MASLARRKAYFLTRNLSNSPTDALRFSFSLSRGFASSGSDENDVVIIGGGPGGYVAAIKASQLGLKTTCIEKRGALGGTCLNVGCIPSKALLHSSHMYHEAKHSFANHGIKVSSVEVDLPAMLAQKDNAVKNLTRGIEGLFKKNKVTYVKGYGKFISPNEVSVETIDGGNTIVKGKHIIVATGSDVKSLPGITIDEKKIVSSTGALSLSEVPKKLIVIGAGYIGLEMGSVWGRLGSEVTVVEFAGDIVPSMDGEIRKQFQRSLEKQKMKFMLKTKVVSVDSSSDGVKLTVEPAEGGEQSILEADVVLVSAGRTPFTSGLDLEKIGVETDKAGRILVNDRFLSNVPGVYAIGDVIPGPMLAHKAEEDGVACVEFIAGKHGHVDYDKVPGVVYTHPEVASVGKTEEQLKKEGVSYRVGKFPFMANSRAKAIDNAEGLVKILADKETDKILGVHIMAPNAGELIHEAVLAINYDASSEDIARVCHAHPTMSEALKEAAMATYDKPIHI

SEQ ID NO: 73628 - protein, 477 aa, Erwinia carotovora subsp. atroseptica SCRI1043
MMFVFKERILSRSNAHLNPLECTQQALHWIHSDTLSPDDMAALNQEVLSCFREYVNPGFLEYRKSVTTGGDYGAVEWRASGPNTLIDTQGNEYLDCLGGYGIFNVGHRNPNVIAAVESQLARQPLHSQELLDPLRGLLAKTLAALTPGNLKYSFFSNSGTESVEAALKLAKAYQSPRGKYTFIAATGAFHGKSLGALSATAKPAFRRPFMPLLPGFHHVAFGDISAMRKQVQQCQKTGDDVAAIILEPIQGEGGVIVPPENYLPAVRALCDEVGALLILDEVQTGMGRTGKMFACEHYGVQPDILCLAKALGGGVMPIGATVATEAVFSVLFENPFLHTTTFGGNPLACAAALATVNELLTKNLPEQAAIQGEFLLQGLQQLAAEYPQLIIEARGMGLLQAIEFRKNEIGYAFAKELFQRNILVAGTLNNSKSVRIEPPLTITREQCARVLKEAKDVLKKLNGTMPDENKMKEYAVE

SEQ ID NO: 73629 - protein, 741 aa, Mycobacterium sp. MCS
MTEAGLSEREPNLSHLRLTARLNTAALDSRRGVVRLHPEVIAALGIREWDAVSLTGARTTAAVVGIAPPGTPTGTALLDDVTLSNAGLPENSSVIVAPVTVYGARSVTVSGSRLATNSISPATLRQALLGKVMTVGDTVSLLPRDLGPGTSTSSATTALASSVGITWTSELLTVTSVDPPGTVSIQPNSSVTWGDGPAPKAASAGPTDGAAVGEATVTTPSVDRPAVSFDDLKGSHAQAGRLTEWLKLSLDEPSLLETLGATAHLGVLVSGPAGVGKATLVRTVCAQRRLVELDGPEVGALHAEDRLNRVSSAVSTVRDGGGVLLISDIDALLPATPEPVGTLILTELRTAVATPGVAFVATSARPDGVDARLRDPDLCDRELGLSLPDAATRKELLEVLLRSVPAQELHLDEIAGRTPGFVIADLCALVREAALRAAARASADGAPPQLTQADLTGALTVIRPLSRSATEEVSVGSVTLADVGDMTETKQALTEAVLWPLQHPDTFERLGIEPPRGVLLYGPPGCGKTFVVRALASSGRLSVHAVKGAELMDKWVGASEKAVRELFRRARDSAPSLVFLDEIDALAPRRGQSFDSGVTDRVVASLLTELDGIEPMCNVVVLGATNRPDLIDPALLRPGRLERLVFVEPPDAEARREILRTAGKSVPLADDVDLDTLAAGLDGYSAADCVALLREAAMTAMRRSIDAADVTAADVEAARQTVRPSLDPLQVDTLRAFAENR

SEQ ID NO: 73630 - protein, 306 aa, Mycobacterium sp. MCS
MSANTKWTAADVPDQEGRVAVITGANTGIGYEAAAVLAAKGAHVVLAVRNTDKGGAAAERIRSALPHADVTVRELDLTSLDSIREAADGLRADYPRIDLLINNAGVMMTEKGATKDGFELQLGTNHLGHFALTGQLLDNLLPVEGSRVVTVSSNAHRWGRVNFDDLQSERSYNRVTAYGQSKLANLLFTYELNRRLSAKGAPTIAVAAHPGTSSTELTRNLWPVARRPVELVWGLVAQTPEMGALPTLRAATDPDVRGGQYYGPDGIGEQRGHPKLVQSNARSYDEAAQRRLWSVSEELTGVTFPV

SEQ ID NO: 73631 - protein, 314 aa, Prochlorococcus marinus str. MIT 9515
MQNKYLINFAKRSWFWFWTKLMDGFAPADSHGNYKRPKGILVDKTYDFEVNTKNSYLLVGNSCPWCHRTLLIYKLKNLSKKIKVIFLKADINSGQWIFKEKFEGCETLNQFYKKAQKQNIFRSTLPLLFNLQNNHINIISSESSQIVRLLNSIKVESSNKTLQIKNCDQNFLKMIHSDINDGVYKCGFARNQRSYELASKTLFRSLSKVEKEFDKNLGNWICGEDLTYADIYLFPTIIRWELIYRQLFKCSEKEISDFKNIIKWRSRFFELSNISETCFDSEWKKDYYKAIFPLNPNQIIPVLPSLQEIIESVT

SEQ ID NO: 73632 - protein, 500 aa, Streptococcus pyogenes M1 GAS
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWGVIPVLAEKPASTDDMFEVAERVAVEAGLVQSGDNIVIVAGVPVGTGGTNTMRVRTVK

SEQ ID NO: 73633 - protein, 216 aa, Bacillus halodurans C-125
MIKIAPSILSADFANLGNEIQDVERGGADYIHVDVMDGHFVPNITIGPLIVDAIRPVTTLPLDVHLMIEQPDGYIPAFAKAGADIITVHVEACPHLHRTLHLIKESGVKAGVVLNPATPVSSIQHVLSDVDMVLFMTVNPGFGGQRFIPSVLPKLKELASLKKEQGLTFEIEVDGGVNEETAKQCVEAGANVLVAGSAVFNEEDRAAAIKGIRGSI

SEQ ID NO: 73634 - protein, 492 aa, Yersinia enterocolitica
MLLSSTRKDWLGNVRGDVLAGIVVALALIPEAIAFSIIAGVDPQVGLYSAFCIPLVMAFFGGRPAMISSSTGAMALLMVTLVKDHGLQYLLAASILTGVFQLIAGYLKLGGLMRFVSRSVVTGFVNALAILIFMAQLPELTNVTWHVYAMTAAGLGIIYLFPYINKTIPSPLVCIVVLTGIAMWLHLDVRTVGDMGKLPDSLPVFLLPDVPLNLQTLLIILPYSAGLAVVGLLESMMTATIVDDMTDTPSDKNRECKAQGIANICTSFIGGMAGCAMIGQSVINVKSGGRGRLSTLTAGVVLLCLIVFLRDWVSQIPMAALVAVMIMVSIGTFSWRSIANLRTHPLSTSVVMLATVAVVVATHNLAFGVLTGVLIASLNFATKVSRFMRVTSVLEGTSRTYTVTGQVFFASADRFTSHFDFREAIENVVIDVSHAHFWDITSVSALDKVVIKFRREGAGVEIRGMNEATRTIVDRFGVHDKPEEVEKLMGGH

SEQ ID NO: 73635 - protein, 652 aa, Crocosphaera watsonii WH 8501
MEASFEITLQIVMAVLAGISAQVIAEFFKVPSIVFLLLFGIILGADGLNILNPQELGIGLEVLVALSVAIILFEGGLNLELKDLGRVSGSLRNLVTFGTLITLVGGGMAAHWLAEFPWSIAFLYAALVVVTGPTVIGPLLKQVEVERKVATLLESEGVLIDPVGAILAVVVLDTILNSNATPVEIFSGLLLRFTIGAIIGGISGFLLGFLLKNTLFLSEELRNLVVLAGVWGLFGLSQLTLSESGLMATVVAGIVLRASSIPDERLLRRFKGQLTVLCVSVLFILLAADLSIDSIFALGWGSVLAVLALMWLVRPISIALCTINSDLNWREKFFLGWIAPRGIVSASVASLFAILLTEKGINGGDSIKALVFLTIMMTVFIQGLSARWVAKGLRITAVEATGAVIVGCNALGRLLGRLFEQQGESVVLIDTDPEACSQAEAQGLSVFQSSALDPDVLEEAGIESMGTFMALTSNGQVNIVLAQRATEEFKPPRVFAIFPSNAPQDNNANKTGNTNKTNISPAFVDQQLIKMWNQYLTEDQFKLGITNFQEQGFSFKQAHFQALIREGEVLPLLIKRQGSLQVVQAAQTWQAGDEVTYLLHDPRPKLLKRLSGGNKTSKELTAERLSEVEEVPLADPVDNSLSESAGLKSQNS

SEQ ID NO: 73636 - protein, 664 aa, Bacillus halodurans C-125
MIGKRISGRYEILETIGGGGMADVYKAMDVILDRQVAVKVLQAQFSKDEQFIKRFRREAQAATSLAHQNVVSIYDVGEEENLYYIVMEYVEGPTLKELIQQRGPLPVDETIDIMSQMMAAISHAHMNQIVHRDIKPHNILIGEDGVVKVTDFGIARAMSSATITHTNSVMGSVHYLSPEQARGGLVTFKSDIYSLGIVLFEMVTGQLPFSGDTAVSIALKHLQNDIPSPKEIQPSLPQSIENVIVKATAKDPFYRYGSVSEMDEDLSTALDPARVNERPYDQKEDDEEATKAIPIIKDEQLEQEDFEKTMEAPPIKKVEEPKAPAAEEKVKKPKKKRRKWLWAVLIVLFLLIGTGVTALALMPSWFQVDDVDVPDVRESSFEEAEAELRSLGLEVEREDVEDDAPAEEVVSQHPRPGSVVKQGSTVRLFVSTGPEEGQMIDVTGRTIEEAQRLLNDFADVRLEERETNDVSPGIVIEQTPEAGESVVPEETTVTLIYSATSDIVLENMQGMTENEAHGYLQENGLRTRFSYDYSSSVAEGRVISHSPASGATVSEGDDVTIVVSRGPEPQTDQGGGQQEQPQQPQQPQTRSHLVNQPIEASQEVQVRIVYRDATTGGQDRVFIDETISETKTYQIPLEASADQPGSFDLYINGEFVKSSREYTY

SEQ ID NO: 73637 - protein, 134 aa, Rhodobacter sphaeroides 2.4.1
MTDEREKVVKSDAEWRAELSELAYKVTRKHGTERAGTHDDFPKEPGVFRCVGCGAPLFDQAQKFESGTGWPSFWAPIDPEAVETSVDRSFFMRRTEVHCARCEAHLGHVFPDGPQPTGLRYCMNGVAMTFEPKG

SEQ ID NO: 73638 - protein, 410 aa, Carboxydothermus hydrogenoformans Z-2901
MAKKFIILKFGGTSLKTAELREKVAQKIINTFESGYQPVVVVSAIGRKGDPYATDTLLNFAYEVNRDLPPREADLLMACGEIISGVIMVNTLAKMGYKAKLFTGAQAGIITDDNFTSASILKVKADKILKAVDEGFIPVVCGFQGVTEDGEVTTLGRGGSDTTAAALGVALKAEFIDIYTDVEGIKTADPRIVEDAKTLEVVTYNEISQLAHEGAKVIHPRAVEIAMQKNIPLRIKSTLTDGEGTLVTSHAEVYGEVIEVIRDRIITGIAHIPGVTQIKILREDTPEIVNLAQKVFKGLALAEISVDFINISPEGLAFTVKGEVTEKAVDVLENMGFTPRIRRNCAKIAAVGAGMTGVPGVMAKIVEALTREQIEILQSTDSYTTIWVLVDGENMEKAVRAIHKAFKLNE

SEQ ID NO: 73639 - protein, 139 aa, Lolium perenne
KEYKEVQREKSADPDIQLICDDSNIFKWTALIKGPSETPFEGGVFQLAFSIPEQYPLLPPQVRFMTKIFHPNVHFKTGEICLDILKNAWSPAWTLQSVCRAIIALMAHPEADSPLNCDSGNLLRSGDIRGYQSMARMYT

SEQ ID NO: 73640 - protein, 486 aa, Zea mays
  misc_feature (384)..(384): Xaa can be any naturally occurring amino acid
  misc_feature (396)..(396): Xaa can be any naturally occurring amino acid
  misc_feature (398)..(398): Xaa can be any naturally occurring amino acid
  misc_feature (401)..(401): Xaa can be any naturally occurring amino acid
  misc_feature (418)..(418): Xaa can be any naturally occurring amino acid
  misc_feature (425)..(425): Xaa can be any naturally occurring amino acid
  misc_feature (446)..(446): Xaa can be any naturally occurring amino acid
  misc_feature (458)..(458): Xaa can be any naturally occurring amino acid
MMDLADSQQQRLIAGAALLVATVAFLRLLLSSRSGGKRLPPTIPGAPVVGGLVKFMRGPIPMIREQYARLGSVFTVPIISRKITFLVGPEVSAHFFKGNEAEMSQQEVYRFNVPTFGPGVVFDVDYSIRQEQFRFFTEALRANKLRSYVDQMVVEAEEYFSKWGESGTVDLKYELEHLIILTASRCLLGREVREKLFDDVSALFHDLDNGMQPISVLFPYLPIPAHKRRDRARARLAEIFATIIKSRKASGQSEEDMLQCFIDSKYKNGRPTTEGEVTGLLIAALFAGQHTSSITSTWTGAYMLRFKQYFAEAVEEQKDIMRRHGDKIDHDILAEMDVLYRCIKEALRLHPPLIMLLRQSHSDFTVTTKEGKEYDIPKGHIVAXTSPSFANRLPHXYXNPXDSYDPDRFGPVRDDEKXAGRTFKXISSGAASNGSLPPPFAYLQHXAICTHLLRNFEXDLLSSFPENDWNATVVGIKGEVMVPLKH

SEQ ID NO: 73641 - protein, 146 aa, Phaseolus vulgaris
  misc_feature (146)..(146): Xaa can be any naturally occurring amino acid
MSSTEVATTTKKGGRGKPKTTKSVSRSSKAGLQFPVGRIARYLKAGRYAQRVGSGSPVYLSAVLEYLAAEVLELAGIAARDNKKSRIIPRHIQLAVRNDEELSKLMGSVTIASGGVLPKNSSKICCPRKTGKGEGEVWIYLVKGFX

SEQ ID NO: 73642 - protein, 136 aa, Brassica napus
MSNQKKRNFRIEAFKHRVVVDPKYADKTWQILERAIHQIYNQDASGLSFEELYRNAYNMVLHKFGEKLYTGFIATKTGHLKEKARLIEAAQGGAFLEELNKKGNEHNKAWEMIRDILKYMDRTYIESTKKPQGHPR

SEQ ID NO: 73643 - protein, 148 aa, Populus trichocarpa
MEQTFIMIKPDGVQRGLVGEIISRFEKKGFTLKGLKLQTVEQSFAEKHYEDLAKKPFFAGLVQYIISGPVVGMIWEGKGVVATGRKIIGATNPAASEPGTIRGDFAIDVGRNVIHGSDSVESATKEIGLWFPEGPANWQSSLHPWIYE

SEQ ID NO: 73644 - protein, 411 aa, Buchnera aphidicola str. Sg (Schizaphis graminum)
MKKVHIEVKMPDIGLEEVEVTEILVKIGEEIKLDQGLITVEGDKASMEIPSPISGIVKDITIKIGEKVKTSSIIMIFKVNNLNSIKNEKDLNYIKTEKKLNENFLEEKKDIKKIVLVHATPVVRRLARHLNVDLKNITPSGPKNRILKEDIELYIRNNTSNKSSFNIEKNNTTNFHKDLFNEIPITNIQQIIGKNLHQNWVNIPHVTQFDEVNITLLEEFRHKYNTEKKQKNNMCSKITILPFIIKSVAYGLLEFPIFNSSLSVNKKTIFLKKYVNVGIAVDVQNALFVPVLKNVDKKNIANLSSELIFLSKKAHENKLDASDMKDGCFTISNLGGIGGSWFSPIINSPEVAILGVSKALIKPLWNGKEFIPSLMLPLSLSYDHRVINGADAARFLTFIGKMLSDIRFLIM

SEQ ID NO: 73645 - protein, 361 aa, Escherichia coli K12
MMKTMRIAAIPGDGIGKEVLPEGIRVLQAAAERWGFALSFEQMEWASCEYYSHHGKMMPDDWHEQLSRFDAIYFGAVGWPDTVPDHISLWGSLLKFRREFDQYVNLRPVRLFPGVPCPLAGKQPGDIDFYVVRENTEGEYSSLGGRVNEGTEHEVVIQESVFTRRGVDRILRYAFELAQSRPRKTLTSATKSNGLAISMPYWDERVEAMAENYPEIRWDKQHIDILCARFVMQPERFDVVVASNLFGDILSDLGPACTGTIGIAPSANLNPERTFPSLFEPVHGSAPDIYGKNIANPIATIWAGAMMLDFLGNGDERFQQAHNGILAAIEEVIAHGPKTPDMKGNATTPQVADAICKIILR

SEQ ID NO: 73646 - protein, 476 aa, Buchnera aphidicola str. Sg (Schizaphis graminum)
MHQEIQSEVVIIGSGPAGYSAAFRCADLGLETVLIEHQERLGGVCLNVGCIPSKSLLHIAKIIKDASELSESGVFFNKPIIDIKKINNWKEKIIKKLTTGLSNMGEKRKVRIVQGKALFNTDHSVLVKNKKNDFTIFFKHAIIATGSKPIKIPSLPNEDNRIWNSTDALSLKSIPNRFLIIGGGIIGLEMATIYSALGSKVDIVDRFNAFLPSVDKDITDIYIKSIKKRFKLLLNTHVKSVEKSKDNDLIVKIAEENSDENVCCYDNILVAIGRSPNVDFLGLEKIGLKLNESGFIEINQQLKTNISHIYAIGDVTGFPMLAHKAVQQAHIAAEVISGKKHYFEPKVIPSVAYTDPEIAWVGLSEKEAENNDIDYEVSLFPWSASGRAHASNCTLGMTKLIFNKNTNKIIGGSIIGTNASELISEIGLAIEMGSDAEDISLTIHPHPTLSESISLASEVFQGTITDLLNLKKSLLN

SEQ ID NO: 73647 - protein, 501 aa, Escherichia coli O157:H7 EDL933
  misc_feature (384)..(384): Xaa can be any naturally occurring amino acid
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDDGMHLPSPYGIRLIKGSHIVVPRVHTQKQAYILQNEDKRIVFVIPWMDEFSIIGTTDVEYKGDPKAVKIEESEINYLLKVYNAHFKKQLSRDDIVWTYSGVRPLCDDESDSPQAITRDYTLDIHDENGKAPLLSVFGGKLTTYRKLAEHALEKLTPYYQGIGPAWTKEXVLPGGAIEGDRDDYAARLRRRYPFLTESLARHYARTYGSNSELLLGNAGAVSDLGEDFGHEFYETELKYLVDHEWVRRADDALWRRTKQGMWLNADQQSRVSQWLVEYTQQKLSLAS

SEQ ID NO: 73648 - protein, 880 aa, Neurospora crassa
MATTLSSGAAAELPIRSQSVRTRRPPTTSRPEPPLPRSESTNRAEASRPHRRSSQRSASGATTAATTTTTTSTATSSRHHPHPSQQQQQYHHQQQPDMSAAAAAAAAPHGHASAGDDHRNGADAGVSTHRSATGTTKQRYRTVIPAPSGNYAFIKTIGQGSMGKVKLAKKEGTNELASQPIKCDISLVACKIIERVSPDDGRQSREEREKADAAREDRNAREAAIVSLLNHQYICGLRDNLRTRWHWYMLFEYVNGGQMLDYIISHGKLKEKQARKFARQIASAVDYCHRNSIVHRDLKIENILISKTGDIKIIDFGLSNLFSPEEDRKLKTYCGSLYFAAPELLQARPYTGPEVDVWSFGVVLFVLVCGKVPFDDQYMPALHQKIKKGAVDYPNWLSSECKHLISRMLVTDPKQRATMQEVMNHPWMLKGYNGPPDNYLPRREPLTLPLDPEVISQMTGFKFGPPEYITAELTKRIKSPKYQAAVRRLEKERERPEPIAKDAEKKRGFGFDFYKRRNSVTSKDTLTAASSEGLSLGDDPLNAFDPLISIYYLVREKLERERNHVYIDLQQPSKAQQPPPSSSQTVMPVPPSPVIRPKEKHSLADIVPPQPVHNAEPRSRQRTRSHSEDQPREPIQGGLLSPDMVPAKKESTAAGILRRLSTRDRRKEPPATASSTDGKPPLRGSMSMRAKSLGHARRESIQMRRAKREAEAAAAQQAQSQTTEPQRSYQSHHHSVREETDAELVDSDIRGETSGGSNERLEPEDPDLVKPVFLKGIFSVSTTSTKPLSEIRADIKRVLRVLGVEFNEIKGGFSCRHTPSINHAERQPTVMTEGGNEIEFEILIVKVPIVSLHGVQFKRLAGNTWQYKALAEQIVRELRL

SEQ ID NO: 73649 - protein, 357 aa, Pisum sativum
MSAFVGKYADELIKNAKYIATPGKGILAADESTGTIGKRLASINVENIEANRQALRELLFTSPNALQYLSGVILFEETLYQKSSEGKPFVEILQENNVIPGIKVDKGVVELAGTDGETTTQGFDSLGARCQQYYKAGARFAKWRAVLKIGPNEPSELSIQQNAQGLARYAIICQENGLVLFVEPEILTDGSHDIAKCAAVTETVLAACYKALNDQHVLLEGTLLKPNMVTPGSDSPKVSPEVIGEYTVNALRRTVPAAVPGIVFLSGGQSEEQATLNLNAMNKFDVVKPWTLSFSFGRALQQSTLKTWSGKKENVGKAQDVFLARCKANSEATLGKYGGGSGTGLASESLHVKDYKY

SEQ ID NO: 73650 - protein, 431 aa, Escherichia coli O157:H7 EDL933
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 73651 - protein, 956 aa, Pseudomonas syringae pv. syringae B728a
MLELTLEQISMAQSAVDKTAALKLIADHLVADGLVAEGYLTGLMNREQQGSTFLGQGIAIPHGTPETRDLVFTTGVRLMQFPEGVDWGDGQMVYLAIGIAAKSDEHLRLLQLLTRALGEEDLGQALREAKTPEDLLKLLQGAPQELALDAQMISLGVSADDFEELVWRGARLLRKADCVSNGFAAVLQQVEALSLGDGLWWLHSEQTVKRPGLAFVTPDKPMRYLGQPLTGLFCLASLGEAHQALLERLCLLLIEGRGHELGHATNSRAVLEALGGELPAEWPTRQIQLANAHGLHARPAKILAQLAKEFDGEIRMRVLETGEAAVSAKSLSKLLSLGARRGQTLEFIAEPTIADDALPALIAAVEQGLGEEVEPLPAVSQTEAAPAPAPAAAKPLSAPPAGSVLQAVSASPGIAMGPAHVQVLQSFDYPQRGESVAAERERLHKAIGEVRSDIENLIQRSKSKAIREIFITHQEMLEDPELTSEVEARLNNDESAAAAWATVIETAAVQQEQLQDALLAERAADLRDVGRRVLAQICGVETVAAPDEPYILVMDEVGPSDVARLDPAQVAGILTARGGATAHSAIVARALGIPALVGAGDEVLLLKPGTVLLLDSQRGRLTVAPDEATLQRAVQDRDAREQRLKAAAAARMEPAVTRDGHAVEVFANIGDSTGTPAAVEQGAEGVGLLRTELLFMAHSQAPDEATQEAEYRRVLTDLGGRPLVVRTLDVGGDKPLPYWPIAKEENPFLGVRGIRLTLQRPDVMESQLRALLRSADSGPLRIMFPMIGTLEEWRQARDMTQRLREEIPVSDLQLGIMIEVPSAALIAPVLAKEVDFFSIGTNDLTQYTMAIDRGHPTLSAQADGLHPSVLQLIDMTVRAAHANGKWVGVCGELAADPLAVPILVGLGVDELSVSARSIGEVKACVRELTLSSARELAQNALTAGSAAEVRALVEAV

SEQ ID NO: 73652 - protein, 358 aa, Glycine max
MSSFKSKYQDELIANAAYIGTPGKGILAADESTGTIGKRLASINVENVEANRRALRELLFTTPGAFECLSGVILFEETLYQKTASGKPFVELMKEGGVLPGIKVDKGTVELAGTNGETTTQGLDGLGARCQKYYEAGARFAKWRAVLKIGPNEPSELAIHENAYGLARYAVICQENGLVPIVEPEILVDGPHDINKCAEVTERVLAACYKALNDHHVLLEGTLLKPNMVTPGSESKKVTPEVIAQYTVTALQRTVPAAVPAIVFLSGGQSEEEATLNLNAMNKSQGKKPWSLSFSFGRALQQSTLKAWGGKDENIKKAQDALFARCNANSHATLGTYKGDATLAEGASESLHVKDYKY

SEQ ID NO: 73653 - protein, 585 aa, Physcomitrella patens subsp. patens
MGSSWLPEQSFQSWGNYRRALASIPSRLIDRMSARTQLNEEVTDIKARSNVDMNKNLTWWDLIWFGIGAVIGAGIFVLTGVEAKNHAGPAIVISYVIAGSSAMLSAFCYTEFADEIPLAGGAFAYLRVELGDFIAFIGAGNIVLGNVIGSAAVARGWTSYFASLIFSGVDVGDKLRIETNLAEGYNQLDPIAVAVLVLVGLVAIWSTKGASYVNWIASLVNMFIIAFIIVAGLALSNSHNLTDDFFHYGARGIFSASSVLFFAYLGFDAISTMAEEVKNPGRDIPIGLLGSMTICTFIYIMMAVTLSLMVPFLNIDEGAPFSVAFSSVGWDWAKYIVALGALKGITTVLLVSTVGQARYLIHIARSHLIPPWFSQVNKQTRTPINATAITILASSVVGFFTDLPILGNLLSLSSLFIFFLVAVALLVRRYYVPGQTSRQHGGLFIVYMLLIILSSTAIAAFWGLNKSGYALYAVCGSIWSFSTLLLHLTLRPLRQPETWGVPFMPWIPSLSVAFNIFLLGSLDKASFIRFGYWTGMMLVYYFFFGLHSTYDAAKYNSSDLVPKTLRNEGQTATIYEQDTPSSTST

SEQ ID NO: 73654 - protein, 392 aa, Schizosaccharomyces pombe
  misc_feature (1)..(1): Xaa can be any naturally occurring amino acid
  misc_feature (28)..(28): Xaa can be any naturally occurring amino acid
  misc_feature (179)..(179): Xaa can be any naturally occurring amino acid
  misc_feature (233)..(233): Xaa can be any naturally occurring amino acid
  misc_feature (265)..(265): Xaa can be any naturally occurring amino acid
  misc_feature (293)..(293): Xaa can be any naturally occurring amino acid
  misc_feature (350)..(350): Xaa can be any naturally occurring amino acid
  misc_feature (379)..(379): Xaa can be any naturally occurring amino acid
XPPKKQQEVVKVQWGRPGNNLKTGIVGXPNVGKSTFFRAITKSVLGNPANYPYATIDPEEAKVAVPDERFDWLCEAYKPKSRVPAFLTVFDIAGLTKGASTGVGLGNAFLSHVRAVDAIYQVVRAFDDAEIIHVEGDVDPIRDLSIIVDELLIKDAEFVEKHLEGLRKITSRGANTLEXKAKKEEQAIIEKVYQYLTETKQPIRKGDWSNREVEIINSLYLLTAKPVIYLVNXSERDFLRQKNKYLPKIKKWIDENSPGDTLIPXSVAFEERLTNFTEEEAIEECKKLNTKSXLPKIIVTGYNALNLINYFTCGEDEVRSWTIRKGTKAPQAAGVIHTDFEKAFVVGEIXHYQDLFDYKTENACRAAGKYLTKGKEYVXESGDIAHWKAGKR

SEQ ID NO: 73655 - protein, 300 aa, Mycobacterium sp. MCS
MTKWTTADIPSQSGRTAVVTGANTGLGLETAKALAARGAHVVLAVRDTEKGKRAADEITAAHPEAAVGVQSLDLGSLRSVRTAAEALKADFPRIDLLINNAGVMYPPKQTTEDGFELTFGTNHLGHFALTGLLLENVLAAPNSRVVTVSSQGHRIRAAIHFDDLQWERSYSRVGAYGQSKLSNLLFTYELQRRLDTRDAIAVAAHPGVSNTELMRHLHLPPVFNPLVGVLTQSPTMGALPTLRAATDPTVRGGQYFGPSGLGEIRGYPELVTSSAQSRDVDLARRLWTVSEELTGVAFPL

SEQ ID NO: 73656 - protein, 384 aa, delta proteobacterium MLMS-1
MDYGENLFLVGGAMLFMFFLVSFIFQRLKLPSLLAYIFLGIAFAGLLTGSGLNIVDQISRIGIVLLFFLLGLHFPLNRLVNISRRIWKVGVMDIVFNFGGSFLIAYLFGFDLMAALIIGGVAYATSSSITVKMLEDSGRLKSPEGEFKLALLIFEDLAAPVMVSFLVGLSAHGVISAGAVGVIFIKVLLVTAFSILLAYQGFRRLDVFVGRYINKDFIPLLAMAVALIFAGIAEVMDLSKLLGAFLAGVMLSETGMSRDLSKLIVPIKDLTLPFFFFWFGTSITFGTGIISPVALVVLIFWAIVAKLLVGFWGGRMYGLSYKGAVRAAFSLTPRGEFSVVIAALADTALRVFLGIYIVVTAIIGVYLFRMAPVFADKLDRFRKK

SEQ ID NO: 73657 - protein, 123 aa, Physcomitrella patens subsp. patens
MQAVRAAVLKRMRVGVTAPWVQAPVVTNASRLFSAEAHGTYLDKHVVTDRVLSVVKKMQKVDSAKVTPNAHFQNDLGLDSLDTVEVVMAFEEEFAIEIPDADADKITSCADAIEYIASQPRAK

SEQ ID NO: 73658 - protein, 514 aa, Aspergillus oryzae
MVHLAQVHRNADLDSTIKRVDSIQLENTDEDGFYSSVYGTRFATEQLPQTEMPEREMPREVAYRMIKDELSLDGNPMLNLASFVTTYMEDEAEKLMTESFSKNFIDYEEYPQSAEIQNRCVNMIARLFNAPVHSEDEHPMGTSTIGSSEAIMLGTLAMKRRWQNKRKAEGKDYSRPNIVMNSAVQVCWEKAARYFDVEERYVYCTEDRYVIDPQQAVDLVDENTIGICAILGTTYTGEYEDVKAINDLLIERNIDVPIHVDAASGGFVAPFINPKLEWDFRLPKVVSINVSGHKYGLVYPGVGWVVWRSPEYLPKDLIFNINYLGAEQASFTLNFSKGASQVIGQYYQMIRLGKRGYRSIMTNITVTADFLAQELEKMGFIIMSQRRGHGLPLVAFRLPAEREGQFDEFALAHQLRERGWIVPAYTMAPNSNNLKLMRVVVREDFTKSRCDALLSDIKLGLKTLGDMDKAMLDKYTQHVRTHATHSHKSKHNHPHYKGETHSLQGKHGKTHGVC

SEQ ID NO: 73659 - protein, 263 aa, Pediococcus pentosaceus ATCC 25745
MKIGFIGVGNMAKAIIKGLLKNNFESTDILVHSAHQSSYGPFAEKNQLIATKSNQELVRNSDIIVIAVKPYVVKTVIDEVRDDLNHHQLVVSLASGISIEDLQTSLDEQQPILRIMPNVNVEIGEGMTAVVANGDLKMEPFQSGVKIFETVGSTMELAEKDFPIFSAIAGSAPAYAYLFIDALSRAGVKHGLTKASATKIAAQMVKGSAEMVLKSDEIPYALIDKVSSPGGTTVAGLLAMEEAGFSPAVVKGIDATVAKEINH

SEQ ID NO: 73660 - protein, 209 aa, Anaplasma phagocytophilum HZ
MSFEPSAAVFSSIEEVVRDAAEGKVFVLLDDEERENEGDLVALADRVSPEAINMMIRYGSGIVCLAFSEYHAKKLGLGLMSRRNANDGCPAFAESIDARHGITTGVSASDRAATILKAVSDDSSADDIVTPGHVFPIVANPGGVLKRGGHTEAGVDIAKLAGAAHAAVICELMNPDGTMARLPEIMEFASANGIKVTTIKKLREYLSSS

SEQ ID NO: 73661 - protein, 440 aa, Photorhabdus luminescens
MKLSLDHIPGQMRHAINECRLIQIRGRVTQVTGTLLKAVIPGVRIGELCHLRNPDNTLSLLAEVIGFQQHQALLTPLGEMFGISSNTEVSPTGAMHQVGVGDYLLGQVLDGLGNPFAGGQLPEPQAWYPVYRDAPAPMSRKRIEHPLSLGVRAIDGLLTCGEGQRMGIFAAAGGGKSTLLSTLIRSAEVDVTVLALIGERGREVREFIESDLGEEGLKRSVLVVATSDRPAMERAKAGFVATSIAEYFRDQGKRVLLLMDSVTRFARAQREIGLAAGEPPTRRGYPPSVFAALPRLMERAGQSDKGSITALYTVLVEGDDMTEPVADETRSILDGHIILSRKLAAANHYPAIDVLRSASRVMNQIITPEHQAQAGLLRNWLAKYEEVELLLQIGEYQKGQDLVADNAIARIDAIRSWLRQGTHEPSDLPQTLALLQQITR

SEQ ID NO: 73662 - protein, 186 aa, Rhodobacter sphaeroides 2.4.1
MAPLNIKQGSTQHSAYDLRDPNSDVIEQHTLALVVDNESGVLARVIGLFSGRGYNIDSLTVAEVDHTGHRSRITIVTRGTPAVIEQIKAQLARLVPVHEVHDLTVEGPSVQRELALFKVSGKGEARIEALRLAEIFRAKVVDSTLESFVFEITGTPEKIDALADLMRPLGLREMARTGVAALSRGI

SEQ ID NO: 73663 - protein, 351 aa, Populus trichocarpa
MVIFVCFLKRKDGARNTVLKGKAESEKPKDFGSGVQEAEKNKLFFFEGCSYNFDLEDLLRASAEVLGKGSYGTAYKAVLEDGTSVVVKRLKEVAAGKKEFEQQMEVIGRVGQHPNIVPLRAYYYSKDEKLLVHNYMSAGSLSAFLHGNRAGGRTSLDWNARVKICLGTARGIARIHSEGGAKFFHGNIKASNVLLTPDLDGCISDVGLAPLMNFPTTMYRTIGYRAPEVIETRKASQKSDVYSFGVLLLEMLTGKAPLQVPGHDSVVDLPRWVRSVVREEWTAEVFDVELVRHQNIEEEMVQMLQIALACVAKAPDMRPKMDEVVRMIEEIQHSDSKNRSSSDAESNVQTP

SEQ ID NO: 73664 - protein, 588 aa, Rhodobacter sphaeroides 2.4.1
MEREMTEVMSGARMVVQALKDQGVDTVFGYPGGAVLPIYDEIFQQNDIRHILVRHEQGAVHMAEGYARSTGKPGVVLVTSGPGATNAVTGLVDALMDSIPLVVLSGQVPTFMIGTDGFQEADTVGITRPCTKHNWLVKDTARLAETIHQAFHVATHGRPGPVLVDIPKDVQFATATYQPPQKARVDHYQPKVKGDIEAITRMVELIETAERPVFYTGGGVINSGSAASQLLREFVDATGFPITSTLMGLGAYPASGKGWLGMLGMHGLYEANLAMHGCDLMINVGARFDDRITGRVKDFSPFSQKVHIDIDPSSINKVIRADVPIIGDVGHVLEDALRLWKSRGRKVNREALAEWWKQIAEWKAVNCLDYAPSSKLIKPQHALQRLEALTKGMDRYITTEVGQHQMWAAQFLGFEGPNRWMTSGGLGTMGYGLPASIGVQVAHPEALVINIAGDASFLMNMQEIGTAMQFRLPVKQFILNNERLGMVRQWQQLLHGQRYSQSWSESLPDFVKLAEAFGAKGIQCADPADLDDAIREMIAYDGPVVFDCLVEKHENCFPMIPSGRPHNEMLLGDAETEGAIGAKGAVLV

SEQ ID NO: 73665 - protein, 533 aa, Saccharomyces cerevisiae YJM789
MSYNNGNTYSKSYSRNNKRPLFGKRSPNPQSLARPPPPKRIRTDSGYQSNMDNISSHRVNSNDQPGHTKSRGNNNLSRYNDTSFQTSSRYQGSRYNNNNTSYENRPKSIKRDETKAEFLSHLPKGPKSVEKSRYNNSSNTSNDIKNGYHASKYYNHKGQEGRSVIAKKVPVSVLTQQRSTSVYLRIMQVGEGTYGKVYKAKNTNTEKLVALKKLRLQGEREGFPITSIREIKLLQSFDHPNVSTIKEIMVESQKTVYMIFEYADNDLSGLLLNKEVQISHSQCKHLFKQLLLGMEYLHDNKILHRDVKGSNILIDNQGNLKITDFGLARKMNSRADYTNRVITLWYRPPELLLGTTNYGTEVDMWGCGCLLVELFNKTAIFQGSNELEQIESIFKIMGTPTINSWPTLYDMPWFFMIMPQQTTKYVNNFSEKFKSVLPSSKCLQLAINLLCYDQTKRFSATEALQSDYFKEEPKPEPLVLDGLVSCHEYEVKLARKQKRPNILSTNTNNKGNGNSNNNNNYNNNNNNNDDDDK

SEQ ID NO: 73666 - protein, 352 aa, Thermoanaerobacter brockii
MKGFAMLSIGKVGWIEKEKPAPGPFDAIVRPLAVAPCTSDIHTVFEGAIGERHNMILGHEAVGEVVEVGSEVKDFKPGDRVVVPAITPDWRTSEVQRGYHQHSGGMLAGWKFSNVKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIESQIMNLTEGKGVDAAIIAGGNADIMATAVKIVKPGGTIANVNYFGEGEVLDVPRLEWGCGMAHKTIKGGLCPGGRLRMERLIDLVFYKRVDPSKLVTHVFRGFDNIEKAFMLMKDKPKDLIKPVVILA

SEQ ID NO: 73667 - protein, 359 aa, Pisum sativum
MSHFKSKYHDELIANAAYIGTPGKGILAADESTGTIGKRLSSINVENVESNRQALRELLFTASWLFLQYLSGVILFEETLYQKTAAGKPFVDVLNEAGVLPGIKVDKGTVELAGTDGETTTQGLDGLGARCRKYYEAGARFAKWRAVLKIGANEPSEHSIHENAYGLARYAVICQENGLVPIVEPEILVDGSHDILKCAAITERVLAATYKALSDHHVILEGTLLKPNMVTPGSDAPKVAPEVIAEHTVRALQRTVPAAVPAVVFLSGGQSEEEASVNLNAINQIKGKKPWTLSFSFGRALQQSTLKAWGGKTENVKAAQDALLTRAKANSEATLGTYKGASNLGAGASESLHVKDYKY

SEQ ID NO: 73668 - protein, 320 aa, Oryza sativa Japonica Group
MYVVHLDLEAPATERAELAAAVRADPVYSRFRNVKVVTRANLVTYRGPTMVANTLHAAAILLREGGEWDWFINLSASDYPLVTQDDLLYVLSDLPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLNDFDGMVNSNAPFARKFGREDPVLDKIDQELLGRQPDGFVAGGWMDLLNTTTVKGSFTVERVQDLRPGPGADRLKKLVTGLLTQEGFDDKHCL

SEQ ID NO: 73669 - protein, 128 aa, Brassica napus
MSVSNIGMMDGAYFVGRNEILAWINTTLQLSLAKVEEAASGAVACQLMDAAHPGAVPMHKVNFDAKNEYDMIQNYKVLQDVFNKLKITKHIEVNKLIKGRPLDNLEFMQWMKRYCDSVNGGFMTSYNA

SEQ ID NO: 73670 - protein, 394 aa, Spinacia oleracea
MASASLLKTSPVLDNPEFLKGQTLRIPSVAGVRFTPSGSSSLTVRASSYADELVKTAKTVASPGRGILAMDESNATCGKRLASIGLENTEANRQAYRTLLISAPGLGQYVSGAILFEETLYQSTTDGKKMVDVLIEQGIVPGIKVDKGWLPLPGSNDESWCQGLDGLACRSAAYYQQGARFAKWRTVVSIPNGPSALAVKEAAWGLARYAAITQDNGLDPILEPEIMLDGEHGIDRTFRVAQQVWAEVFFNLAENNVLLEGSSLKPSMVGPGALSARKGPPEQVADYPLKLLHRRRGPVVPGIMVLSGGQSEVEATLNLNAMNQSPNPWHVSFSYARALQNTCLKTWVEGQENVKAQDFACAKSNSLAQLGKYTGEGESEERKKDMFVKATLTY

SEQ ID NO: 73671 - protein, 543 aa, Rhodopirellula baltica SH 1
MVLTFMTATRRRPVVLIVRDGWGQNPDPKWNESNAVHLANTPVDDKLTQEYPSVLIHTSGEDVGLPAGVMGNSEVGHQNIGAGRIVDQEVMRITRAIRDDSFFSNPVVTGAIDHVKKSGGRLHLLGLMSDGRVHSDLQHGIAVIDLAKRNGLTGDQLAIHAITDGRDTSPRGGLKFVSQLTDHCEASGVGVVASVIGRFYAMDRDLRWERVEAAYNLMTQGTGQTFPSASAAIESYYANPTESSRDGDEFITASSIVPEGGSPITVQPGDAVLFMNYRGDRTREITKAFTFDDAAWKDIPGGGFDRGKKIDNLYFATMTGYETGLPVKVIFEKPAKMPNILGEYVASKGLHQFRCAETEKYPHVTFFFNDYRDNPFEEEEWGMAPSPRDVSTYDQKPEMSAEDITEKVLKQIKSGKCDMIIVNYANGDMVGHTGVLEAAIKAVEKVDACVGRVVDATLAAGGSLVVTADHGNCEQMIDPETGGPHTAHTTYQVPLIVVDPEFVGKPLREGGRLADIAPTVLALMGLEVPPEMTGRPLMETQTA

SEQ ID NO: 73672 - protein, 554 aa, Pseudomonas syringae pv. syringae B728a
MAYYRTPSDVTALPAWQALNKHRQAMQNFSMREAFNTDPQRFSQFTLSSAGLFLDYSKNLITTETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFEQNMPVLLGLLGVWYGNFWNAQSHAILPYDHYLRNITKHLQQLDMESNGKSVRQDGTPTSTDTGPVIWGGVGANGQHAYHQLLHQGTQMIPADFIVPIVSFNPVADHHQWLYANCLSQSQALMMGKTRAEAEAELREKGMDEQEVQKLAPHKVIPGNRPSNTLVVERISPRRLGALVAMYEHKVFVQSVIWGTNAFDQWGVELGKEMGKAVYQRLTGGTEEQADDASTQGLINYFRGRHRG

SEQ ID NO: 73673 - protein, 273 aa, Vitis vinifera
  misc_feature (11)..(11): Xaa can be any naturally occurring amino acid
  misc_feature (68)..(68): Xaa can be any naturally occurring amino acid
MACSAPSTPTXLLSSNPRAFPSKSLSTVASFSKPLSPQTLTIPNSFNPLRKPFQSPVPRSISSRGSHXRRSLVVRASEAPLVGNKAPDFEAEAVFDQEFIKVTLSEYIGKKYVILFFYPLDFTFVCPTEITAFSDRYEEFEKLNTEILGVSIDSVFSHLAWVQTDRKSGGLGDLKYPLVSDVTKSISKSYDVLIPDQGVALRGLFIIDKEGIIQHATINNLAIGRSVDETMRTLQALQYVQENPDEVCPAGWKPGEKSMKPDPKLSKEYFAAI

SEQ ID NO: 73674 - protein, 406 aa, Debaryomyces hansenii CBS767
LKMTIKSNFSNLTREAPDPIVETMTMYAQDTSPDKIDVSIGVYKGEKGESYVFPAVSKAKKHLFENDPGHSYTNMAGIPEYTSGARKVVFGEKYGTEGKIASLQTISGTGACHMAFLLLREAGLTNFYVGTPCWSNYGPMITHVGSKYSTYTHYDESLRGIDFDAVLEALQNAPSKSVFLFQACCHNPTGADFSKDQWKQIASIVKSRDIFPVFDIAYQGFSSGDKDVDAWPVRYFYEQNLEFLVCQSFSKNMGLYSERAGCLHAVVQDTDYVPNVQSQLVALFRSECSFAPAYGARIASIIINEPGLENQWGQEVSDVTTRLKNIRKQILDKFLELGTPGKWDHVVKQQGLFWYSGLSPEQNDKLIEDHHIYSTSIGRVNIAGLNESSVDKFVGAIDKVVRDSIG

SEQ ID NO: 73675 - protein, 587 aa, Photobacterium sp. SKA34
MPRFTSATAFLLSVCCFSFPALANEVQQASDHIEPEPSINQQSQQLVSGTEWMIATANAYASQAGADILRQGGSAVDAMITSQLILGLVEPQSSGIGGGGFLVYWDNDKNQMTTFDGRETAPFAATPRLFQDNQGQPLKFYDAVVGGRSVGTPGTIKLLWRSHQQYGKLPWKTLFLPAIKLAKEGFIVSPRLAAMVENDAKNLSRYPTTKAYFFDSQGKPLQAGSKLVNNAYSNTLRQVADYGPKAFYQGDIARDIVNTVQNAKGNPGVLNTMDLASYSVKQREPICAPYRQYQICGMGPPSSGALTLGQILAMLNHYPLDKLGADSVKSWQLIGDASRLAFADRGRYMADSDYVPMPVRGLLDPNYLAERAKLLDGNKALTQVKPGIPPWNHAHNRASDEAIELPSTSHLSIVDKEGNVVSLTSTIENRFGSRLMVRGFLLNNELTDFSFRSQIDGIPVANRIEPGKRPRSSMTPTIVMKNNQPVLTIGSPGGSQIIGYLAKTLVAYIDWEMDLQQAINLPNMNNRFGTFELEKNTPAAEWAPKLEKLGYKTQIKDLNSGIQAISIAPNQLIGAADPRREGKVISQ

SEQ ID NO: 73676 - protein, 367 aa, Rhodopirellula baltica SH 1
MNVPDSLSSAGASSFRSYRFPAEWEPCEAVWLAWPHNRDTWPGHFEPVPAAFAQFVRAIHESTPVRILATGLVAEDCRKHLQQIGLVESDSLRIVDVPTNDCWIRDYGPTFVFGPDSEKIAVDWRFNAWGGKYEPFDSDAAAGAEIAKIAGLKRLDGGLTMEGGALETDGAGRLLVNPGCLVDPARNPGVSKEQVSQRLNQCLGVEEIVWVDGGAPAGDDTDGHIDQIARFLNRENVVCAVASSEVDENYPGLEANYRKLRLWSRQTEPAVTIHRLPTPPPREVDGAAVPQSYCNFLRLGMDRMLVPTFRSTASDQHALALLRELCPGVEVVGVDCFDIAWGLGALHCASCHEPAIARSPAAESSGG

SEQ ID NO: 73677 - protein, 112 aa, Zea mays
  misc_feature (18)..(18): Xaa can be any naturally occurring amino acid
  misc_feature (97)..(97): Xaa can be any naturally occurring amino acid
TGRALRRTVRPAVPGVTXLSGGQIEEEASINLNAINKCPLRKPWALTFSYGRALQASALKAWGGKKENLKAAQEEYIKRALANSLACQGKYTPSGQXGAAASESLFISNHAY

SEQ ID NO: 73678 - protein, 510 aa, Arabidopsis thaliana
MDINRWSLQGMTALVTGGSKGIGYAIVEELVGFGARVHICDIDETLLNECLSGWHAKGFEVSGSICDVSSRPQRVQLMQTVSSLFGAKLNILINNVGKYILKPTLESTAEDFSSLMATNLESAYYISQLAHPLLKASGNGNIVFISSVTGVVSGTSTIYGVTKGALNQLARDLACEWASDNIRANSVAPWVTATSLVQKYLEDEIFAEAMFSRTPLGRACEPREVASLVTFLCLPAASYITGQTICIDEQSQRWSLKAKTVLVTGGTKGIGHAIVEEFAGFGAVIHTCARNEYELNECLSKWQKKGFQVTGSVCDASLRPEREKLMQTVSSMFGGKLDILINNLGAIRSKPTLDYTAEDFSFHISTNLESAYHLSQLAHPLLKASGCGNIIFMSSIAGVVSASVGSIYSATKGALNQLARNLACEWASDGIRANAVAPAVIATPLAEAVYDDEFKKVVISRKPLGRFGEPEEVSSLVAFLCMPAASYITGQTICVDGGLTVNGFSYQPQG

SEQ ID NO: 73679 - protein, 393 aa, Mesorhizobium loti MAFF303099
MPRPSSRISGIVPSGKDGWEVHFAAWTRKEAGEDIIMLSVGDHDFDTPSQTIEACVTAVRGSNHHYTPLPGLPRLRQAMAAASSACTGIETTPDQVIATPGGQAALYAAVQAVLDQGDHAIVVAPYYATYPNTFSAAGASFTVVETPAEDGFQPRADMIRAALRPNTRAILINTPNNPTGAVYSRERLEQLAQICREHDLWLLSDEVYWTLGGGEHVSPRSLPGMAERTLVINSMSKSHGMTGWRMGWLTGPQDMITLLINLNLVTTYGLPAFISIACAEALENRYGVKEIAERYAARRTVLLDAVRGMNNVSVRGSEGGMYVMLDISDVEPDDEKFAWALLDQEKVGVMPGSSFGEAAAGHIRISLCQPEPVLQEAAARLRRFASTYRREAA

SEQ ID NO: 73680 - protein, 312 aa, delta proteobacterium MLMS-1
MSASPEIPASVAGLVGDTPLLRLEHMSRECGAEILVKLESHNPIFSVKDRIALAMLTAARRQGLIQPTTTIIEPTSGNTGIALAMLCAAQSLRLTLTMPETMSVERRALLRHLGAKLVLTPGPEGMKGAIARAEELAAADTDTFIPNQFTNPANPEIHRRTTAEEIWRATGGELDLFVAGVGTGGTITGVGEVIKERLPGFKAFAVEPAASPVLSGGAPGPHKIQGIGAGFIPAVLNTGIIDEVIQVSNEDAIASARLLAAREGVLAGISSGANLYAAMQIAARPEFKGKRIVTVVCDTGERYLSTDLFLTE

SEQ ID NO: 73681 - protein, 93 aa, Brassica napus
NQSVLVDVESPFKPDVLKGKVALITGGGSGIGYEISSKFGKHGASVAIMGRRKQVLDAAVSDLRSLGIQMTFNWALRVYSRHRISGRRFCFTR

SEQ ID NO: 73682 - protein, 413 aa, Oryza sativa
MGVLSRPEEVLPLVKLRVAAGRIKRQIPPEEHWAFAYTMLQRVSRSFALVIQQLGPDLRNAVCIFYLVLRALDTVEDDTSIPAAVKVPILKEFHRHIYNRDWHYSCGTKDYKLLMDKFRLVSTAFLELGQGYQEAIEEITRLMGAGMAKFICKEFHVQFLAVLSVETVDDYNEYCHYVAGLVGYGLSRLFHAGGTEDLASDSLSNSMGLFLQKINIIRDYLEDINEIPKSRMFWPREIWSKYVNKLEDLKYEENSEKAVQCLNDMVTNALSHAEDCLQYMSALKDHAIFRFCAIPQIMAIGTCAICYNNVNVFRGVVKMRRGLTARVIDETNTMSDVYTAFYEFSSLIESKIDNNDPNASLTRKRVDAIKRTCKSSCSLKRRGYDLEKSKYNSMLIMVVLLLVAIVLGMIYAK

SEQ ID NO: 73683 - protein, 578 aa, Vitis vinifera
MSKQTYRVCFCFRRRFRLTVSEAPQEIKELFDRYSENGMMSIDHLQRSSRRRKLLLKMLRPFWTHLNIFHRKALNLEAFFKYLFGDINPPLSTALGVHHDMTAPLSHYFVYTGHNSYLTGNQLSSDCSDVPIIHALQRGVRVIELDIWPNSTKDNVDVLHGRTLTTPVELIKCLKSIKEHAFSASEYPVVITLEDHLTPDLQAKVAEMVTQTFGDILFTPGPECLNEFPSPESLKKRIIISTKPPKEYLEAKDVKEKENDSQKGKESADEEAWGKEVSNLKPSTVAVDEVHEDSGFNLGPLWFVHIQNAAPEYKRLIAIHAGKVKGGLTEWLRVDPDKVRRLSLSEQELEKAVLTHGKEIVRFTQRNLLRVYPKGIRFDSSNYNPVIGWMHGAQMVAFNMQGYGRSLWIMHGMFKANGGCGYVKKPDFLLNNGSHDGVFDPKAKLPVKTTLKVTVYMGEGWYFDFRHTHFDAYSPPDFYARVGIAGVPADTIMKKTKTLEDNWTPNWDEHFEFPLTVPELALLRVEVHEYDMSEKDDFGGQTCLPVSELRRGIRAVPLFSRKGDKYPSVKLLMRFEFV

SEQ ID NO: 73684 - protein, 55 aa, Zea mays
KRGPKASPNLKVGLCGEPGGDPPSVAFFAKAGLDYVSCPPFRVPIARLTPAQGLV

SEQ ID NO: 73685 - protein, 396 aa, Rhodobacter sphaeroides 2.4.1
MTRPTVRLRPKAEARALRHGFPWVYADELVTDRRTQALAPGTLAVLEDAERRALGLVTVNVSSKIIARMLDRDPEAVIDEGWFAERLTRALALRERLFDQPFYRLVHAEADGLPGVVIDRFGEAAVIQPNAAWAETHLSELEAALVRVTGVTTVVKNGTGRARGLEGLAEETVVLRGGLSAPVPVPMNGATYMADLTGGQKTGLFYDQRPNHAFAARLGRGGSVLDVFTHVGGFALAALAGGAERALAVDASGPALALAEAGAKLAGLGDRFETRQADAFQALEALGAEGARFDLVICDPPAFAPAKPALEAGLRAYERLARLAAPLVAPGGYLVLCSCSHAADLSAFRNASARGIGRGGRRGQLIHTGFAGPDHPILPQLAESGYLKSLFFRLDG

SEQ ID NO: 73686 - protein, 258 aa, Rhizobium leguminosarum bv. viciae 3841
MSESRTSADGGMETSYGFREVPDGQKQGLVNQVFHKVAKRYDIMNDVMSMGMHRAWKDAMISALNPRKEPGYKVLDVAGGTGDIAFRIVEASGRQAHATVLDINGSMLGVGAERAEKKKLSGNLTFVEANAEELPFEAGSFDAYTIAFGIRNVPRIDAALSEAYRVLKRGGRLLVLEFSEVDMPLLDKIYDAWSFNAIPQFGKAITGDAEPYQYLVESIRKFPNQENFAAMIRQAGFSRVTFTNYTGGIAALHSGWKL

SEQ ID NO: 73687 - protein, 332 aa, Ralstonia metallidurans CH34
MNSSSTPTARFVSTGTLPGPEEIRSLVEAAYENFREEAGGKLADYIPALAEADPSAFGICVANTRGHAFMVGEAAETFSIQSVSKPFVFALVCEALGAAEAATRLGVDATGLPFNSIMAMELRTDGTSNPLVNAGAIAATSLIPGFGADDRWHHVRQGLSRFAGRELACDEHVYESEAANNQRNAGLAHLLRGHGRLYCDPDEAVEVYTRQCALLVSARDLALMGATLAGGGVHPLTGEQVVSAATCQRVLAVMATAGLYERSGSWLYDVGLPGKSGVSGGILTIAPGKGAVATFSPPLDAAGNSVRGQLVMRFLSERLGLNLFISAPAAHL

SEQ ID NO: 73688 - protein, 161 aa, Populus trichocarpa
MTVLEHTIPFFLPLREAENDLLSSNAMRFIDYIGELLQAYVDRKEQVRLIKELYGNQIGELYHSLPYHIIEFVLDDFPCKVIVSLRYADLVSVLPTRVRVIAWPIDQFKKSEVMGAHPSPRRLSYAEDALKSMSLPEAYAEIVLRLPQVTQENFFEDRNPS

SEQ ID NO: 73689 - protein, 76 aa, Clostridium perfringens str. 13
MFDKLKEIIADKLSVNEDEITMESTFIDDLGADSLDIVELIMALEEELEMEIPDEDAEGFKTVGDVVEYITEHTEK

SEQ ID NO: 73690 - protein, 224 aa, Photobacterium sp. SKA34
MNQPLNYRNTSFITSAPDIRHLPQDAGVEIAFAGRSNAGKSSALNRLTDQKGLARTSKTPGRTQLINMFEVVQGCNLIDLPGYGFAQVPLEMKLKWQKSLGEYLQRRECLQGLVVLMDIRHPMKDLDQQMINWALESRLPVMVLLTKADKLKSGARKAQVLKIRQMTKELEGDVQVEAFSSLKGIGVDQVRRKLDEWYAPELERQRVLAGGDDAFPEQVEEDNE

SEQ ID NO: 73691 - protein, 538 aa, Medicago truncatula
MGCLLSKDKDSEPEHNNGGYRYGEHNHRNNHEQVNTSRTAPTSSYQPQIPTKPSSISAPSPKPLIKQDSNTILGKGLEDVKQFYTLGKELGRGQFGVTFLCTENSTGLLYACKSISKRKLVSKSDREDIKREIQIMQHLSGQPNIVEFKGAYEDRNSVHVVMELCAGGELFDRIIAKGHYSEKAAASICRQIVNVVNICHFMGVMHRDLKPENFLLASKDENALLKATDFGLAVFIEEGKVYRDIVGSAYYVAPEVLRRRCGKEIDIWSAGVILYILLSGVPPFWAETEKGIFDAILEGHIDFESEPWPKISDSAKDLVRKMLIQEPKKRITAAQVLEHPWIKDGNASDKPIDSAVLSRMKQFRAMNKLKKLALKVIAENMSEEEIRGLKAMFTNMDTDNSGTITYEELKAGLQRLGSKLSEAEVKQLMEAADVDGNGTIDCIEFITATMHRHKLERDDHLYKAFQYFDKDSSGFITRDELETAMKEYGMGDDATIKEIISEVDTIISEVDTDHDGRINYEEFCAMMRSGNQQQVKLF

SEQ ID NO: 73692 - protein, 606 aa, Rhodopirellula baltica SH 1
MPSTFLTSERTRRNQSDRVIRHRSMMLELQGIPVSPGVAIGPALVLDADGYRIPRCIVPASDVEDEFARLHTAVDLVSAHLEHSRLETTATAGRSTGDIFAAQLQMLHDPRLHSELQRRIGEDRQSAAFAVSGVLHNYASALRRLDNPLLADRAQDVLDIERQLLMQLGAVTRQPLSDLSEPVIVLSHMLTPSETANLDRRFVKGFCTETGGPGGHTAIVAKGLEIPAVVGIGDFLHQIAGSNCVIVDGDRGKLIVDPDDDVLENYRERAEYRRSLAVRLAELSQLPAETTDGVRIQLNANIEFPHETVACIDRGADGIGLYRTEFLYLSSDDEPSEEDHYQAYSEVVQKMDGRPVVIRTLDLGADKMGRGNMAHRENNPFLGLRSIRLSLRNLDVFRPQLRAVLRAAVHGDVRVMFPLITTINELRQARMLLNVVAEDLQESGLPYRSDLPVGMMVEVPAAVMMLEHFASEVDFFSIGTNDLAQYTLAVDRSNEYVADLYQSSDPAVLRLIQHSIDVAAKSQTPVSVCGEMSSNPGRALLLLGMGVRNLSVPPSALPRVKKVIRNVSIDQCKAIAERVMKLEAARDVDLYLLDRLSDLAPELVMQ

SEQ ID NO: 73693 - protein, 543 aa, Magnaporthe grisea 70-15
MASSQSGSAARRLQATAQQLRPIASAAMASTPTNYPTTHEKITEPVDTPYFIDNKFIASEATSFIDLHDPATNNLVTRVPQMTDAELKAAVASAEKAFPAWRATSVLARQQIMFKFVALIRENWDRLAASITLEQGKTFADAKGDVLRGLQVAEAACAAPELLKGEVLEVAKDMETRTYREPLGVVAAICPFNFPAMIPLWCIPIATITGNTLILKPSERDPGAAMILAELCQKAGFPDGVVNIVHGAHNTVNFILDDPAIKAISFVGGNKAGEYIFSRGSANGKRVQANLGAKNHAAVLPDCNKNQFLNAIVGAAFGAAGQRCMALSTLVMVGETKEWLPELAELAKGLSVNGGFEEAADLGPVISPQSKERIESLIASAEKEGAKILLDGRGFAPSKYPNGNWVGPTIITDVTKDMECYKQEIFGPVLVCLNVETLDDAVELINSNEYGNGVAIFTRSGATAEKFRRNIEAGQVGINVPIPVPLPMFSFTGNKKSVAGGGASTFYGKPGINFYTQLKTVTALWQSADAISKKADVAMPTHS

SEQ ID NO: 73694 - protein, 390 aa, Pseudomonas syringae pv. syringae B728a
MSQPYSARSRAIEPFHVMALLARANELQAAGHDVIHLEIGEPDFTTAEPIIKAGQAALADGKTRYTAARGLPQLREAISGFYAQRYGVDIDPQRILVTPGGSGALLLTSSLLVDPGRHWLLADPGYPCNRHFLRLIEGEAQLVPVGPQQRYQLTPELVATHWNHNSVGALVASPANPTGTLLSRDELAALSQALKVRNGHLVVDEIYHGLTYGVDASSVLEVDNDAFVLNSFSKYFGMTGWRLGWLVAPQDAVADLEKLAQNLYISAPSMAQHAALACFEPQTLAILEQRRAEFGRRRDFLLPALRELGFGIAVEPEGAFYLYADISAFGGDAFAFCRHFLETEHVAFTPGLDFGRFQAGHHVRFAYTQSLPRLEQAVERIARGLRSWGV

SEQ ID NO: 73695 - protein, 581 aa, Escherichia coli O157:H7 EDL933
MIKPTFLRRVAIAALFTGSCFSTVAAPPAPSPVSYGVEEDVFHPVRAKQGMVASVDATATQVGVDILKEGGNAVDAAVAVGYALAVTHPQAGNLGGGGFMLIRSKNGNTTAIDFREMAPAKATRDMFLDDQGNPDSKKSLTSHLASGTPGTVAGFSLALDKYGTMPLNKVVQPAFKLARDGFIVNDELADDLKTYGSEVLPNHENSKAIFWKEGEPLKKGDKLVQANLAKSLEMIAENGPDEFYKGTIAEQIAQEMQKNGGLITKEDLAAYKAVERTPISGDYRGYQVYSMPPPSSGGIHIVQILNILENFDMKKYGFGSADAMQIMAEAEKYAYADRSEYLGDPDFVKVPWQALTNKAYAKSIAEQIDINKAKPSSEIRPGKLAPYESNQTTHYSVVDKDGNAVAVTYTLNTTFGTGIVAGESGILLNNQMDDFSAKPGVPNVYGLVGGDANAVGPNKRPLSSMSPTIVVKDGKTWLVTGSPGGSLIITTVLQMVVNSIDYGMNVAEATNAPRFHHQWLPDELRVEKGFSPDTLKLLEAKGQKVALKEAMGSTQSIMVGPDGELYGASDPRSVDDLTAGY

SEQ ID NO: 73696 - protein, 335 aa, Clostridium perfringens str. 13
MNMELMKQIWESAKNNRKKIVLPEGDEERTLVASQRIKEEGLADVYLVGSEQVIREKAEALGVNLEGVNIVDPETSDKLDTYINEFYELRKAKGMTVEKAGKIVRDPLYFGTMMVKMGDADGMVSGAVHTTGDLLRPGLQIIKTAPGVSVVSSFFIMMVPGSQYGEGGMLLFSDCAVNPNPNADQLAAIAIATADTAKNLCKMDPKVAMLSFSTMGSADHDLVTKVRVATEKAKELRPDLDIDGELQLDAAIVGKVASQKAPNSKVAGNANVLVFPDLQAGNIGYKLVQRFANAEAIGPVCQGFAKPINDLSRGCSSEDIVNVVAITAVQAQATK

SEQ ID NO: 73697 - protein, 182 aa, Streptomyces avermitilis MA-4680
MTELVNITELLLSRIRDVRDYPEPGVVFKDITPLLADPAAFTALTGALAELTVRHGATKIVGLEARGFILGAPAAVQAGVGFIPVRKAGKLPGATLSQSYDLEYGSAEIEVHAEDLVAGDRVMVVDDVLATGGTAEASLQLIRRAGAEVAGVSVLMELGFLGGRARLEPALAGAPLEALLQI

SEQ ID NO: 73698 - protein, 824 aa, Solibacter usitatus Ellin6076
MFSTPDTLCVERCAANARIRSVLRVLMLVLSLVALGAPLMAQETGGGEANLKLPRLDSVTFLGGISGSSLLMGGLVVSALGLIFGLYIFTRLRAMPVHDSMREVSELIYETCKTYLATQGKFLCILEALIAVIIVFYFGFLLGFEFYKVLIILAFSVVGISGSFMVAAFGMRVNTFANSRTSFAALRGKPFPCYAIPLQAGMSIGMLLVSVELLIMLCILLFVPGDLAGSCFIGFAIGESLGAAALRVAGGIFTKIADIGSDLMKIVFKIKEDDARNPGVIADCTGDNAGDSVGPSADGFETYGVTGVALITFILLAVASPTVQVQLLVWIFTMRIMMVISSGVGYFINDAIAKAKYLNADKFDFEAPLTTLVWLTSILSIVLTYVLSNMMIPDLAGDTTLWWKLATIISCGTLAGALIPEFVKVFTSTNSRHVREIVTSSREGGASLNILSGFVAGNFSAYWLGMAMLALMSIGFFVSTMFPVTLMLAPAVFAFGLVAFGFLGMGPVTIAVDSYGPVTDNAQSVYELSTIETIPNIEALIQKQYGFKPEFEKAKENLEENDGAGNTFKATSKPVLIGTAVVGATTMIFSTIVALTHGLKDNMDKLSMMHAPFLLGLIAGGAVIYWFTGASAQAVTTGAYQAVEFIKKNIKLETTEKASVADSKKVVEICTKYAQKGMFNIFLVVFFSTLAFAFLEPFFFIGYLVSIALFGLFQAIFMANAGGAWDNAKKVVETELRAKGTPLHDACVVGDTVGDPFKDTSSVALNPIIKFTTLFGLLAVQLAVSVSAKQGNTLTTILSAVFFLASTYFVYRSFYGMRIETTKE

SEQ ID NO: 73699 - protein, 613 aa, Debaryomyces hansenii CBS767
PGRQPKSIDLIQDYEEITTFPKPTAECRAALYSSNGEYFAYTQPNEVVVVRTTKEAPLQTRIDLPEVFDIYFSPNGTYLCLWCKPILQDKESGVWNKNVKIFNINSNSIISEWSNKHQAGWKPQFTQDEKLFAKNVNNKELHFFDVTNSSNEEININQPTYKYKLSDPKATFQSFQMSPGLNPSIAIFIPEKNGKPASVVIYNVPNFNQPICLKNFFKAERCQLKWNSIGTALLALASTDHDTTNKSYYGETNLYLLGIAGSYDSRIDLKRTGPIHDITWSPSAREFAVVYGYMPADTTFFDARGNAIFSLPTAPRNTILYSPHARYVLVAGFGNLQGTVDVYDRQNKFSKVVTFEAANTSVCEWSPCGRYILTATTSPRLRVDNGCKIWHASGKLVYLKEYQELYSITWKPQSLDKFPPLRNLEDAPVAHESTKEYLAKKQANDLSAAQKPSGAYRPPHARNSGSSARTSLYQKELQSSSSLSGSNGNGARTRVVPGAAPVDNTPKESKSAAKNRKKREAKKQQQDEGQQTGSPSNSVESVQKDNETSESGVIGGVSSLEEKKIRSLLKKLRAIETLKMKQANGEILEDTQVSKIKKEDDIRKELHLLGWSD

SEQ ID NO: 73700 - protein, 472 aa, Photorhabdus luminescens subsp. laumondii TTO1
MSQNVYQFIDLQRVDPPKKPLKIRKIEFVEIYEPFSTSQAQTQADRCLSCGNPYCEWKCPVHNYIPNWLKLANEGRIMEAADLSHQTNSLPEVCGRVCPQDRLCEGACTLNDEFGAVTIGNIERYINDKAIAMGWKPDMSHVQPTGKQVAIIGAGPAGLACADVLTRNGVQAVVFDRHPEIGGLLTFGIPAFKLEKEVMIRRREIFSEMGIEFRLNTEIGKDIALSELTEQFDAIFLGVGTYQSIRGGLANEDADGVYDALPFLTANTRHLMGYPALPSQPFINMQGKRVVVLGGGDTAMDCVRTAIRQKAASVTCAYRRDETNMPGSQREVKNSKEEGVEFLFNLQPVRIEINHSGQVCGINMVRTQLGQPDENGRRQAEIIAGSEHLLKADAVIMAFGFKPHTMNWLSAHQVTLDKQGRIVAPEYSDIPFQTSNPQIFAGGDAVRGSDLVVTAIAEGRKAAQGILDYLNI

SEQ ID NO: 73701 - protein, 349 aa, Solibacter usitatus Ellin6076
MIGAYLPGNSTVEMKEVPVPVPAHGEVLLRMKASTICGSDIRCIYHEHLGKGPEGYQGVVAGHEPCGQIVKTGPGCRRFGVGDRVIVYHISGCGVCNDCRRGYMISCTSERYRRAYGWQRDGGMAEFLLAEEKDLIPLPGKLSYADGAQVACGFGTVYEGLEKIGISGNDAVLITGLGPVGLATGALCRKLGAEKIIGIDVVPERMKLALDLKLCDEVLASGPENVAEVRRLTGGQGVERAVDCSANEQARATAIRATRKWGRIVFLGEGGRVEFNPSPDIIHDQKTIYGSWVTSTWLMEELVERLVRWNLHPADLVTHRFPLESVDQAYTLMASGKCGKVAVCFDEEL

SEQ ID NO: 73702 - protein, 316 aa, Solibacter usitatus Ellin6076
MPAIGLGTFGSDHVSAEQIADVVRDAAVVGYRHFDCASVYRNEDRIGFAFRDIMKGGIRREDLWITSKLWNDKHGEGDVIASCRQSLADLQLDYLDMYLVHWPFPNFHPPGCDVSSRSPDARPYIHENYMKTWREMERLVELGLVRHIGTSNVTIPKLKLILRDARIRPAVSEMEMHPHFQQRELFEFVRAAGIEPIAYSPIGSPGRPERDRTPEDTVDIEDPVIVAIAKRIGVHPAVVCVKWAEQLGATPIPFSTRRRNYLANLQGVVSDPLTAADMEAIAGIDRNCRLIKGQVFLWKQDQTWEDLWDLKGVIAQ

SEQ ID NO: 73703 - protein, 453 aa, Streptomyces avermitilis MA-4680
MRVEPDLFTAAAEERQEKDPSSSPLAVRMRPRTLDEVVGQQHLLKPGSPLRRLVGEGSGGPAGPSSVILWGPPGTGKTTLAYVVSKATNKRFVELSAITAGVKEVRAVIDGARRATGGFGKETVLFLDEIHRFSKAQQDSLLPAVENRWVTLIAATTENPYFSVISPLLSRSLLLTLEPLTDDDLRGLLRRALTDERGLKEAVTLPADTEEHLLRIAGGDARRALTALEAAAGAALDKGEPEIGLQTLEETVDRAAVKYDRDGDQHYDVASALIKSIRGSDVDAALHYLARMIEAGEDPRFIARRLMISASEDIGLTDPHALPTAVAAAQAVAMIGFPEAALTLSHATIALALAPKSNAATMAIGAAMEDVRKGHAGPVPLHLRDGHYKGAAKLGHAQGYVYPHDLPEGIAAQQYAPEELKDREYYTPTRHGAEARYADAVEWTRKHLGRGRP

SEQ ID NO: 73704 - protein, 85 aa, Capsicum annuum
LLVLRFANRFFLPLWNRDNIDNIQIVFREDFGTEGRGGYFDEYGIIRDIIQNHLLQVLCLVAMEKPVSLKPEHIRDEKVKVLQSM

SEQ ID NO: 73705 - protein, 568 aa, Vitis vinifera
MGNTCVGPNLAANGFLQSVSAAVWRTRPPEDMLPPPNADGSSSGDNAGSDGAKGSDPPMPVQSTPPETVKITAEVQKAEKSDGNSGKQKKQTHMKRLSSAGLQIDSVLQRNTENLKEIYSLGRKLGQGQFGTTYLCVEKANGKEFACKSIAKRKLTTREDVEDVRREIQIMHHLAGHPNVISIVGAFEDAVAVHVVMELCVGGELFDRIIQRGHYTERKAADLARVIVGVVEACHSLGVMHRDLKPENFLFINQDEDSPLKTIDFGLSMFFRPGEIFTEVVGSPYYVAPEVLRKHYGPECDVWSAGVIIYILLSGVPPFWDETEQGIFEQVLKGDLDFVSEPWPSISDSAKDLVRKMLVRDPKKRLTAHEVLCHPWVQVNGVAPDKPLDSAVLTRLKQFSAMNKLKKIAIRVIAESLSEEEIAGLKEMFKMIDVDNSGNITLEELKTGLERVGADLKDSEIIRLMQAADIDNSGTIDYGEFVAAMLHLNKIEKEDHLYAAFSYFDKDGSGYITQDELQQACEQFGLEAIHLEDVIREVDQDNDGRIDYSEFVAMMQDRDFGKKGYKIT

SEQ ID NO: 73706 - protein, 256 aa, Leptospira interrogans serovar Lai str. 56601
MENIMKDKVAIVTGGSTGIGKAVVKEFVSKGVKVVFCGRRLEEGKKLESEIRAEGGDVYFVVCDVTSGEQVKKVVDAALEKFGRLDFGINNAGIMGLNHLLHEYPEDVWDKVVNVNLKGTWLSMKYQIPEMIKMGGGVVVNVSSISGINGVVGINPYAAAKHGVVGLTKSAALEYAKKNIRINAICPGAVKTEILDELFHLAKDPVEAERQLVKLHPIHRIASPEEISKTVLWLCSEDSSFITGTAIPVDGGYSAK

SEQ ID NO: 73707 - protein, 495 aa, Sulfitobacter sp. EE-36
MKDWNALASALYDGSFRPMFINGKWCPAQSGAEMDARNPANGSLLATVPQGGAADIDAAVKSARAAFEGPWAKFTPFERQALLLRIADKFEAEWERLCLSDTLDMGMPIQRTLANSRRVLGMLRFYAGQAVMIHGQTIPNSFPGEIYSSTVREPVGVVGAIIPWNAPIAGSVWKIAPALATGCTVVLKPSEEASLTVLMIARLMQEAGLPDGVLNVVTGLGADAGAALAAHPDVDKIVFTGSTATGQAIARAATGTLKRVSLELGGKSPVIVCKDADIDKAVPVAAMSVFANSGQICIAGSRLFVAREIHDEFTRRVAEFAAGLKIGQGIDEGTDIGPIISARQAERIAGFLSDGPAEGATVLTGGQRAEGAALEGGHFIQPTVFGGVTDDMRIAREEIFGPVISALPFDDLDEVVTRANDTPYGLAAGVFSTNLGTAHKLAHRLKAGSVWVNMYHAIDPAVPFGGVKMSGYGREGGTEHLEEYLDTKAIWINAD

SEQ ID NO: 73708 - protein, 306 aa, Clostridium tetani E88
MMQSKIESIIEECRKYTREGEVASYIPELKKADKDALGIYIDKLDGNEFCAGDYDTKFTIQSISKIIALIIAIMDNGMEKVLSKVGVEPSAYSFNSIVTLEVKNANKPLNPMINAGAIATVSLIKGNSPEEIIERILEFTRKVTGNKNIKVNEEVYQSEKKTGDRNRSLAYFMKGTGIIEKDVEKVLDAYFQQCSIEVTCKDIAKIASFLANDGVLPSTGERIIPAEVAKIVKAVMVTCGMYDASGSFAVKVGIPSKSGVGGGILATVPGVMGIGVFGPALDKKGNSIAGVKILERLSEELNLSIF

SEQ ID NO: 73709 - protein, 222 aa, Arabidopsis thaliana
STNFSGRSSRSSSSSSGFCSGNITEEENVDDDDDGCVDDWEAVADALAAEEEIEKKSRPLESVKEQVSVGQSASNVCDSSISDASDVVGVEDPKQECLRVSSRKQTSNRAWRLDDDLRPQGLPNLAKQLSFPELDKRFSSVAIPSSCPICYEDLDLTDSNFLPCPCGFRLCLFCHKTICDGDGRCPGCRKPYERNMVKAETSIQGGGLTIRLARSSSMFCKF

SEQ ID NO: 73710 - protein, 294 aa, Acinetobacter sp. ADP1
MFDSIAQDIPYHTLIDGSPVRLDLKRLDLIHPHISGNKFYKLKYNLIEAKKRGCDRILTFGGAFSNHIAASAYAAHHFDFKSIGIIRGQELAYRSLNATLKTAQHYGMQLEFMSREQYRQKDQSEFLHTLQSQYPSAFIIPEGGTNALAIQGSKEILSDTDRLNYDVICCAVGTGGTLAGLIEASHHGQYVIGFSALKGDFLHNDVQRHTNKTNWHILDDYCFGGYAKTSSELFDFIAGFEQKYQIPLEQVYTAKMLYGLLDLIQKNDFDQGTRILALHTGGLQGRRHDIGVTE

SEQ ID NO: 73711 - protein, 343 aa, Photobacterium profundum SS9
MKIKALSKLKPEEGIWMNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 73712 - protein, 402 aa, Clostridium tetani E88
MKDFKLICTGCGETYSIKRVHPRCEKCNEPLEMELVKEGKIKDGNPLTQTILERYQDFFPFDEINNELSLNEGFTSLVSSPRMAKRIGIKNIYFKNESQNPTWSFKDRGTLFGIHHAYSMGYKKVGAVSTGNMAVSVAAYGQRAGFETFIFVGENIPEEKLNPVAIYGANLIKVEGDYGKLYYESLEIGKDQGIYFINSDVTYRVEGYKTAAFEMCEQLNFNVPDYVVVPTSAGGNIRGILKGFKEFKEAGIIDRVPKMICAQASGCSPICNSFKEGKDEIERIMDPCTIAHGIENPFPPSGNDTLRKIRENGGTCVAVTDEEIIKAQKEMAKEGIFVQPESCVPLASVKKLKIEGYLDENDSVACVLTGSGLKYTKAFEKHNLSSYECKLQVLETFIEENF

SEQ ID NO: 73713 - protein, 852 aa, Saccharomyces cerevisiae YJM789
MFKSKTSTLSYDETPNSNEGDRNATPVNPKEKSQTKHLNIPGDRSRHSSIADSKRSSSRYDGGYSADIIPAQLRFIDNIDYGTRLRKTLHRNSVVSNGYNKLSENDRWYFDLFDRKYFENYLEEPTYIKIFKKKEGLEQFDRMFLAQELKIPDVYKSTTYQGEPAVANSELFKNSICCCTFSHDGKYMVIGCKDGSLHLWKVINSPVKRSEMGRSEKSVSASRANSLKIQRHLASISSHNGSISSNDLKPSDQFEGPSKQLHLYAPVFYSDVFRVFMEHALDILDANWSKNGFLITASMDKTAKLWHPERKYSLKTFVHPDFVTSAIFFPNDDRFIITGCLDHRCRLWSILDNEVSYAFDCKDLITSLTLSPPGGEYTIIGTFNGYIYVLLTHGLKFVSSFHVSDKSTQGTTKNSFHPSSEYGKVQHGPRITGLQCFFSKVDKNLRLIVTTNDSKIQIFDLNEKRPLELFKGFQSGSSRHRGQFLMMKNEPVVFTGSDDHWFYAWKMQSFNLSAEMNCTAPHRKKRLSGSMSLKGLLRIVSNKSTNDECLTETSNQSSSHTFTNSSKNVLQTQTVGSQAIKNNHYISFHAHNSPVTCASISPDVAIKNLSLSNDLIFELTSQYFKEMGQNYSESKETCDNKPNHPVTETGGFSSNLSNVVNNVGTILITTDSQGLIRVFRTDILPEIRKKIIEKFHEYNLFHLEAAGKINNHNNDSILENRMDERSSTEDNEFSTTPPSNTHNSRLSHDFCELHPNNSPVISGMPSRASAIFKNSIFNKSNGSFISLKSRSESTSSTVFGPHDIPRVSTTYPKLKCDVCNGSNFECASKNPIAGGDSGFTCADCGTILNNFR

SEQ ID NO: 73714 - protein, 210 aa, Francisella tularensis subsp. tularensis SCHU S4
MMKVTLYTTKYCPYSLRARIALAEKKMSTDIVEAGDLEPAMIKKITPNGVFPVLMEKDYSINNRKALLIYIDERFPAPSLLPNVVNERIKIRLSLDKIDNEWYPVLDQIRKHRSDQKMLESMFKDLKESLLAMEKAFTGSEFFISSGFTLADCYIAALIICLEAEGFIIDDEYGAIYEYKKRLFARDSVKKANIKGGAGESLLKTLRTHR

SEQ ID NO: 73715 - protein, 492 aa, Vitis vinifera
MQTSRRKTALFPAEIVAMKQAGGGRKSNNLSVFVVVFSIFLFGCFMYNEDVKSIAEFPFSRPMGQEIQEDGSKSGDPVQESNSNEVDSTVWIGSRMKPRSQMSEETQEPENLSLTVAKQEEKNIELPVVEEEEDDSDVELPPEDCDVFNGDWVYDNVTHPLYKEDECEFLTEQVTCMRNGRQDSTYQNWRWQPRQCSMPKFKPRLLLQKLRGKRLMFVGDSLNRNQWESMICLVQSVAPPGRKSLTKNGSLSIFRIDDYNATVEFYWAPFLVESNSDDPTMHSILNRIIMPESIDKHGQNWKGVDYLIFNTYIWWMNTFKMKILRGSFDQGSTEYDEIERPIAYGRVLRTWAQWVDQNVDPNRTSVFFSSMSPLHIKSLDWDNPDGIKCAKETYPIFNLTTRLDVGTDRRVFAVAVNVTQSMKVPVYFVNITSLSELRKDAHTSVHTIRQGKLLTPEQQADPMNFADCIHWCLPGLPDMWNEFLYSRIISHS

SEQ ID NO: 73716 - protein, 314 aa, Rhizobium leguminosarum bv. viciae 3841
MASARKIIIDTDPGQDDAAAIMLAFGSPDELEVLGITTVAGNVPLSLTSRNARIVCELCSRTETKVFAGADAPIARKLVTAEHVHGKTGLDGPELSEPTMALQPGHAVDFIIETLRREPEGTVTLCTLGPLTNIGLAFQKAPDIVPRIRELVMMGGGFFEGGNITPAAEFNIYVDPEAADIVFRSGVRVVMMPLDVTHQLLTRKDRVKRMAEIGTAPAKAMVEMLEFFERFDIEKYGSDGGPLHDPTVVAYLLKPELFKGRDCNVEIEVQSELTVGMTVVDWWHVTERKRNAKVMRHVDADGFFDLLIERFARI

SEQ ID NO: 73717 - protein, 92 aa, Glycine max
  misc_feature (52)..(52): Xaa can be any naturally occurring amino acid
  misc_feature (55)..(55): Xaa can be any naturally occurring amino acid
  misc_feature (65)..(65): Xaa can be any naturally occurring amino acid
VGFPTSKTYNDITSIVSNGGRLQCMHVWPPLGKKKSETLFYLPYLYDAQSAXKYXYLLKKGWIPXWEFQLDHSLVYHDHYRLPRYYDGRYWT

SEQ ID NO: 73718 - protein, 78 aa, Helicobacter pylori 26695
MALFEDIQAVIAEQLNVDAVQVTPEAEFVKDLGADSLDVVELIMALEEKFGVEIPDEQAEKIINVGDVVKYIEDNKLA

SEQ ID NO: 73719 - protein, 221 aa, Arabidopsis thaliana
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMAHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 73720 - protein, 353 aa, Mycosphaerella graminicola
MGCGQSSESKEGKQRNEEIENQLKRDKMNLRNEIKMLLLGAGESGKSTILKQMKLIHEGGYSRDERESFREIIFSNTVQSMRVILEAMESLELPLDDQRAEYHVQTIFMQPAQIEGDVLPPEVGQAIKTLWSDAGVQAAFQRSREYQLNDSAKYYFDSIDTIASPTYIPSDADVLRSRVKTTGITETTFIIGDLTYRMFDVGGQRSERKKWIHCFENVTTILFLVAISEYDQLLFEDETVNRMQEALTLFDSICNSRWFTKTSIILFLNKIDRFKEKLPVSPMKNYFPDYEGGQDYGAACDYILNRFVSLNQHPTKQIYTHFTCATDTMQIRFVMAAVNDIIIQENLRMCGLI

SEQ ID NO: 73721 - protein, 354 aa, Francisella tularensis subsp. tularensis SCHU S4
MQSIFKKTIIVIVIFLSSYLVALAALPNVYIVATGGTIAGVAKSSTAAVYKAGSLSINDILEKEPAFGKLANIKSEQFYNIDSVDMTMAMRIKLAEYVQKLIDDPNVNAVIITHGTDNMVQTAFFLNQVLDVKKPVILVGAMRAFTSLSSDALMNLYDALVTAVNKQSIGKGVLVVMNEEILTANDVAKTNTTNVDAFKAPNYGKLGTVIINDVDYYQSPRVVGNILSVDDLQKITALPKVEVIYESADISLEFLDSVLTIKGLEGIVLAGLGDGNIPSNQGDFLKKARAKCIVVVRSSYVGSGKVTHNYNNLDDKFDLVSSATLSPEKARIFLQLCLIKTHDIKKIQKLFDRF

SEQ ID NO: 73722 - protein, 355 aa, Mycosphaerella graminicola
MCFGSSSKDDPEAKKSKEIEKQLREDQKRLDREVKLLLLGAGESGKSTVLKQMRLIHTKGFSSSERKQWKVTIFQNLVHAFQVVFGAMEEQEVEFADPSSVGFAELLAADPEIGPDDSMPNDCLHAFKNLWRDQGVQLAIRKGNEYALHDNLTYFLTDVDRLFARDYSPTDQDILRARLRTTGISETIFETGSLTYRMFDVGGQRSERKKWIHVFDNVQVVLFLVAISGFDHVLVEDRNGNQMHEALMLFESIANSKYFEKSALILFLNKIDLFREKVSSGRSLIREHFPEYTGADTDVDEGQQFFARKFKNLVRDPEKEAYVHFTNATDTNLLDKTMKSVQDMIVQRNLHNLML

SEQ ID NO: 73723 - protein, 469 aa, Photobacterium sp. SKA34
MSVENVLALIQENEVKFIDLRFTDTKGKEQHISIPSHQIDADFFEEGKMFDGSSVAGWKGINESDMVMMPDASSAVLDPFTEDATLNIRCDILEPATMQGYDRDPRSIAKRAEEFMRSTGIADTVLIGPEPEFFLFDDVKFNTDMSGSFFKIDDVEAAWNTGSDFEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFSGDKYGGLSEMALYYIGGIIKHARAINAFANPATNSYKRLVPGFEAPVMLAYSARNRSASIRIPVVPSPKARRIEVRFGDPAANPYLAFAAMLMAGLDGIQNKIHPGEAMDKDLYDLPAEEAAEIPTVAESLQGALQALSDDREFLTSGGVFSDDFIDSYIALKSQDVEKVNMTTHPLEFELYYSV

SEQ ID NO: 73724 - protein, 356 aa, Mycosphaerella graminicola
MGACMSSGNNEEGDQKKRSQMIDRSLEEDSKKLRRECKILLLGSGESGKSTIVKQMKIIHQNGYSHDELQLYRHTIYKNLIDCAKALVGAMRQFEIEIENEANRAHCDTIMEYTVDPDPQQSLDPKIGEAVAGVWKDPCISKVFDHQNEFYLMDSAPYFFDEALRITGPDFIPTEADVLRARTKTTGIYETRFQMGQLSIHMFDVGGQRSERKKWIHCFENVTSIIFCVALSEYDQVLLEESSQNRMMESLVLFDSVVNSRWFMRTSIILFLNKVDLFRAKLAKSPLGNYFPDYSGGNDVNRAAKYLLWRFNQVNRAHLNLYPHLTQATDTSNIRLVFAAVKETILQNALKDSGIL

SEQ ID NO: 73725 - protein, 221 aa, Microcystis aeruginosa
HKTQREALEFLQDFKSHLDETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 73726 - protein, 230 aa, Vitis vinifera
  misc_feature (31)..(31): Xaa can be any naturally occurring amino acid
  misc_feature (105)..(105): Xaa can be any naturally occurring amino acid
  misc_feature (112)..(112): Xaa can be any naturally occurring amino acid
MDSDHWSSRLAVAKRQYMLHQTNKSHSDRLXIDDLEVEDDIPCPYCYEDHDIASLCSHLEDEHSFESRVAVSLLLDYTDFEGHGVHLCLCNVLRCPYGFGTLKQXLDGTRRXRLRRVAIPNSQALSLLGRDLREAHLQVLLGGGGYRPSNANASNSLTESLLSSLVLNFPLCEAEEITKSVVPDLEDISGANSSKKTWNTRSTPVLDKYQPEVAIRRLLELQLPSYPLLI

SEQ ID NO: 73727 - protein, 217 aa, Clostridium perfringens str. 13
MVKIAPSILSADFSILGEQVKRVEKGGAEFLHIDVMDGHFVPNISFGFPIMKAIRNLSNLVFDVHLMIEEPGRYVDEFISAGADLITVHYEADRHIDRTINYIKSKGCKAGIALNPGTPVSMLKNLIPSLDMVLIMSVNPGFGGQSFIPYSLDKIKEVKEMAKACGKEDLLIQVDGGVGANNIKEIVEAGANVLVAGSAVFKEDKIEENIKALREAL

SEQ ID NO: 73728 - protein, 501 aa, Oryza sativa
  misc_feature (322)..(322): Xaa can be any naturally occurring amino acid
MENSQMWLLWGALSVALFFYFSTLRRRYAGGKPLPPGPTPLPLIGNLHLVGGGTFHHKLRDLARVHGPVMTLKLGLATNVVISSREAAIEAYTKYDRHLAARATPDTFRACGFADRSMVFIPSSDPQWKALRGIHASHVFTPRVLAAVRPIRERKVGDLIAYLRAHAGEEVLVGHAMYTGILNMVSFSYFSVDIVDMGSQMARELREVVDDIILVVGKPNVSDFYPFLRPLDLQGLRRWTTKRFNRVFSIMGDIIDRRLAHIRDNKPRHDDFLDSILELMAAGKIDRVNVLNMLFEAFVAGADTMALTLEWVMAELLKNPGXVMAKARAELRDVLGDKEIVEEADAARLPYLQAVLKEAMRLHPVGALLLPHFAMEDGVEVGGYAVPKGSTVLFNAWAIMRDPAAWERPDEFVPERFVERTPQLDFRGKDVEFMPFGSGRRLCPGLPLAERVVPFILASMLHTFEWELPGGMTAEELDVSEKFKTANVLAVPLKAVPVLIK

SEQ ID NO: 73729 - protein, 249 aa, Brucella melitensis 16M
MTDDQLFSVRGKVIAVTGGSSGLGLRMVHVLAGHGARVISISRTHAGESLCPSGGEVLEIMADVTRPEEIARAFDEGESRFGPISALFNNAGVAHMARALDTTRDMLEHIFEVNVAGAFFTAQEVARRMIAQGQGGSIINVTSILGERPQKGAAAYSMSKACVSQMTRALALEWAAHDIRVNAISPGWFPTRINEEQLQGPAAGYLKGRNPMRRLGDPNDLDGVVLLLASDASRYMTGSIITVDGGHQL

SEQ ID NO: 73730 - protein, 261 aa, Arabidopsis thaliana
MWLMQYLVTHFSDFQLACIGSFLLHESVFFLSGLPFIFLERQGFLSKYKIQTKNNTPAAQGKCITRLLLYHFSVNLPLMLASYPVFRAMGMRSSFPLPSWKEVSAQILFYFIIEDFVFYWGHRILHSKWLYKNVHSVHHEYATPFGLTSEYAHPAEILFLGFATIVGPALTGPHLITLWLWMVLRVLETVEAHCGYHFPWSLSNFLPLYGGADFHDYHHRLLYTKSGNYSSTFVYMDWIFGTDKGYRRLKTLKENGDMKQT

SEQ ID NO: 73731 - protein, 460 aa, Pseudomonas putida KT2440
MASQDNKKQRSLQHGLTSRQVSMISIAGIIGAGLFIGSSNAIATAGPAILISYAMTGLLVLLVMRMLGEMAIANPNSGSFSTYASEAIGPWAGFTIGWLYWWFWVLIIPVEAIAGADILHAYFPGVPSWLFAFLIMLVLSGTNLVSVKNFGAFEYWFALVKVVAIIGFIGVCTLAVFGFWPLAEVSGVSRLWDSGGFMPNGFGTVLGGVLITIFSFFGAEIVTIAADETANPKDKIRRATNLVVYRIAIFYLASIFLVVSLVAWNDPGLKAVGSFQRVLEVLNVPGAKLLVDLVVLVAVTSCMNSGLYTASRMLYSLGARGQALSVTKRISGSGVPTVAVIFSTLAGFAGCFVNYVFPGKVFGFLLSTTGAIALLVYLVIAVSQLRMRARAEREGRPLELKMWLFPWLTWLVIGTIVMVLGYMLFSDAYRYETLMTAGVTAFILLVSLTQRRAKMVAQTA

SEQ ID NO: 73732 - protein, 221 aa, Microcystis wesenbergii
HKTQREALEFLQDFKSHLEETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 73733 - protein, 102 aa, Physcomitrella patens subsp. patens
MASAMRLRAGAGLPVGSMEVPAHPLPENAELIWDDGSPFPEPCLDNVAPMVGKYEALAWLLGGMGLFAGIGGLAAWNDKASRIPWAPREYPYDDLKVELGKE

SEQ ID NO: 73734 - protein, 416 aa, Pseudomonas putida KT2440
MNQESISQSIAIVHPITLSHGRNAEVWDTDGKRYIDFVGGIGVLNLGHCNPAVVEAIQAQATRLTHYAFNAAPHGPYLALMEQLSQFVPVSYPLAGMLTNSGAEAAENALKVARGATGKRAIIAFDGGFHGRTLATLNLNGKVAPYKQRVGELPGPVYHLPYPSADTGVTCEQALKAMDRLFSVELAVEDVAAFIFEPVQGEGGFLALDPAFAQALRRFCDERGILIIIDEIQSGFGRTGQRFAFPRLGIEPDLLLLAKSIAGGMPLGAVVGRKELMAALPKGGLGGTYSGNPISCAAALASLAQMTDENLATWGERQEQAIVSRYERWKASGLSPYIGRLTGVGAMRGIEFANADGSPAPAQLAKVMEAARARGLLLMPSGKARHIIRLLAPLTIEAEVLEEGLDILEQCLAELN

SEQ ID NO: 73735 - protein, 392 aa, Escherichia coli
MFGTLKITVSGAGYVGLSNGILMAQNHEVVAFDTHQKKVDLLNDKLSPIEDKEIENYLSTKILNFRATTNKYEAYKNANYVIIATPTNYDPGSNYFDTSSVEAVIRDVTEINPNAIMVVKSTVPVGFTKTIKEHLGINNIIFSPEFLREGRALYDNLHPSRIIIGECSERAERLAVLFQEGAIKQNIPVLFTDSTEAEAIKLFSNTYLAMRVAFFNELDSYAESFGLNTRQIIDGVCLDPRIGNYYNNPSFGYGGYCLPKDTKQLLANYQSVPNKLISAIVDANRTRKDFITNVILKHRPQVVGVYRLIMKSGSDNFRDSSILGIIKRIKKKGVKVIIYEPLISGDTFFNSPLERELAIFKGKADIIITNRMSEELNDVVDKVYSRDLFKCD

SEQ ID NO: 73736 - protein, 493 aa, Nocardioides sp. JS614
MAVETGRITTDIPARLDRLPWARWHWLVVIGLGTVWILDGLEVTIVGSMSDALKPDGTGLGMNNFDIGLAGSMYVAGACLGAPFFGQLTDRLGRKKLFIVTLAVYTVATVLTAFSMNPMWYFACRFLTGCGIGGEYAAINSAIDELIPAKYRGRVDIAINGSFWVGAAGGALLTIPLLDPTMIDQSWGWRLAFGLGAILAVGILVVRRNVPESPRWLFIHGREDEAEQIVRDIERTVSEESHHQLHDVHDTITVRQRTSIGIGLIARTVFTLYPKRTILCFSLFVGQAFLYNAFFFTYGDTLTTFLGVEQTGYYIAVFAASNFAGALLLSPLFDTLGRVKMITATYIGSGVLLAVTGFYLGSFDATTLTLMGAIIFFMASAGASAAYLTASEVFPMETRALCIAFFYAIGTAAGGISGPLFFGWLIEQASADKDITQIAVGYFLGAALMIIGGIVEAFLGVKAEGKSLESIAQPLTAEDTDTGSTGSTQPQHA

SEQ ID NO: 73737 - protein, 302 aa, Streptococcus equi subsp. zooepidemicus
MTKVRKAIIPAAGLGTRFLPATKALAKEMLPIVDKPTIQFIVEEALKAGIEEILVVTGKAKRSIEDHFDSNFELEYNLQAKGKTELLKLVDETTAINLHFIRQSHPRGLGDAVLQAKAFVGNEPFVVMLGDDLMDITNPSAKPLAKQLIEDYDCTHASTIAVMRVPHEEVSNYGVIAPQGKAVKGLYSVETFVEKPSPDEAPSDLAIIGRYLLTPEIFAILENQAPGAGNEVQLADAIDKLNKTQRVFAREFKGERYDVGDKFGFMKTSLDYALKHPQVKDDLTDYIIKLGKALESTQQQAK

SEQ ID NO: 73738 - protein, 346 aa, Erwinia carotovora subsp. atroseptica SCRI1043
MFNALFVVVFVCFSSLANAAENLPNIVILATGGTIAGSAAANTQTTGYKAGALGVETLIQAVPELKTLANIKGEQVASIGSENMTSDVLLTLSKRVNELLARSDVDGVVITHGTDTLDESPYFLNLTVKSDKPVVFVAAMRPATAISADGPMNLYGAVKVAADKNSRGRGVLVVLNDRIGSARFISKTNASTLDTFKAPEEGYLGVIIGDKIYYQTRLDKVHTTRSVFDVTNVDKLPAVDIIYGYQDDPEYMYDASIKHGVKGIVYAGMGAGSVSKRGDAGIRKAESKGIVVVRSSRTGSGIVPPDAGQPGLVADSLSPAKSRILLMLALTKTTNPAVIQDYFHAY

SEQ ID NO: 73739 - protein, 80 aa, Lactobacillus johnsonii NCC 533
MTEEEIFNKIADMISERFSIDRDKITKDLNFQNDLDADSIDFVELVMDLEDTFGAEIPDDDAEKLQTVGEAVEYIKSHQN

SEQ ID NO: 73740 - protein, 203 aa, Vitis vinifera
  misc_feature (65)..(65): Xaa can be any naturally occurring amino acid
  misc_feature (70)..(70): Xaa can be any naturally occurring amino acid
  misc_feature (120)..(120): Xaa can be any naturally occurring amino acid
MNLRVQTRYPLFREVIRINFLKSLSKRLKCNITAYENYHRVYVPEGQSPKSDPKEPLRVYVLFQXIQKMXSSETAVIAETRDSWFNCQKLKLPRGCRYEFQLQYGSIGCFYVTLLDISTXILYEQGKAYLEEGLAKSVSQVDNMASLSSDIFCDILKHFDGDPALTSATHACAGLCLSRLMNLLERRLSRDDEEDEEKLDKSR

SEQ ID NO: 73741 - protein, 94 aa, Trifolium isthmocarpum
LAVKEAAWGLARYAAISQDNGLVPIVEPEILLDGEHNIDRTFEVAQKVWAEVFFYLAENNVQFEGILLKPSMVTPGAESKEKESPATVADYTLK

SEQ ID NO: 73742 - protein, 172 aa, Solanum commersonii
MANPRVFFDLTIGGAPAGRVVMELFADTTPKTAENFRALCTGEKGVGKMGKPLHYKGSTFHRVIPGFMCQGGDFTAGNGTGEEKSIYGAKFKDENFVKKHTGAGILSMANAGPGTNGSQFLICSAKTEWLDGKHVVFGQVVEGLDVIKKAEAVGSSSGRCSKPVVVADCGQL

SEQ ID NO: 73743 - protein, 484 aa, Bowenia serrulata
GVPTLVEKNVGRIVQIIGPVLDVAFPPGNMPNIFNSLIVKGQDTAGQEIHVTCEVQQLLGNNKVRAVAMSATDGLTRGMKVIDTGAPLSVPVGGATLGRIFNVLGEPVDNLGPVDARTTSPIHRPAPAFIQLDTKLSIFETGIKVVDLLAPYRRGGKIGLFGGAGVGKTVLIMELINNIAKAHGGVSVFGGVGERTREGNDLYVEMKESGVINEQDISGSKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPWIVGEEHYETAQGVKQTLQRYKELQDIIAILGLDELSEEDRLTIARARKIERFLSQPFFVAEVFTGSPGKYVGLVETIRGFQMILSGELDGLPEQAFYLVGNIDEATAKAMNLKVES

SEQ ID NO: 73744 - protein, 310 aa, Clostridium tetani E88
MILKMNKKTKIILDTDPGIDDAVAIVAALFSPKIQVELITTVSGNVDVDKTTENALKILEFLNKDVPIAKGARKPLMRELDDASDIHGDSGLDGYNFGKITRKTDEKPAIDKMREVIINSEEKITLVAIGPLTNIALLLSSYPEVKDKIDKLVIMGGSASRGNKTPAAEFNIYVDPESANIVFKSGINIVMCGLDITNNAIFKEEDINYIKNLNKTGYMLYSLFKCYRSGSFKKGLRMHDLCAIAYLDKPEIFKAVSAKVDIETKGEHTLGATVVDFDNYSNGKAQVKVCMELDVEDLKKWFFSILNKVN

SEQ ID NO: 73745 - protein, 216 aa, Lactobacillus johnsonii NCC 533
MIAPSILNADNMHLSRDIKAAIESGIDRFHIDIMDGHFVPNLSYGPELVKDFKRSFPLTDAEIHLMSNDLETTLPLFVEAGCDLLEFHYEATDNPEYWLKYLKDHNVRCGMAINPSTPVQKLQPFLKELDQVLLMTVKPGFGGQKFEEESVERLVELKNMIEAENLSVPIEVDGGIEPKTLKLTRDAGATIFVAGSYIFKNGSIEDQVMKLKKEDK

SEQ ID NO: 73746 - protein, 484 aa, Ceratozamia miqueliana
  misc_feature (330)..(330): Xaa can be any naturally occurring amino acid
GVSTLVEKNVGRIVQIIGPVLDVAFPPGNMPNIFNSLIVKGQDTAGQEIHVTCEVQQLLGNNKVRAVAMSATDGLTRGMKVIDTGAPLSVPVGGATLGRIFNVLGEPVDNLGPVDARTTSPIHRPAPAFIQLDTKLSIFETGIKVVDLLAPYRRGGKIGLFGGAGVGKTVLIMELINNIAKAHGGVSVFGGVGERTREGNDLYVEMKESGVINEQDISRSKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPXTTFAHLDATTVLSRGLAAKGIYPAVDPLDSTSTMLQPWIVGEEHYETAQGVKQTLQRYKELQDIIAILGLDELSEEDRLTVARARKIERFLSQPFFVAEVFTGSPGKYVGLVETIRGFQMILSGELDGLPEQAFYLVGNIDEATAKAMNLKVES

SEQ ID NO: 73747 - protein, 733 aa, Arabidopsis thaliana
MVEGFSLSLMFLLVSHFFVSGVMSRNFTIENKCDYTVWPGFLTMTTAVSLPTNGFSLKKGESRVINVPPSWSGRLWGRSFCSTSSTGNFSCATGDCGSGKIECSDSGARPPTTLIDFTLDATDGQDFYDVSVVDGYNLPLVVVPQRLGSGRTCSNVGCVVNLNKTCPSELKVMGSSNKEHPIACMNACQKFGLPEFCCYGEYGKPAKCQPTLYSTNFKNECPLAYSYAYDNENNTFRCSNSPNYVITFCPNDISSMSQPSKETNGGTKRVSAALTLMILIVVVIIVRTKNMRNSEWNDQNVEAVAMLKRYSYTRVKKMTNSFAHVLGKGGFGTVYKGKLADSGRDVAVKILKVSEGNGEEFINEVASMSRTSHVNIVSLLGFCYEKNKRAIIYEFMPNGSLDKYISANMSTKMEWERLYDVAVGISRGLEYLHNRCVTRIVHFDIKPQNILMDENLCPKISDFGLAKLCKNKESIISMLHMRGTFGYIAPEMFSKNFGAVSHKSDVYSYGMVVLEMIGAKNIEKVEYSGSNNGSMYFPEWVYKDFEKGEITRIFGDSITDEEEKIAKKLVLVALWCIQMNPSDRPPMIKVIEMLEGNLEALQVPPNPLLFSPEETVPDTLEDSDDTSTFFNPSHFERGVTSRNFNIENKCDYTVWPGVLSVTVWLSTTGFELKKGQSRVINVPLSWTGRFWGRSLCSTSSTGNFFCATGDCGSGKIECSVRGYRDQHNIENSL

SEQ ID NO: 73748 - protein, 528 aa, Clostridium tetani E88
MISTNNISLRYGGRVLFEDVNVKFTPGNCYGLIGANGAGKSTFLKILSGEIEANKGDVILEPGKRMAVLKQDHFQFDSEPVLETVIMGHERLYNIMKEKEKIYSKEDFSEEDGIKVAELEGEFTELNGWEAESEAATLLTGLGIPVELHYKLMKDLDGGQKVRVLLAQALFGKPDILLLDEPTNHLDIKSIQWLEEFLINFENTVILISHDRHFLNKVCTHIADLDFGKIQLYVGNYDFWYESSQLALEMAKDQNKKKEEKIKDLEEFIARFSANASKSKQATSRKKMLDKITLEDIKPSSRRYPFVGFKPDREAGNDLLAVEGITKTIDGEKVLNNVSFRVNKGDKIAFVGENSIAKTALFQILTGEDKADSGEFKWGITTSQSYFPNDNSNYFNGVNLNLVDWLRQFSEEKSETFIRGFLGRMLFSGEEALKSAEVLSGGEKVRCMLSKMMLSGANVLILDEPTNHLDLESITAVNNGLINFPGTILFTSHDHQFVQTIANRIIEITPDGIIDRQMTYDEYLNSKK

SEQ ID NO: 73749 - protein, 115 aa, Triticum aestivum
LLVPPTSLAKMSTVTRAYLDQRLAAAKRCSKEATMAGAKAAAVATVAAAVPTLASVRMLPWAKAHLNPTGQALIISTVAGMAYFIVADKTILSMAMARRHSFEDAPEHLKNTSFH

SEQ ID NO: 73750 - protein, 904 aa, Zea mays
QHQHSSLSTTSTRSLLSHDRLTPHPRGRLQEQRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGEKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 73751 - protein, 366 aa, Helicobacter pylori 26695
MGLSVGIVGLPNVGKSSTFNALTKTQNAQSANYPFCTIEPNKAIVNVPDRRLDALAQIVKPERILHSVVEFVDIAGLIKGASKGEGLGNQFLANIKECEVILQVVRCFEDDNITHVNDKIDPLNDIETIELELILADIAALDKRIDRLQKALKSSKDAKNLLECALSLKTHLEELKPAKTFPLNTSEAFLELDKELRFLSHKKMIYVANVGEEDLNALNEHAKKVKNHAKEQNSEFVALCAKLEEEMVSMSGDEVKEFLQSLGVEESGLEKTIRLSFKELGLINYFTAGVKEVRSWTIKKGSSAPVAAGVIHKDFEKGFIRAETISYDDFIAYKGEAGAKEKGALRIEGKDYIVQDGDVLHFRFNI

SEQ ID NO: 73752 - protein, 685 aa, Clostridium perfringens str. 13
MIGKILGNRYELLQCVGEGGMSFVYKARCRKLNRFVAVKILKDEFKNNEEIVRRFKKEATAIANLSNPNVVNVLDVGTQDDINYIVMEYVEGKTLKDIIKEKGALPYEVAISIGIKVAKALECAHKSGIIHRDVKPQNILVTEEGVVKVTDFGIAKSMDSSTIAHTNSVMGSAHYFSPEQAKGTYTDYRTDLYSLGIVLYEMVTGVVPFNGDSPVTVAVKHIQEKAIPPKNINQNIPNSLNDLIMKAMEKDPVNRYQTAKEIIGDLEKIKKDPNVTISSKSAEDEDQFTRVMSPVVVPNTETNNSEPDEDDEDDDEYYEDDEDEDEEENNIQTKPQKAINKNKKKSPILIIIATILVVALGITLGFLGMKKFMEGGKDVKIPNVVGEKVEDAKSKLEGLGLKVLEVTEESDQEKGIVLKVDPNVDSTVKTGSEVKLTVSGGEGQIKVPNFAEMNLDSVKRTLKSLGLELGSVDEEYSDSVPRGEVISQSPNANESVDKGSKVNVTISKGKEIKSETINIPDVSGKSVEEAKSILANAGVGVNPVKGEAAKSEGEAGKVYSQSQSGSLTIKQGEKVTITINYYGDYVKPEKPKHNAGELVGMTGAQAKAWASKNKINVSGITSDTAKVKSVSNSGEVEEGGSVSVTMEEEKKPEQPTQPNQPTQPTQPNQQAQPEQPKQPEQSGNN

SEQ ID NO: 73753 - protein, 179 aa, Helicobacter pylori 26695
MNETLKEELLQSIREVKDYPKKGILFKDITTLLNYPKLFNKLIDTLKKRYLALNIDFIVGIEARGFILGSALAYALGVGFVPVRKKGKLPAHTLSQSYSLEYGSDSIEIHSDAFRGIKGVRVVLIDDLLATGGTALASLELIKALQAECIEACFLIGLKELPGIQLLEERVKTFCLLEC

SEQ ID NO: 73754 - protein, 351 aa, Debaryomyces hansenii CBS767
SSIRKLATFISPESALPKKYGGKYTVTLIPGDGVGKEITDSVRTIFSHQNVPIEWEVVDVSGLEAGNGVTEAVESLKRNKVGLKGILYTPTGTSGKSLNVALRKELDIYASLVLIKNIPGVKGRLEGIDFALVRENTEGEYSGLEHQSYPGVVESLKIMTRFKSERIAKFAFDFAKKNNRKLVTAIHKANIMKLGDGLFRTTVKDVGQDYAGIEVNDLIVDNASMQAVAKPQQFDVLVTPNLYGTILSNIGAALIGGPGLVPGANFGREYAVFEPGCRHVGLDIKGQNTANPTAMILSAAMLLRHLGLNDHADKISKATYDVIAEGNVRTKDIGGASSTTEFTDAIVAKLN

SEQ ID NO: 73755 - protein, 601 aa, Bordetella pertussis Tohama I
MGKTVRGGAAAILGCWVNDITPGTLRADAQAGLLGALLVLPQGVAFAMLAGLPPEYGLYSAIVPCIVAALFGSSRHVLSGPTNANSLALFAVLAPLALPGSPGYIQMALAVTILVGVMQLAVGLLRLGSLANFISPSALFGFTSGAALLIAVHALKDALGLEGVQAHSAGAVLAAVGSRLGEAHWGASVVALTTIIVTLLVRHWDRRKPHMLAGLAAGTLLAAALNAGVFTAAGQPISVLGGLAQPWPPFHVPAVQWSVLPDLVGVAVPLTIVALAQSISIAKAVAMRSGQLIDANREFIGQGLSNVVGGLFSSYLSCGSLNRSVPNYEAGARTPMAAVFAALLLVLLVLVSSPVLALIPHAAIAGLLIVVAWSLLDLPRWRVLVRIAPREALIAAATLAATVTIRMEIAILLGTLLSLTAYLYRTARPAMRPMGFDAADPQRHFAVLEGQPGELPECPQLKLLRMEGSVYFGAATHVTDRLQALRAGASAGQRHLLVMSKSMNFIDHAGAQVWEEELRRRRAGGGDLYFHRPRPEVLRDWRRSGFIDRLGADHIFPDKATAIHTIYERLDPEICRGCTARIFTECGPPGTAHQPGAERAE

SEQ ID NO: 73756 - protein, 188 aa, Rhizobium leguminosarum bv. viciae 3841
MFIQTEATPNPATQKFLPGKVVMENGTAEFRSTEEAQASPLAARLFEISGVTGVYFGYDFISVSKDNADWQHLKPAILGSIMEHFMSGKPVMGDASILSEDADADDEFFDEGDESIVLTIKELLETRVRPAVAQDGGDITFRGFKDGKVYLNMKGSCAGCPSSTATLKHGVQNLLRHFVPEVQEVIAA

SEQ ID NO: 73757 - protein, 1230 aa, Candida albicans
MSILSENNPTPTSITDPNESSHLHNPELNSGTRVASGPGPGPEVESTPLAPPTEVMNTTSANTSSLSLGSPMHEKIKQFDQDEVDTGETNDRTIESGSSDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSSSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 73758 - protein, 198 aa, Brassica napus
MSEEQQRPAPRLNERILSSLSRRSVAAHPWHDLEIGPGAPQIFNVVVEITKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHYIDIKELPPHRLSEIRRFFEDYKKNENKEVCGNDFLPSENAIDAIQYSMDLYAE

SEQ ID NO: 73759 - protein, 405 aa, Vibrio campbellii AND4
MAGVLGMILAGGEGSRLRPLTESRSKPSVPFGGSYRLIDFALNNFANADLMRIYVLTQFKSQSLFHHLKKGWNINGITDRFIDPIPAQMRTGKRWYEGTADAIYQNLRFMELAEPEQVCIFGSDHIYKMDIKQMLAFHQEREASLTVSALRMPLSEASQFGVIEVDNQGRMIGFEEKPAHPKSIPGDPKHALVSMGNYVFEAKVLFAELIEDADNEASSHDFGKDIIPKMFPRGDVFVYDFSTNRITGEREEVYWRDVGSIDAYWQAHMDLLEKDAPFSLYNRKWPLHTYYPPLPPATFTDSDNGRVQIIDSLVCSGSYVRGSRIEKSVLGFRSNIASACDISQCILLGDVKVGEGCVLHRVIVDKNADIAPGTQIGVNLQEDKKHYHVSDDGIVVIPKGARVGY

SEQ ID NO: 73760 - protein, 751 aa, Debaryomyces hansenii CBS767
IVFTTGQYTHFNLTQDKNLWIIGRNQECDYTLNLSTRLSNKHFKLWFNSQYNTLWIQDMSTNGTHLNNSRLVKGSNYMLNQGDEISVGNGIAKDIVKFVILFQDKFNPSKFSNPDMKEQGIYKDFIVKNEVIGQGAFATVKKTIERSTGKSYAVKIINRRKALKNGESMEGVNRELSILRQLDHPNIVYLKSFYEDIDNYYLVMEYVPGGDLMDFVAANGAIGEDATQVITKQILEGINYVHKMGISHRDLKPDNILIMQDDPILIKITDFGLAKLSDNVTFMKTFCGTLAYVAPEIITGKYDANDSNNYSSLVDIWSLGCLVYVLLTSHLPFNGKTQAQMFTKIKNAEYHESPLNTYNVSADGKEFLNCCLQVNPRLRITAQGALKHKWLSHIKDENEEMSLSQSQSQQLRKIDNDMVRPLEKNQFKVPKRVVLPPSQQPASQQKAIPKPKSQINDKNSVEHNEDIQEEATDKTKIQSQHKSINGHSLQDITNDNIYQNNGKRSIDASSEPIDTSKRIKLENLSINEEVPKDTFIILLPVDKTVNNKPIYIRQGVNPYAIGRNETCDTFINDDRISKIHCLIQKKRHPVLTSSIYESPAHCLDDIWLLDLSTNSCLINGVVLGKNRKTQIFNNDIIDLFKDDKINERMSYKISIKDQTGLFNRGERMNNNKLVNVLKQDLNDLRLKPKTVVEPAIPESNSQKDIIGNGGNFNSQLRQQRKLLANSNKPSQSTKRANLQVGQSRPTNSWLS

SEQ ID NO: 73761 - protein, 206 aa, Borrelia burgdorferi
MAKIIGISGGSGSGKTTVVSKISEFIPEFVLISQDNYYKSVGDYEHEFSKVNFDHPDAFDNNLFYEHLKNLKKNSPIDMPLYDFINHKRQLKTVLVVPTPVVIVEGIMIFVEERVRNLIDLKIYIDTPNDIRFIRRLRRDISKRGRTVESVIDQYLNTTRWGYYRFIEPTKEYADLIIPEGGHNDKALYVLSTFLKSLSKEGLDFT

SEQ ID NO: 73762 - protein, 479 aa, Pseudoalteromonas haloplanktis
MSTNSCCSSDNSQPEQLHVAIIGSGSGAFASAIKAAEGGARVTIIEGADVIGGCCVNVGCVPSKILIRAAQLAHQQRTNPFDGLENIQPQLSRSLLAHQQTARVEELRGAKYQSILENNPALSLLKGYARFKNENTLLVQMADGSEEELVADRILIATGSTPSIPPIDGLVDTPYWTSTEALFSDVLPSSLVVIGSSVIALEIAQAYARLGSSVTVLARHTLLYAEDPLLGEKLTECFEKEGIRVLNNTQANHVSYSNNGFPLETNEGTLTAEKLLISTGRHANTDKLGLENVGVETDKSGAIVVNSMMETSTANIYAAGDCSNMPQFVYVAAAAGSRAGINMTGGNAQLDLSTMPAVIFTDPQVATVGLTEEQAITGGFEVISRVLDMENVPRALANFETDGFIKLVADKSTGKILGAQILAHEGGELIQSAALAIHNKMTVEELAGQLFPYLTMVEGLKLCAQTFSKDVKELSCCAG

SEQ ID NO: 73763 - protein, 465 aa, Solibacter usitatus Ellin6076
MSSGRILIVEDDDSLRKVMHVQLEREGYETSSASTAEEAFAILDKASQSLVMTDLHLPGMSGLELLKKVRLDYPETAVIVMTAFGTIQTAVEAMKAGAYDFLTKPIHPYELKMLVRRCLEHHRLIEEVQVLRTALDEKYGFEAIVGSSSQLMRALDVAARVASTDATILIYGETGTGKELVAKAIHLRSSRRDRPFITINCGAIPKELLESELFGHVKGSFTGALTHKKGKVEMADGGTVLLDEIGEMPLELQVRILRLIQEREIEKVGATSPTKVDVRIVAATHRELAGMVKAGTFREDLYYRLLVVPINLPPLRERTGDILILVQHFLEKCRMKHSRPNLMMSTDLLPYFTNYSWPGNVRQLENAVERLVLLARDSTINASDLPDFLSAAPAPPPEPVPVALPEGGINLEDLEKDLILQALKKYAGNQTRAAQYLNMSRRAFAYRLEKYDFHPDVLKARKHDA

SEQ ID NO: 73764 - protein, 218 aa, Zea mays
MDMAIDTPSPAPPTPPAPSAAAGRQTRAAEAVRLEHQLVRVPLESLRATVRSNHRLAEKEIAAVLSSASAAPAESSAAAVDHLTSLVSRLHGLKRKMEEGARAEELQVQRCRARLDRLATASTGDDAEWEDMRLKRILVDYMLRMSYYNSATKLAETSGIQDLVDIDVFLDAKRVIDSLQNNEVSPALAWCAENKSRLKKSKGCLTFFRFSIDLIQSA

SEQ ID NO: 73765 - protein, 463 aa, Sulfitobacter sp. EE-36
MTSAFANLQKSIYSCASAKISGTVRSITGMTLTVSGLEAMAAIGSQCRVYTPAGHIDGEVVSAQGSDLCVLPFGTWEGVSVGNTVELIEHDDMVSPDDSWIGTVVDALGRPLTQYTRARRPRRKTRFRANPPGAFDRKKVGEKLETQIKCIDIFTPICRGQRMGVFAGSGVGKSTMMAMLARNTDADVIVIGLIGERGREVQQFIQEDLGEEGMARAVVVVSTGDEAPLLRKQAALTTTAIAEYFKSTGKQVLLLLDSVTRFAMAQREIGLARGEPPTLRGYPPSVFSELPHLLERAGPGMAAEGDITGLYTVLVDGDDMNEPIADAVRGIVDGHLVLDRRIAEQGRFPAIDLQKSLSRMLPGCHSPEEYEITKVARKALGRYADMEDLIRLGAYKAGSDPETDQAITFFQAASPFLSQSRGDKTPAAEGFADTYRMILESGIDDPLRSFFEERARAEATPAQ

SEQ ID NO: 73766 - protein, 1074 aa, Oryza sativa
MRGDAPAASSSSSASSPPSLFGGGDGGGELFGSAPGPLVFLPLLLIQGGGMDLSRVGEKLLSSVRSARSLGLLPPTPPPPASRPEVPARAAAAAAAARAIAGLPPHEKISLPSNSEDLVSIYGSNPQGHAVGELEEVFFQEEFDPIKYILQSIPAEGDSSYFDKQSTLRLAQLDKIAERLSHHVMGHHEEMVKGMQLVMELEQDLKVANVICMNGRRHVSSSKNEVSRDLVVNVKSKKKQALLDVLPILTELRNAQDMQMELESFVEKENYFQAFQLLPEYLQILENYSGLSSVQEMGRGIEAWLARTIQKLDTHLLGVCQTFHEESYLTVIDAYALMGDIGGMAEKMQSFFLQEVLSQTHYVLKEMLEEEVGNNTQRNRFTYSDLCAQVPEPKLRPCLLRTFQSLFSLMCSYYTIMSFCPGVKSIESEGENSLTGRNNTSQSADESLGDSGRGHAAEMSDRTSSSDVSNPDTSTSGTDSPFYQLRTDAAKLVAHAFERGRRNLWQLATSRLSVLLSSSVVFSTSTYQFLKNYEDLTIFILAGEAFCGFEASEFRQKLKGICLNYSVAFHRQNIYALKMVLERESWTIMSAEASRIISLAGLTGDGAALISPTSRISTLPIHGSTMSDTGKEKNGFAAWTKIENPFFYKVENGTTESPKSNMMFNSVDNSSAHGSTNNGNGNKAPLDEENEDLLADFIDEDSQLPSRLAKTKIVKGNSSHWKDGDISSQTGSSLSLLRMMDKYARLMQKLEIVNVELFKGICQLFGIFYHYIYETFGNQDRGQSGKSLPDHQSFRLRVALSKITQDSDQWIKPQSISYSPSSPVSMDVMPTAPPSSMFTLYGLKERCAAAETISLVARVLNRSRAHLHSVLSQSNTSILEEFFGTMVDSVPDLAEHIHRTSARMLLHINGYPDKIANAKWEVKELGMEHNGYVDLLLGEFKHYKTRLDHGGISKELQDLLLEYGIDSIAEVLVEGLSRVKRCTDEGRALMSLDLQVLINGLLHIVSANVRPKLQIVDTFIKAYYLPETEYVHWARSHPEYSKSQVVGLVNLVATMKGWKRKTRLETIERIEAGP

SEQ ID NO: 73767 - protein, 286 aa, Streptococcus pyogenes M1 GAS
MITLKSAREIEAMDRAGDFLAGIHIGLRDIIKPGVDMWEVEAYVRRRCKEDNVLPLQIGVDGHMMDYPYATCCGLNDEVAHAFPRHYILKEGDLLKVDMVLSEPLDKSIVDVAALDFDNVPEMKKWTGSYTGGLADSCWAYAVGTPSDEIKQLMDVTKEAMYRGIEKAVIGNRIGDIGAAVQEYAESFGYGVVRDLVGHGVGPTMHEEPMVPNYGTAGRGLRLKEGMVLTVEPMINTGTWEIDTDIKTGWAHKTLDGGLSCQYEHQFVITKDGPVILTSQGEERTY

SEQ ID NO: 73768 - protein, 71 aa, Brassica napus
ALFLNTAGGAWDNAKKYIETGALGGKGSEAHKAAVTGDTVGDPFKDTAGPSIHVLIKMLATITLVMAPVFL

SEQ ID NO: 73769 - protein, 458 aa, Erwinia carotovora subsp. atroseptica SCRI1043
MEQPSSKLKRGLSTRHIRFIALGSAIGTGLFYGSASAIQMAGPSVLLAYLIGGIVAYIIMRALGEMSVHNPQSSSFSRYAQDYLGPLAGYVTGWTYCFEMLIVAIADVTAFGIYMGVWFPAVPHWVWVLSVVLIIGAINLMNVKAFGELEFWLSFFKVATIIIMIAAGIGIIVWGIGNGGEPTGIHNLWSNGGFFSNGVMGTILSLQLVMFAYGGVEIIGITAGEAKDPHKSIPRAINSVPWRILVFYVGTLFVIMSIYPWNQVGTNGSPFVLTFQHMGITAAAGILNFVVITASLSAINSDVFGVGRMLHGMAEQGHAPKVFSRVSKRGIPWVTVVVMMMALLVAVYLNYIMPGKVFLVIASLATFATVWVWIMILFSQIAFRRRLSVDEVKALAFPLRGGIATSVFGIVFLFFIIGLIGYFPDTRISLYVGIIWILVLLVGYVWKKKHQNAVAAQN

SEQ ID NO: 73770 - protein, 334 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 73771 - protein, 475 aa, Encephalartos barteri
VGRIVQIIGPVLDVAFPPGNMPNIFNSLIVKGQDMAGQEIRVTCEVQQLLGNNKVRAVAMSATDGLTRGMKVIDTGAPLSVPVGGATLGRIFNVLGEPVDNLGPVDARTTSPIHRPAPAFIQLDTKLSIFETGIKVVDLLAPYRRGGKIGLFGGAGVGKTVLIMELINNIAKAHGGVSVFGGVGERTREGNDLYVEMKESGVINEQDISGSKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPWIVGEEHYETAQGVKQTLQRYKELQDIIAILGLDELSEEDRLTVARARKIERFLSQPFFVAEVFTGSPGKYVGLVETIRGFQMILSGELDGLPEQAFYLVGNIDEATAKAMNLKVES

SEQ ID NO: 73772 - protein, 200 aa, Erwinia carotovora subsp. atroseptica SCRI1043
MVLVTRQAPDFTAAAVLGSGEIVENFNLKKHINGKAAVIFFWPMDFTFVCPSELIAFDHRYAEFKKRGVEVVGVSFDSEFVHNAWRKTPVDKGGIGEVQYAMVADIKREIQKAYGIEHPEAGVALRGSFLIDKNGVVRHQVVNDLPLGRNIDEMLRTVDALQFHEEHGEVCPAQWEKGKSGMGASPDGVAKYLSENADKL

SEQ ID NO: 73773 - protein, 769 aa, Chlamydomonas reinhardtii
MAFASSSMAALSRPLAAVSSGLGSALSRASQLLTSGSLSSSPTASHSSTRRFISDGTVGSKGRPDSLFLSDISGRPNATANDYYNKAMVKRQVFADHKVDVLGVVINGLPREHHAILSSQLRDKLERAGLPFAGALPEDPVLSSVRPPPPALDKPSPGLTCVSSCAPSHRYPPTLPPLGLGLLLCPCPVPARLQLIASGKQSEVLDRIYAAYMAYKAGGELDLCLVEGPGPLMGGTELDAQVVVGSQRLEELLETLVERPMGRPLVVTSADRLDIVLGLLAAQLSVRGPSVAGVLLTQAGASRITRSYAKSAVDNIFAGLSNNTGASGGGPDGAAAANGSAQGSLYRGALLPVLSTDKHLAEALAVIGRMDASILPTSIRKVTQCKVAGAAVMLFDKYIDANAVVTGLQKSRPTRVTPKMFQHTMKAMCRASPQHIVLPESVDKRVLAAAADVTARGLARVTLLGDPTTVQQEPPPSPSTPAAMAAPASASSDRFDKYVDMLVEARKKKGMTREAAADTLHGDINFFGTMMVAAGDADGMVSGAIHTTASTIRPALQMLKNPASSLVSSIFFMCLPDRVLVYGDCAVNVSPSAADLAAIATTSADTAAAFGIEPRVAMLSYSTLGSGAGPDVQKVTEAVALVKQQRQDIKVEGPIQYDAAIDPAVAAVKVKGGSEVAGRATVFVFPDLNTGNNTYKAVQQSTGAIAMGPVMQVCVRVSAGVGGLLKPVNDLSRGCTVPDIVNTICVTSIQAMQFKQRTQAAVAAAAAPK

SEQ ID NO: 73774 - protein, 212 aa, Nostoc punctiforme PCC 73102
MALRLGDTVPNFTQASTHGDIDFYQWAGDSWVVLFSHPADFTPVCTTELGTVAKLKPEFDKRNVKAIALSVDDVESHKGWVGDIEETQSTTLNYPILADADRKVADLYDMIHPNANAAVTVRSVFVIDPNKKLRLSFTYPPSTGRNFDELLRVIDSLQLTDNYSVATPADWKDGEDVVIVPSLKDPEVLKEKFPKGYEEIKPYLRMTPQPNK

SEQ ID NO: 73775 - protein, 837 aa, Chromobacterium violaceum ATCC 12472
MGTIAPRLDVLAPLSGWLVPLDSVPDPVFAGKMVGDGISLDPTSGSLLAPVSGVVSNLHSAHHALTITTSEGVEVMVHIGIDTVMLKGEGFFPLVEQGQQVSAGQPVIDFDLDLVGRKAASLLTQIIVTNGDETVSKMKLSDGLVAAGKDIVLSLQLANGKAVLQVEASEPQLSADIVIGNPAGLHARPAAVFASKAKSFASDIQLILGDKEANAKSVVAIMGLATKLGDAVRVRAAGADAAAAIAELTQLLNDRCGEKADEAPIAPAAPVFAQQQDSDTQLAGVGASPGIAIGRIVHHRLQEFDVPEQGKGANVEQQAFARATEEASAQLDLVKAQLTDPAKQAILSMHQELLQDPDLLAQTYTGLADGKSAAWSWRAAFSAYSARLEAQDNALLRERANDIRDVGRRVLALLAGVKQAALELPAGSILIAEDLAPSDTASLDPSKVMGFCTRTGGATSHVAILARSLGIPAICGISQSALKLPEGLQVILNGNEGTLAIAPTTEDLAAAEQEIARLAERRAAEAKSSMQPAATSDGARIDVVANIRNAADAREAVAKGAEGVGLLRSEFLFDNRDTAPTEAEQAAEYCAVAEALGKDRPLVVRTLDVGGDKPLSYLPLPKEDNPFLGLRGIRVSLDRPDLLRTQLRAILRAAPLTQLHIMFPMVASLEELRAAKAVLAEEQAAAGASNVKVGIMVEVPSAAVLAARFAPEVDFFSIGTNDLTQYVLAMDRGHPQLAKQADALHPGVLAMIALTCEGARAHGKWVGVCGGLASDERAAPLLVGMGVTELSVSTPAVASVKATLARWSMDECRQLAKDVLALSTVTDVRHHLNQHAR

SEQ ID NO: 73776 - protein, 478 aa, Metasequoia glyptostroboides
VEKKAGRIAQIIGPVLDVSFPPGNMPRIYNSLIVKDNDTTGQPISVTCEVQQLLGNNKVRAVAMSATDGLMRGMRVIDTGGPLSVPVGETTLGRIFNVLGEPVDNLGPVDALTTSPIHRSAPAFTQLDTKFSIFETGIKVVDLLAPYRRGGKIGLFGGAGVGKTVLIMELINNIAKAHGGVSVFGGVGERTREGNDLYKEMKESGVINEQNISESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPSIVGEEHYETAQGVKQTLQRYKELQDIIAILGLDELSEDDRLIVARARKIERFLSQPFFVAEVFTGSPGKYVSLIETIRGFQMILSGELDGLPEQSFYLVGNIDEATAKAMNLKEI

SEQ ID NO: 73777 - protein, 518 aa, Clostridium tetani E88
MSILSVENLTHGFGDRAIFNDVSFNLLKGEHIGLVGANGEGKSSFMNIITGNLEPDEGVIEWSKRVRVGYLDQHTVLKSGTTIREFLKTAFKYLFDLEKEMNEICDKMGTANSDELELLLEDMGTIQDILTNNDFYIIDAKIDEVARGMGIADIGLDKDVQDLSGGQRTKILLAKLLLEKPDILLLDEPTNYLDEQHIEWLKRYLQDYENAFILISHDIPFLNSVINLIYHMENGELNRYVGNYDDFLKVYEAKKQQLEAAYKKQQQEIQELKDFVSRNKARVSTRNMAMSRQKKLDKMDLIELPKDKPKPEFNFKEGRTSGKMLFETKDLVIGYNEALSKPLNLHMERGEKIALVGANGLGKTTLLKSILGEIKPISGHATLGDYLNIGYFEQEIKKANYNTCIEEVWSEFPSFTQYEVRAALAKCGLTTKHIESKVLVLSGGEQAKVRLCKLINKETNFLVLDEPTNHLDVDAKEELKRAIKAYKGSVLLICHEPEFYQDIVTDVWNCENWTTKIV

SEQ ID NO: 73778 - protein, 325 aa, Triticum aestivum
MARSALDEVTDTGAFDRTPSTFRSFVFRDASARFPAVAGRYHLYVSYACPWASRCLAYLKLKGLDHAISFSSVKPIFERTRESDDHLGWVFPATADEVPGAGPDPFNGAKSVRDLYEIASTNYTGKPTVPVLWDKQLKTVVNNESSEIIRMLNAEFNDIAENPGLDLNPAHLQVSIDEVNGLVYDAINNGVYKCGFAKKQGPYDEAVTTLYEALDKCEEILGKQRYMCGNQLTEADVRLFVTLIRFDEVYAVHFKCNKKLLREYPNLFNYTKDIYQIPGINSTVNMEHIRKHYYGSHPSINPYGIIPQGPNIDYNAPHDRERLFL

SEQ ID NO: 73779 - protein, 97 aa, Populus trichocarpa
MASGGAAAGGGGKVSFKVTLTSDPKLPFKVFSVPEAAPFTAVLKFAAEEFKVPPQTSAIITNDGVGINPQQSAGNVFLKHGSELRLIPRDRVGASEC

SEQ ID NO: 73780 - protein, 288 aa, Lactobacillus johnsonii NCC 533
MKLKDFQEKYTPQIDNFLKEHLVTEIDNPTFSKIMSYSVMAGGKRLRPLLFLATLETLNHKIEEPELRIACGIELIHTYSLIHDDLPAMDNDDYRRGKLTSHKKWGEAEAILAGDGLLPLGIQWITEGSNSAALAIVISQAVGPNGMVGGQYLDIDTTNNDSAKENAKMIDQMEWLKTGCLIEASVKMAAIYAGATDSELNRLDNFSKRFGRSYQIYDDLVDVVETATEAGKATHKDATEGKNNTLTLLGIEDSRKQLVEMIESGRKAIEVFEQPLLGEFFNLYQKVL

SEQ ID NO: 73781 - protein, 117 aa, Glycine max
  misc_feature (37)..(37): Xaa can be any naturally occurring amino acid
  misc_feature (81)..(81): Xaa can be any naturally occurring amino acid
MASSMIFSPADTTVNRAGAGMAGPFTGLKYMAGFPTXRKTNNDLTWIARHGGKRPCMHVWPTIGKKKFETLSYLPDLDDAXLAKEGQYPLKKGWDPLLGITLEHRFAYPEHKKAPGY

SEQ ID NO: 73782 - protein, 141 aa, Zea mays
  misc_feature (55)..(55): Xaa can be any naturally occurring amino acid
  misc_feature (108)..(108): Xaa can be any naturally occurring amino acid
PAYFLDLTAKCDKPLPLVGAMLPATAMSADATVNLYNDGETVMDPQSVNRDAMVXTNYTGLDGRDDTKTNTNAAQTFHTTKFAPLGYIHNAKGNYQCSPHRKHTRDTXLDVSKLNELPKVGIVYNYDNDSDAPTKVLIDEG

SEQ ID NO: 73783 - protein, 339 aa, Streptococcus pneumoniae TIGR4
MKAVVVNPESTGVAIEEKVLRPLETGEALVEVEYCGVCHTDLHVAHGDFGQVPGRVLGHEGIGIVKEIAPDVKSLKVGDRVSVAWFFEGCGTCEYCTTGRETLCRTVKNAGYSVDGGMAEQCIVTADYAVKVPDGLDPAQASSITCAGVTTYKAIKEAKVEPGQWVVLYGAGGLGNLAVQYAKKVFNAHVIAVDINNDKLALAKEVGADIVINGLEVEDVAGLIKEKTDGGAHSAVVTAVSKVAFNQAVDSIRAGGRVVAVGLPSEMMELSIVKTVLDGIQVIGSLVGTRKDLEEAFQFGAEGLVVPVVQKRPVEDAVAIFDEMEKGQIQGRMVLDFTH

SEQ ID NO: 73784 - protein, 334 aa, Arabidopsis thaliana
MSIPMELMSIRNPNSTLLYRAHSRPPVKLCAPPRSLLPSRRHFSAPRAVVSYPGIRFGFTSPEVLLNRSVVAFAASHEDSGESGVEVGKEKSDIDVEDDTSKEAWKQTLESFKEQVSKMQSVSSEAYSVNSQKAMTVLKETSEQLRIQAEKAKEELGTKAKVVSEEGREYILKAAEESPSDVKEIVEAFASTEDLKNVSRANDFHVGIPYGLLLLVGGFINFMVSGSIPAIRFGVILGGALFALSLASLKSHRKGESSTKFLKGQMAIVAIIFLRELRLLLSQKSTFLGFFTTLTSGGVLGFYLYKMVVKREKGPTLEDGGEDESSDGFVRSEG

SEQ ID NO: 73785 - protein, 396 aa, Mesorhizobium loti MAFF303099
MAGFTHLFIPGPTNIPEQVRQAMNLPMEDMRAASFPDLTLPLFEDIKRVFKNETGRVFIYPSSGTGAWEAAMTNVLSPGDRVLMSRFGQFSHLWVDMAERLGLEVDVIDCEWGTGVPLELYAERLKADKEHRIKAVFCTQNETATGVTSDVAGCRAALDDANHPALLFVDGVSSIGSIDFRQEEWGVDCAVSGSQKGFMLPAGLGFLSVSKKALVASRTATHRRCFFSFEDMIRANDAGYFPYTPATQLLRGLRASLDLIAEEGLDNIFARHHRLAEGVRKAVDAWGLKLCAKAPKWHSDTVSAIQVPEGIDSGDIVKRAYRTYQTSLGGGLNKVMGKVFRIGHLGWLNEVMVLASLSAAEMALLDCGVRLAPGSGVGAAIQHFRASAAVPVAEAA

SEQ ID NO: 73786 - protein, 761 aa, Rhizobium leguminosarum bv. viciae 3841
MPDIDKKDRPVTSVTDQEALDFHAMGRPGKLEINPTKPMATQRDLSLAYSPGVAVPVKAIAADPQTAYDYTARGNMVAVISNGTAILGLGNLGALASKPVMEGKAVLFKRFADVDSIDLEIDTENVDEFINCVRFLGPSFGGINLEDIKAPDCFVIESRLRELMDIPVFHDDQHGTAIIAAAGLINALELTGRDLKTTKLVCNGAGAAAIACVELIKAMGFAPENVILCDTKGVIYQGRTEGMNQWKSAHAAKTDTRTLEEAMKGADVVFGLSQKGAFSAKMIRSMAERPIIFAMANPDPEITPEEVARIRDDAIMATGRSDYPNQVNNVLGFPYIFRGALDVRASTINDAMKIAAVNALANLAREDVPDDVVAAYQGNRPRFGSQYIIPVPFDPRLISAIPVAVAQAAIESGVARKVITDMAGYARELSARRDPIASTLASLYERVRRRPKRIVFAEAEEEQVLRAAMSYANQQLGTAILLGREDLIRATAERAGIDLNRPGLEIVNARLSTRVEAYIDYLYARLQRHGYLHRDAQRLIHNDRNHFAATMVALGDADGMVTGITRNYSTALEDVRRCIDEKPGHRVIGVSLALCRGRTVFVADTAVHDMPTAEELADIAEEAAGLARRMGYPPRVAMLAYSTFGHPSGERSERVREAVKILDKRRVDFEYDGEMAADVALNRKVMEQYPFCRLSGPANVLVMPAFHSASISTKMLQELGGSTVIGPILVGLDKPVQITSMGAKDSDIVNMAAIAAYGAGS

SEQ ID NO: 73787 - protein, 207 aa, Rhodopirellula baltica SH 1
MTVRAFVLSLVGIATFGLTAGPASSTSAADPAKGEVTHKVYFDVSIGSEPAGRIVLGLFGKDVPKTAENFRALSTGEKGEGKLGVPLDFEGSAFHRVIPGFMLQGGDFTAGNGTGGESIYGMKFADENFKFQHTTPGLLSMANSGRNTNGSQFFITVAPTPWLDGKHVVFGRVIEGMDVVKKIEAQGSGSGQTRKLIKITEAGEVKE

SEQ ID NO: 73788 - protein, 308 aa, Helicobacter pylori
MSLKIKNILLSGGSGKRLWPLSRSLYPKQFLKLFDHKSLFELSFKRNASLVDETLIVCNEKHYFLALEEIKNEIKNKSVGFLLESLSKNTANAIALSALMSDKEDLLIVTPSDHLIKDLQAYENAIKKAIDLAQKGFLVTFGVSIDKPNTEFGYIESPNGLDVKRFIEKPSLDKAIEFQKSGGFYFNSGMFVFQAGVFLDELKKHAPTILKGCERAFESLENAYFFEKKIARLSEKSMQDLEDMSIDIALMQQSHKIKMVELNAKWSDLGNFNALFEEAANEPKENVSLNQTPVFAKESEEGHHHHHH

SEQ ID NO: 73789 - protein, 256 aa, Myxococcus xanthus DK 1622
MATARRRKIVAGNWKMNKSVPEALALVRDLRGQVASLGDTVEVVVAPPFVALQPLHVALEGAPLALAAQNCHWESSGAFTGEISAPMLAELGCAYVIVGHSERRQLFGDTDEQVNKRAKAVRAAGMTPIICVGETLAEREANQTLAVVERQVRGALEGFGAKEVAGFVLAYEPVWAIGTGRNATAAQAQEVHAAIRGLVERLYDGETAGRVRIQYGGSVKPDNAAELLGQPDVDGALVGGASLKAGDFAAIVKAAT

SEQ ID NO: 73790 - protein, 394 aa, Mesorhizobium loti MAFF303099
MDIHEYQAKELLARHGVHVPRGGLAYSPEQATYRAREIGGGKWVLKAQVHSGARGKAGGIKLCANDEEISSAAEAMLGRKLVTQQTGPRGKLISRLYLEEAVDIAQELYVGFVLDRKEERVMIVASAAGGMEIEDIVEKEPNSILRTSVDPGVGMQRFQAREIAFGLGLDHNLIGKATETIFSCYQVFRDYDASMLEINPLVVTRDGNLIALDAKMSFDENALFRRPEISELRDKSQEDPRETFASDRGLSYVGLDGNIGCIINGAGLAMATMDMIKIAGGEPANFLDIGGGASPERVAKSFRAVLGDKNVETILVNIFAGINRCDWVAEGVIKAIREVGVNVPLVVRLSGTKAEEGRRILADSGEAVIVADTLAEAAEKAVAAWRAAAKKKAA

SEQ ID NO: 73791 - protein, 327 aa, Clostridium perfringens str. 13
MKKIAVIFNGGTISMKVDDRIKAAVPSLTGEEIMAMVTGIESFATIESHSFSSLPSPHITPEIMLELSKFINALVEREDIDGVVVTHGTDTLEETSYFVNLTTKTSKPIVFTGAMRSGSELGYDGPANLAASICTAASDEAKNRGVLVCFNGELNSASEVTKANSMALNAFRTPNFGPIGIVDNNRVIFDRRVPQEDFIPLEVIDKKVAIIKCAAGMDGDFIYHCIEKKYDGIIIEALGRGNVPPTMVDAIKDALDKGIVIVLTSRCFEGRVSDSYGYLGGGKNLKELGVIFGESMPSQKARIKLLTLLGFNKDYRYIKHSFEKERY

SEQ ID NO: 73792 - protein, 499 aa, Ralstonia eutropha JMP134
MDTRTELLSAATRAFLQRPKRMLIDGQWCAATDGAVFTTEDPASETTLAEVPAAGPADVDAAVQAARAAFEQGPWNAMRPSDRERLLLRLADLVEANAEELAQIEALDNGKPATMARAIDVAGAAGFLRYMAGWATKLHGESLDVSVPLVREREFVAFTRQEAVGVVGAIIPWNFPLLMAAWKLGPALACGCTVVLKPAEETPLSALRLGELVMEAGYPAGVVNIVTGDGARCGAALAGHPQVDKIAFTGSTEVGKLVGGAAMERLARVTLELGGKSPVIMLDDMSPEAAATGAAQAIFFNQGQVCTAGSRLYLPRSKFDATVQALADIANSLRLGPGLEPDTGMGPLVSRRQHKRVAGYVQAGVDAGAQLICGGNADLPRGHFFKPTVLARAPETSSVVQEEIFGPVVVALPYDDIDEVVGRANGTPFGLAASVWSNDLSRVHRLVPRIKAGTVWVNCHNLLDNAMPFGGFKQSGLGREMGRAVFDHYTETKSVMIAV

SEQ ID NO: 73793 - protein, 331 aa, Clostridium perfringens str. 13
MSKVAFLGAGSFGTSLGILLGNKGVTVSLWDRDENVINDINVNRKNDKYIKDLTIPTNVTAYKDLDEALNGAEYVVLAVPSHVIRTACKNLKGKINDDVIIINIAKGIEEGTNLRLSQVINQELPNNKVVVLSGPSHAEEVSKGIPTTLVASSECMECAEKVQDLFMDKNFRIYTNDDIIGVEIGGAVKNIIALAAGVCDGIGYGDNSKAALMTRGMAEIARIGIKMGGKAETFFGLTGMGDLIVTCTSMHSRNRRAGILIGQGKTAEEAIEEVGMVVEGIKACKAFYELKEKEGVTMPITDIAYKVLFEGAKAENAVSLLMERDKKKEEI

SEQ ID NO: 73794 - protein, 297 aa, Escherichia coli
ETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLP

SEQ ID NO: 73795 - protein, 277 aa, Photobacterium sp. SKA34
MAYSHLLPDVVEIARASGQLILDIYQRGQFEKQIKDDNTPVTSADLAAHKLVMERLTQLTPDIPVLSEEDASVPLTERSQWKRYWLVDPLDGTQEFIAGSGDFATIIALVEGNRPIMGVVYAPVSGVSYYAYAGKGAYKITAEGESVKIATHHHEENTKSIVVAISRRQDISSITSRLDPSYNYELVPLGSAALKSCLVAEGAVDCYLRLGPTGEWDTAATQCIVEEAGGRILNTHLTPLSYNERNTLENPNFITLGDEGLPWADILEPDDRMMNAD

SEQ ID NO: 73796 - protein, 146 aa, Triticum aestivum
  misc_feature (2)..(2): Xaa can be any naturally occurring amino acid
  misc_feature (33)..(33): Xaa can be any naturally occurring amino acid
  misc_feature (41)..(42): Xaa can be any naturally occurring amino acid
  misc_feature (70)..(70): Xaa can be any naturally occurring amino acid
  misc_feature (95)..(95): Xaa can be any naturally occurring amino acid
MXPTVMASSVTSVAPFQGLKSTAGLPVSRRSNXASLGSVSXXVGRIRCMQVWPIEGIKKFETLSYLPPLXTEALLKQVDYLIRLQSGCPCLEVQXGWGSSSREHNAIPPGVLRIGPGTWTVKPGNCGIATRTAQRQRLITEGLGRE

SEQ ID NO: 73797 - protein, 397 aa, Thermococcus zilligii
MEVGVVGKPNVGKSTFFSAATLVDVDIANYPFTTIEANVGVTYAIADHPCKELGCRPNPQNYEYKDGTALIPVKMIDVAGLVPGAHEGRGLGNKFLDDLRMASALIHVIDATGKTDAEGQPTDHHDPVEDIEFLEREIDYWMLGILKKGWEKFAKRIKLQHMKLEQAIADHLSGIGVKEEDVWEAIHRLGLGDDPTKWTDDELFALVRELRKINKPMIIAANKADAASDEQIERLKKEGEKRGYLVIPTSAAAELTLRKAARAGFIDYIPGSSDFRILKEMNPQQEKALQLIKERVLERFGSTGVQEVINRAVFELLKLIPVYPVQDENKLTDQFGNVLPHVYLLPKGSTPRDLAYKVHTDLGRTFLYAVNARTHRRVGDDYKLEFNDIIKIVATAK

SEQ ID NO: 73798 - protein, 410 aa, Streptococcus pneumoniae
MKIAVAGTGYVGLSIAVLLAQHHEIKAVDIVAEKVELINQKKSPIQDDYIEKYLVEKDLNLEATMDAKYAYEDAEFVVVAAPTNYDSKKNFFDTSAVEAVIQQVKKINPKAVIIIKSTIPVGFTESVQKKYQYKNILFSPEFLRESKALYDNLYPSRIIVGTDLEDTYLKDKANIFASLLKEGAIKEDIDTLFMGVTEAEAVKLFANTYLALRVSYFNELDTYAEVKGLDAKAIIDGIGLDPRIGNHYNNPSFGYGGYCLPKDSKQLLANYFDVPQNMMTATVESNRTRKDFIAQRILEKAGVSETDSLDAFKNIQDIVIGIYRLTMKSNSDNFRHSSIQGVMKRLKAKGVTVIIYEPTLKDGETFFGNKVVNTLDKFKEASNVIVANRFEPSLEDVSNKVYSRDIFKRD

SEQ ID NO: 73799 - protein, 542 aa, Glycine max
MAVSTSFPGAKLEALLLKCGSSNAATATATTTTHLSCFCKTRKTLVQSQRGPIRCEASSASDVVADATKKAASVSALEQLKTSAADRYTKERSSVMVIGLSVHSTPVEMREKLAIPEAEWPRAIAELCSLNHIEEAAVLSTCNRMEIYVVALSKHRGVKEVTEWMSKTSGIPVADLCQHQFLLYNKDATQHLFEVSAGLDSLVLGEGQILAQVKQVVKVGQGVNGFGRNISGLFKHAITVGKRVRTETNIAAGAVSVSSAAVELALMKLPEASHANARMLVIGAGKMGKLVIKHLVAKGCTKMVVVNRSEERVAAIREEIKDVEIIYKPLSEMLTCIGEADVVFTSTASENPLFLKDDVKELPPATDEVGGRRLFVDISVPRNVGSCLSDLESVRVYNVDDLKEVVAANKEDRLRKAMEAQAIIGEESKQFEAWRDSLETVPTIKKLRAYAERIRLAELEKCLGKMGDDINKKTQRAVDDLSRGIVNKLLHGPMQHLRCDGSDSRTLSETLENMHALNRMFNLETEISVLEQKIRAKVEQKP

SEQ ID NO: 73800 - protein, 436 aa, Leptospira interrogans serovar Lai str. 56601
MKVCVIGSGYVGLVAGACFAEYGNHVICVDKDETKIANLKKGIIPIYEPGLSELVLNNWKEKRLEFTVSLKEGVEKSDIIFIAVGTPTLPDGSSDLSAVFAVAKEIGKSINGYKVIVDKSTVPVGTAAKVKTIIANETKEEFDVVSNPEFLKEGAAIEDFMRPERVVIGSETQKAGDLIAQLYAPFVLNGNPILRMGVVSAELTKYACNAFLATKISFANEIANLCEAVGGNYEDVRKGMGTDSRIGRQFLYAGIGYGGSCFPKDVRALIKTSEDEGAPLQIIRKVEEVNESQKLRLYEKIIKFYGESGLSGKTFAVWGLSFKPGTDDMREAPSIPLLLKLHDKNVKLRVYDPVSKETSSIYFEGKVEYSVDAYSALKGADALLLLTEWREFREPDFLKIKGLLKNKVIFDGRNQYSPDLMKKEGFQYFSIGKPNV

SEQ ID NO: 73801 - protein, 556 aa, Streptococcus pyogenes M1 GAS
MYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVAIAIAEEITGSISILALGDYVRYVSQEQATQALAALETIYDSGKSMSRFATDLLTYLRDLLVVKAGGDNQRQSAVFDTNLSLSIDRIFQMITVVTSHLPEIKKGTHPRIYAEMMTIQLAQKEQILSQVNLSGELISEIETLKNELAQLKQQLSQLQSRPDSLARSDKTKPKTTSYRVDRVTILKIMEETVRNSQQSRQYLDALKNAWNEILDNISAQDRALLMGSEPVLANSENAILAFEAAFNAEQVMSRNNLNDMFGNIMSKAAGFSPNILAVPRTDFQHIRKEFAQQMKSQKDSVQEEQEVALDIPEGFDFLLDKINTIDD

SEQ ID NO: 73802 - protein, 262 aa, Chromobacterium violaceum ATCC 12472
MAAIPGQARRRRREQGVNMDKTTHFGYKTVAESEKAGKVAEVFHSVASKYDVMNDLMSGGLHRVWKHFTLTTSGVRAGDKVLDIAGGTGDLSRGWAKRVGKTGEVWLTDINSSMLTVGRDRLLDEGVILPVSLADAEKLPFPDNYFDAVSVAFGLRNMTHKDAALKEMCRVLKPGGKLFVLEFSKVWKPLSPFYDFYSFKALPIMGKLVANDADSYQYLAESIRMHPDQETLKQMMLDAGFGKVDYHNLTGGVVALHKGVKF

SEQ ID NO: 73803 - protein, 158 aa, Erwinia carotovora subsp. atroseptica SCRI1043
MNVIEGVVATPDARVAIAIARFNHFINDSLLQGAIDALKRIGQVKDENITVVWVPGAYELPLAVRALTKSAKNGGYDAVIALGTVIRGGTAHFEFVAGECSSGLSSVAMDSEIPVAFGVLTTESIEQAIERAGTKAGNKGAEAALTALEMINVLKAIK

SEQ ID NO: 73804 - protein, 201 aa, Zea mays
MSSSRVLLVSAVLVALVTLSSCRSLGELSEQKTYSSAPSYGGSPTPTYGSGEGHEPTPTPSHHGTTPTPSYGTTPSTPAHGVPEIPKHGFVGSCDYWKSHPDMIIAVVGSLGNIGKTFGAACSLLVGKKLENLHEALSNTRTDGVGALLREGSAAFLNSIVNKKFPFTTQQVKDCIAVSVTSDDAASAQAGIFKKANEYHY

SEQ ID NO: 73805 - protein, 450 aa, Xanthomonas oryzae pv. oryzae KACC10331
MTDLRLYGEGLVRNRLGRLPLHRSAAHGGLVMTATTLGATPLSGPILRARRRHVNPAGYNGPMNSPVPVVRLKNAWRSSHPWIFQKLVEKPAAKPKPGTIVDVVGVDGEWIGRGFYNGHSRIAVRILETDQSVPVDAGWFARKIAAAVSLRRDWLKLDGVSDAWRVVHSEGDGLSGLVVDRYGDLVVVEFFAAGMFRHREWIYDALREQFPGCRFHSFADEHVQKQESFDFHSNTTTEAAVITEHGIKFRADPAGAHKTGFFADQRDNRQWLSEQVEGKTVLDLCCNTGGFAVYAAARGASEVLGVDIDEDVIAIAKGNAKLNNVRPKFVQADIFPWLRDASNRGEQFDVVILDPAKMTRDREQVIPALKKYLDMNKLALGVVKPGGLFATFSCTGLVAEQEFLDMLRRASYFSGRTIQILKVAGAGPDHPFMAHVQESRYLKAVFCRVV

SEQ ID NO: 73806 - protein, 356 aa, Glycine max
MEVTAAPVPYVQEIAKEALTIVPERYVRPVHERPILSNSTPLPEIPVIDLSKLLSQDHKEHELDRLHYACKEWGFFQLINHGVDSSLVEKVKRGAQGLFDLPMEEKKKFGQREGEAEGYGQLFVVSEEQKLEWADLFFMFTLPPNKRKPHLFPNLPLPFRGDLDAYCEELRKLAIQILDQMANSLAIDPMEIRELFGEAEQSMRMNYYPPCPQPELVMGLNPHSDGGGLTILLQANEVEGLQIRKDGLWIPVKPLPNAFIINLGDMLEVMSNGIYQSIEHRATVNSEKERLSIATFYSTAIDAIICPAPSLVTPKTPAMFKPISAGDYFKGYLAQELRGKSFLDTIRIHAENENSS

SEQ ID NO: 73807 - protein, 468 aa, Chlamydomonas reinhardtii
FWALSGKFMPMVGLFFMLAFVNTILDSLKDTLVITAAGGGAQVIPYLTVYAVLPSSLVFLLAYSYASQRFRRQTLFNGIVAVFMTFFAGFALWLYPNHHLLHPTSWAEGAAASLPLGLDGLVGMVRNWTFTLFFCMSELWGDVCLGLLFWGLANDTTSLADAPTLYPLFGLGANLGFAVGGHTPNCRAPHTPARARCPAQFFSGPASHGGSFTWEVQSLMAVVMVFSLPKDAASTRPKKSKQSMGEIYRTLASSVPIRCLVVMSMAQGLCTNLMEFAWKSHIRLLYPTPAEFTSFLGDVSTWQGIVTGLLMVLSPTMFERLGWAGVAAATPQILLYGGGAFFAFVMAPAAAAATASGAAAAAAASAAVLQLLVYGGALLYVFSKSAKFSLFKPAEEMVYISLDEEGRTKGKAAIDVVGSQAGKSGGSVLQQVLLLLCGGAIAGQLPIMVAVYLAMSNGWLGAVGALSR

SEQ ID NO: 73808 - protein, 655 aa, Chlamydomonas reinhardtii
MSPALFNPYVAPNRIAPGPRCRMLQRGAAGRGTARGVAATTHAARPYVPRWSRAAAARVVRAAAPSPPPAQDTARGTEAAGEAVFQSSSKKKRRNAVKPPLSRGPLLSLSALFGRGGGQQQQGPTPEVRVPLNNVGKVPIFQLLYELYSSHGGVFRMRLGPKSFLVLSDPGAVRQVLVGAVDKYSKGILAEILEFVMGNGLLAADGEHWIARRRVVAPALQRKFVSSQVALFGAATAHGLPQLEAAAAAAAAAAGDSRGGGAASVDMESFFSRLSLDIIGKSVFDYDFDSLRHDDPVIQAVYSVLRESTVRSTAPFPYWKLPGISLLVPRLRESDAALAIVNDTLDRLIARCKSMVGRCCGGGGGGGGGSSAPTVLHFLLGSGEALNSRQLRDDLMTLLIAGHETTAAALTWALHLLVAHPEVMKRVRDEVDWVLGDRLPGSDDLPLLRYTTRVVNEALRLYPQPPVLIRRAMQDDVLPGGHVVAAGTDLFISVWNLHHSPQLWERPEAFDPDRFGPLDSPPPTEFSTDFRFLPFGGGRRKCVGDMFAIAECVVALAVVLRRYDFAPDTSFGPVGFKSGATINTSNGLHMLISRRDLTGVPPPAPRAPAAAAGAAAGSCPHAAAAAATAAAAAAVGCPHAAAAATSGAPAGVTPQ

SEQ ID NO: 73809 - protein, 102 aa, Glycine max
  misc_feature (80)..(80): Xaa can be any naturally occurring amino acid
SNISSTVHLQPAVLYDAGCTNLKSMAVFPTRKTNNYITSIASNCGRVQCMQVWPPIVKKNFETLSYLPDLYDAQFAYEVXYLLMKVCIPFLEFVLEHIFLFP

SEQ ID NO: 73810 - protein, 386 aa, Zea mays
MSLCALRFPRVPIYQLRSTPRLRHLFFPTQYIRSFSALDKPTAMDKAPGQESKGSITDWVKPGDKSGEFKRQTSVFRNWIENKPNAEFPPEKGRYHLYVSYACPWAHRTLIVRQLKGLEDIISYNSVHWHMAEKGWRFASSDERIPGNTTPDPLHQDYTHLRDIYFEQNPDYEGRFTVPTLYDKKTNKIVSNESAEIIRMMYTAFDDIIEEKYKKVDLFPKDLQKDIEEMNEWVYNDVNNGVYKSGFATTEEAYTKAVTQLFKSLDRLEESLSQSKTPYLLSAPHVTEADVRLFTTIIRFDPVYVQHFKCNIRDIRSGYPHIHKWLRHLYWDYPAFKDTTNFEHIKKHYTKSHGQINKFQITPIGPLPDILNKEDEVPSVKAALAK

SEQ ID NO: 73811 - protein, 154 aa, Zea mays
MTASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGA

SEQ ID NO: 73812 - protein, 410 aa, Arabidopsis thaliana
  misc_feature (337)..(337): Xaa can be any naturally occurring amino acid
  misc_feature (373)..(373): Xaa can be any naturally occurring amino acid
  misc_feature (385)..(385): Xaa can be any naturally occurring amino acid
MGSVSLKIGDGTARFRRTSICSSAVNLLMLFSVVTTNLFALYAFSSHSQANSPLLHSSNNISLVSQHLSLILREIDSSQRKLAQMEKQMLGYESIDISRPNIVPELKLFLQRHQLPLGKDSRTGITEMVSSVGHSCEKSTDLLSQYMSYKVFDRCPDDWSLGQKLILRACEPLPRRRCLAKTVQKQDLSKSPDSLWRSVSNKSVNWSGLGCKSFDCLKGKKLSKECVGCFDLGVEKDRFVKVKGKNDFLIDDVLGLGSGKIRIGFDISGGSGTFAARMAEKNVTVITNTLNNGAPFSEFIAARGLFPLFLSLDHRFPFLDNVFDLIHASSGLDVEGXAEKLEFLMFDLDRVLKPRGLFWLDNFYCANDEKKKXLTRMIERFGYKXLKWVIGEKADAQVYLSAVLQKPVRA

SEQ ID NO: 73813 - protein, 297 aa, Escherichia coli
ETIDEGLWDTLSARLDFCNLDVNDTAAFNRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLP

SEQ ID NO: 73814 - protein, 89 aa, Zea mays
MAPVQCARSQRVFHFGKGKSEGNKTMKELLGGKGANLAEMASIGLSVPPGFTVSTEACQQYQDAGCALPAGLWAEIVDGLQWVEEYMGA

SEQ ID NO: 73815 - protein, 456 aa, Xanthomonas campestris pv. campestris str. ATCC 33913
MSARYDYDVVVLGGGSGGLAAAFRAAKHGARVAIMEPGELGGTCVNLGCVPKKAMWLAADLASKIELAGALGFDVVRPTLTWQELVTHRQGYIGNIHASYRRRLDDDGVVLIPQRGVLQDRHTLMGADGVPVTAEHIVIATGAHPLRPHVEGAEHGHVSDDFFNLCHAPDHVAIVGGGYIAVEIAGLLQALGSRVHLFVQGERLLERFDAELTLQLADNLRHLGVRLHFGFRTTGVQRDDTGKLRMRGHSAHPGELGNDVFDQVFFAIGRRANTAGLGLEALGVELGKKGEIVVDDGQTTNVPNIHAVGDVDGKVGLTPVAIAAGRKLMDRLFGGQPDARMDYDNVPSVVFSHPPLGAVGLTEEQARERYDGAVRVYRSNFRPMLHALADAPQRSVFKLVCVGEEERVVGVHLLGESADEMLQGFAVAVKMGATKRDFDETVAIHPTSSEEIVLMH

SEQ ID NO: 73816 - protein, 460 aa, Arabidopsis thaliana
MVRSDENSLGLIGSMSLQGTLNRSILLLKIKTFVLFDFSPKLILNLLDVGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 73817 - protein, 423 aa, Brucella melitensis 16M
MRKEMLLPNLSISYSDPIKFVRGDGVWLIDNRGRAYLDCFNNVCHLGHAHPEVVEAIARQAAILNTNTRYLHDTIVSYAERLTATLPEGLTVASFACSGSEANSLALRMARTHSGQRDALVLDWAYHGTTQELIDLSPYKYKRKGGKGRPDHVFEATIPDSYRAPESWPLAEHGRRFAESIAEQIEKMKAQGRAPAFFIAESIPSVAGQVFLPEGYLREVYAMVRAAGGVCIADEVQVGFGRVGSHWWAFEMQGVVPDIVTMGKPIGNGHPMSAVVTTREVADSFNNGMEYFNTFGGNPVSCAAGLAVLDVIEHNDLRRNALEIGNYLIAGFRSMQDRFDIIGDVRGQGLFLGIELVMDRKTKEPATAIARKINDGARERGILMGTEGPFDNVLKMRPPMIFTRANADHLLSVLEDSFAAALK

SEQ ID NO: 73818 - protein, 248 aa, Physcomitrella patens subsp. patens
NTVRVTNVSVKATAHDIHDFFSFSGEIENIELHRDGDTQIALVTFKEAQALDTALLLSGATVVDRAVNITPLEDELSPSINSIPRDKAFGNDGGFAGPSSHTPNQAVDVISTMLAKGFILGKDAVSKAKEFDAKHDLSASAKSSVVNFDKNIGISEKLSTGTAVVNKQMKAVDEKYQVSQKTRAALAVAEENVKTAGSALMKNRYILTGASWVTGAFSRVQKVAAEVSQKTIEKAHTMETDHNSGRVE

SEQ ID NO: 73819 - protein, 759 aa, Azotobacter vinelandii
MLNTLRKIVQEVNSAKDLKTALGIIVRRVKEAMGSQVCSVYLLDPETNRFVLMATDGLNKRSIGKVSMASNEGLVGLVGTREEPLNLENAAAHPRYRYFAETGEERYASFLGAPIIHHRRVMGVLVVQQKERREFDEGEEAFLVTMSAQLAGVIAHAEATGSIRGLGRQGKGIQEARFVGVPAAPGVAVGKAVVVLPPADLDVVPDKPAEDLKAELELFGNALEAVRADIRALSAKLATQLRPEERALFDVYLMMLDDASLGCEVQRVIRTGQWAQGALRQVVNEHVKRFELMDDAYLRERASDVKDLGRRLLAYLQQARQQAMVYADNTILVSEELSSAMLGELPEGKLVGLVSVQGSGNSHVAILARAMGIPTVMGVVDLPYSKMDGIDLIVDGYHGEVYTNPSDMLRQQFADLVEEERQLTQGLDALRELPCETLDGHRLPLWVNTGLLADVARAQERGAEGVGLYRTEVPFMNNERFPSEKEQLAIYRDQLSAFYPLPVTMRTLDIGGDKSLSYFPIKESNPFLGWRGIRVTLDHPEIFLVQVRAMLKASEGLNNLRVLLPMISSIHELDEALHLIHRAWGEVRDEGTDVPMPPVGVMVEIPAAVYQTRELARLVDFLSVGSNDLTQYLLAVDRNNPRVADLYDYLHPAVLQALNKVVQDAHAEGKPVSICGEMAGDPSAAVLLMAMGFDSLSMNATNLPKVKWLLRQITLSKARELLDRLMAIDNPQVIHSTLQLALRNLGLGRVINPVASLQS

SEQ ID NO: 73820 - protein, 273 aa, Physcomitrella patens subsp. patens
METRVKALYIYPVKSCRGIAVPHASITPTGFKWDRQWLIVNANGLLLTQRAVKKLALVEAILPEEALDSRWGSISPDAALCLKAPGMEPLYVPLVPQYPLKKVENITCWEWSGTALSEGDEAAQWFTKYLGKPSSLVRFDNENVTRPTDPDFAVGHKVAFSDGFPFLLISQASLDALNKKLSVSIPIDRFRPNIFVDGCEAFAEDEWGDFKIGDFHFHGVKLCGRCTVPTINQQTGEASKEPTLTLRSFRKGSLLHIPTMENEVIIPGFVACE

SEQ ID NO: 73821 - protein, 621 aa, Erwinia carotovora subsp. atroseptica SCRI1043
MSFDTAKYPTLALVETPDELRLLPKESLPKLCDELRQYLLDSVSRSSGHFASGLGTVELTVALHYVYNTPFDHLVWDVGHQAYPHKILTGRRDRISTIRQKGGLHPFPWRDESEYDVLSVGHSSTSISAGLGMAVAAEREGKGRRTVCVIGDGAITAGMAFEAMNHAGDIKSDLLVVLNDNEMSISENVGALNNHLAQLLSGKLYASLREGGKKVLSGLPPIKELVKRTEEHLKGMVVPGTLFEELGFNYIGPVDGHDVQALSHTLKNMRSLKGPQLLHIMTKKGKGYAPAEQDPISWHAVPKFDPASGTLPKSKEGAQPTYSKIFGQWLQETAAKDSKLMAITPAMREGSGMLQFSRDYPQQYFDVAIAEQHAVTFAAGLAVGGYHPIVAIYSTFLQRAYDQVIHDVAIQSLPVLFAIDRGGIVGADGQTHQGAFDLSFLRCIPNMIIMTPSDENECRQMLHTGYHYQKGPTAVRYPRGNGTGTELTPLSELPIGKGVVRRQGKTVAILNFGTLLPEAQAVAEKLNATLVDMRFVKPLDEALLEELAQSHSTFVTLEENAVMGGAGSGVNEFLMAKRLAVSVLNIGLPDVFIPQGSQEEIRVDLGLDAAGIERRITQWME

SEQ ID NO: 73822 - protein, 303 aa, Erwinia carotovora subsp. atroseptica SCRI1043
MTDFSAQLNAHYQRTNRMLGHFITSLPFQSSPLVNAMEYGSLLGGKRLRPFLVYTTGELFDMPLESLDAPAAAVECIHAYSLIHDDLPAMDDDDLRRGQPTCHIKFGEATAILAGDALQTLAFSILADAPMTQVSDRDRLAMISELAQASGVAGMCGGQAFDLEAEGHQVNLAALERIHRHKTGALIRAAVRLGALAAGDAGRDALPYLDRYANAIGLAFQVQDDILDVVGDSATTGKRQGADQQLGKSTYPSLLGLDNARKKAQELYQESLASLDDLVASSPIPLNIAPLQALANFIVERDK

SEQ ID NO: 73823 - protein, 139 aa, Francisella tularensis subsp. novicida
DEDVFKKLNKIIDTTITPVVCIGESLDDRQSGKLKQVLATQLSLILENLSVEQLAKVVIAYEPVWAIGTGVVASLDQIQETHQFIRSLLAKVDERLAKNIKIVYGGSLKAENAKDILSLPDVDGGLIGGASLKAAEFNE

SEQ ID NO: 73824 - protein, 256 aa, Glycine max
MSQEQPRRPKGQNPIKYGDVFVVSGDLAQKPVAPEDAAMMQSAETRVLGQTQPGGAASVMQSAATRNEQAGLVGHRDVTDVTGDRGVTVTETKVPGRRIITEAVGGQVVEQYVEATPVEAGRSSAIKENAITIGEALEATAQTVGQKAVDQSDASAIQAAEVRATGSNVITPGGLAAMAQSAAAYNADCKLDQDKVKLADILAGATAKLPADKAATLQDAEGVACAEVRNNPDATATPGGVAASVAAAARLNENVK

SEQ ID NO: 73825 - protein, 358 aa, Geobacter sulfurreducens PCA
MSATRNLDALRREIDAIDDAILDLLNRRAGLVMEVGQVKTVEKRDFHVPNREREIYERLLAHNTGPFPAEAVKSVFREIISASLALEAPMKVAFLGPRATFTHLATMQHFGLAAELVAQKSIPAVFEEVEKGRALYGVVPVENSTEGMVSHTLDMFMESDLKINAEVLLEVSHDLLSRTGRLDDVKKVYSHPQALAQCRKWLDDNLPGVPVVDVASTALAAQIVSEDYAAAAIASEFAAAQYDLKVVRTRIEDQVNNFTRFLVIGRKMADRSGDDKTSLMFSVKDEPGILYRMLEPFASRGVNLSKIESRPLKKKAWEYIFYLDLAGHITDPVVAEAVQDLGRYCQFVKILGSYPRAK

SEQ ID NO: 73826 - protein, 139 aa, Francisella tularensis subsp. novicida
DEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNE

SEQ ID NO: 73827 - protein, 441 aa, Chromobacterium violaceum ATCC 12472
MLFSELGLSPEILRAIDEQGYSQPTPIQEKAIPLVLSGRDLLAAAQTGTGKTAAFMLPILERLKKFANTSVSPAMHPIRALVLSPTRELADQIGVNVQTYTKYLPLRATTVFGGVNMDPQTQELRRGVEILIATPGRLLDHIQQKTVQLNKVEVLVLDEGDRMLDMGFIQDIRKIMGMLPKERQTLLFSATFAPEIKRLAADFMHAPQTVEVARQNATNDQVEQLVFQVDNFKKRQLLAHLIRSREMSQVIVFCKTKISADQLARDLKRDGLDAEAIHGDKTQGARLETLAGFKEGKLRVLVATDVAARGLDISELPYVVNFELPTSPEDYVHRIGRTGRAGAKGIAISLMCPDESRQHEAIEKLTKQTLTPQSVDGFWPSWLPRPKPAREPSSASPSMPALSAGKSEGLKQARPGRRSRKAKREIPALLLPPRYKVEIIR

SEQ ID NO: 73828 - protein, 127 aa, Zea mays
MATVSAAVVTTIVARAAIARPNALGLPALRARSERVRCSYAKDAAPVSTKGAGASLLAAAGAVTASAGPALALVDERMSTEGTGLSLGLSNNLLGWILLGVFGLIWSLYTIYTSDLDEDEESGGLSL

SEQ ID NO: 73829 - protein, 90 aa, Zea mays
MAPAPCGRSSQRVFHFGKGKSEGNKNMKELLGGKGANLAEMASIGLSVPPGFTVSTEACQQYQEAGRALPPGLWAEVLDGLRWVEEYMGA

SEQ ID NO: 73830 - protein, 491 aa, Triticum aestivum
  misc_feature (39)..(39): Xaa can be any naturally occurring amino acid
  misc_feature (57)..(57): Xaa can be any naturally occurring amino acid
THCATDAAVPAPAATNKPRRAADEDIREEAARLRAPANXFSAWYEPFPPGLRRRPVXDERYSLDEVVYRSTSGGLLDVRHDMAALARFPGSYWRDLFDSRVGRTTWPYGSGVWSKKEFVLPEIDSDHIVSLFEGNSNLFWAERLGREHLGGMNDLWVKQCGISHTGSFKDLGMTALVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFNWQVPDWVIIPGGNLGNIYAFYKGFEMCRALGLVDRVPRLVCAQAANANPLYRYYKSGWTDFQSLVAGTTFASAIQIGDPVSIDRAVVALKATDGIVEEATEEELMDATALADLTGMFACPHTGVALAALFKLRDQGIIGTNDRTVVVSTAHGLKFTQSKIDYHDKNIKDMLCQYANPPISVKPDFGSVMDVLQKKLNGKI

SEQ ID NO: 73831 - protein, 472 aa, Pseudomonas syringae pv. tomato str. DC3000
MAERLSNDFQFIDVGRKDPKKKLLRQRKKEFVEIYEPFKPQQSADQAHRCLGCGNPYCEWKCPVHNFIPNWLKLVAEGNILAAAELSHQTNTLPEVCGRVCPQDRLCEGACTLNDGFGAVTIGSVEKYITDTAFAMGWRPDMSRVIPTGKRVAIIGAGPAGLGCADVLVRGGVTPVVFDKNPEIGGLLTFGIPEFKLEKSVLSHRREVFTGMGIEFRLNTEVGKDVTIDQLLEEYDAVFMGMGTYTYMKGGFAGEDLPGVHDALDFLIANVNRNLGFEKAPEDFVDMKGKRVVVLGGGDTAMDCNRTSIRQGAKSVTCAYRRDEENMPGSRKEVKNAKEEGVRFLYNRQPIAIVGEGKVEGVKVVETRLGEPDARGRRSPEPIPGSEEIIPADAVVIAFGFRPSPAPWFEQFTISTDSQGRVVAPEQAQYKHQTSNPKIFAGGDMVRGSDLVVTAIFEGRNAAEGIMDYLGV

SEQ ID NO: 73832 - protein, 387 aa, Francisella tularensis subsp. tularensis SCHU S4
MNLHEYQAKDLLESYGLKVQKGIVAHNPNEAAQAFDQLGGKFAVVKAQVHAGGRGKAGGVKVVKSSQEAREVAESLIGKNLVTFQTDAEGQPVNSVGVFEDVYPVTRELYLGAVVDRSSRKVTFMASTEGGVDIEEVAHNSPEKILKVEVDPLVGLQPFQAREVAFKLGLEGKQINDFVKTMLGAYKAFIECDFALFEINPLAVRENGEIVCVDGKINLDSNALYRHPKLLALRDKSQENAKELKASEHELNYVALEGNIGCMVNGAGLAMATMDIIQLYGGKPANFLDVGGGATKERVIEAFKLILDDENVKAILINIFGGIVRCDMIAEAIIEAVKEVNVTVPVVVRLEGNNAEKGAKILADSGLKLIPADGLADAADKVVKSLG

SEQ ID NO: 73833 - protein, 208 aa, Clostridium perfringens str. 13
MKRPIFIGITGGTGSGKSTIAKEIYRQFGEDCIAMIEQDSYYKDQSHLSMEDRVKTNYDHPNAFDNNLLVSHLESLLNGHSIQKPSYDFSIHNRIEDTTKVEPKEIVIVEGILILEDPRIRELLDIKIYVDTDADVRIIRRMVRDINERGRTMESVINQYLNVVKPMHNQFTEPTKKFADIIIPEGGHNKVAIDIIVAKIKEVLGKYE

SEQ ID NO: 73834 - protein, 299 aa, Rhizobium leguminosarum bv. viciae 3841
MITVFGSINMDLIATTERLPKPGETVAGNGFATAAGGKGANQALAARRAGRYVHMAGAVGKDAFAAEALALLDDAGTDLSLIKHVDGPTGTALILVGGDGENMIAVVPGANGQVTPADAETAIGRMNEGDILMLQLEVPVAAVERALSAARAKGVTSILNLAPLIPDAPRLGRLADIVIANETEFERLAGQEGMDAQAREAALVRLHAETGQTLIVTLGADGVIAIRDGAISRAQGLKIEPVDTVGAGDTFCGYFAASLDDGLDFVSALRRAAVAGSLACLEAGAQPSIPLSEEVADRI

SEQ ID NO: 73835 - protein, 327 aa, Francisella tularensis subsp. tularensis SCHU S4
MKITTRKICIAPMLDWTDRHYRYMMRLITRHTMLYTEMVTLNAILHGNKEFLLKYNPQENPVTLQLGGCVPKDFISCGKLAEELGYNEININVGCPSERVKKGNFGLSLMAEPELVADCVKAMKDNLNIPISVKCRIGYDHNDSYEELYNFVDKQVQAGIDYLCIHARKGWLSGLSPKENRTIPELKYDVVYSIKKDFPNLELGINGGITTIQEIQQHLKYVDSVMIGREAYHNPMLFKDFDNIFYNQPTTNISALEIAYKMAEYIKDQMDNDPYIKLNNITKHTLNLFNGLPNAKVYRRYLSENATKKEANVDTFLTALEVFENKL

SEQ ID NO: 73836 - protein, 334 aa, Actinoplanes sp. A40644
MKTAAATAVAHPNIALIKYWGKSDERLMIPYVDSLSMTLNILPTVTTVALDSGVRTDQVTLDGSPAKGDFRQRVVTFLDLLRAMAGRDDRAVVDTRNVVPTGAGLASSASGFAALAVAGAAAYGLDLDPTALSRLARRGSASASRSIFGGFAICHAGQGGGEAADQSAFAEPVPVTGLDPALVIALVNAGPKAVSSREAMRRTVATSPLYQSWAASSKIDLAEMRAALHHGDLAVVGEIAERNALRMHATMLAARPAVRYLSADTVTVLDSVLRLRADGIAAYATMDAGPNVKVLCHRADAGRVADAVRAAVPDCSVLTAGPGPAAVLRTEAGR

SEQ ID NO: 73837 - protein, 365 aa, Debaryomyces hansenii CBS767
HTLPFPILFENPHFTVFLLRKEMVVHSPVIEAIAGFPWYRIRFDSKSTVNPILLIVLAYIKVFSRKTKSIIDWHNLNYTILNLKFQNLKHPLVRILKTYERVLGQFADYNITVTRQMKEFLIKEFNLNKKNIITLHDRPGEQLKPSESLGVTKQEILESHDIFRDIQNISKYKILVSSTSFTPDEDSNLLLSALNQYDNSLAERGLPPISIIITGKGPLKSQLSQKVKQLNFLDNVIIKNAWLSSEDYPLILSVADLSISLHTSSSGIDLPMKIVDFFGCGIPVITLRFPAIGELVTHGTNGLITKSDKDSSVNESQEIYRLLTEAFKNDELLDKIKQGALKESNLRWEENWNNKMGKRFEYSTD

SEQ ID NO: 73838 - protein, 544 aa, marine gamma proteobacterium HTCC2080
MYKYNPIDQAIVDARVSQFSEQMTRYLAGELPEEQFMPLRLQNGLYIQRHAPMLRVAIPYGTLAGYQLRHLAQIARKYDRGYGHFTTRQNIQFNWLALEQVPEVLGELATVQMHAIQTSGACVRNTTTDPLAGTVADEAIDPRVVCELIRQWSTFHPEFAYLPRKFKIAVVATEEDRAAIEVHDVGIRIKKHVIHGLAFDLWVGGGLGRTPLLGHRLLADLPLDELRNWLTAVLRVYNLAGRRDNKYKARIKILVNAMGVEAFREAVTHRYLTDHDSDLKISAETLEDLGDSFSCKLEPQPIEGHQGSLDFQRWYRQNTKPHRIMGYRSVFLSLKRPGTAPGDVTALQMDVIADLADRFSQSEIRTTHDQNLILPHVAESDLKELLQCLSAHDLAHPNLGLISDSIACPGLDFCSLANAPSLSLAEALHETFDDLDEQVDIGPLEVKISGCMNACGHHHIAHIGILGVEKKGQPWYQITLGGRDQQGAALGKRLGPAVPHDDVLPLIKRLVDTYLEERQPGEYFVGFVDRLGVDYLKEISYATH

SEQ ID NO: 73839 - protein, 312 aa, Zea mays
FGRESSFQKSFLDPQARASQPLSPSPRKPIANSQTNPKPQSTPSPPHPLRAAMACSFSAAITVSSAPTPAARPLAAATQSVCIARSAVATTARPLRLAASRSARATRLVARASVVDDLPLVGNKAPDFEAEAVFDQEFINVKLSDYIGKKYVILFFYPLDFTFVCPTEITAFSDRYEEFEKLNTEVLGVSIDSVFSHLAWVQTDRKSGGLGDLKYPLVSDVTKSISKAFGVLIPDQGIALRGLFIIDKEGVIQHSTINNLAIGRSVDETMRTLQALQYVQENPDEVCPAGWKPGERSMKPDPKGSKEYFAAI

SEQ ID NO: 73840 - protein, 210 aa, Streptomyces venezuelae
MKVLLIDAYDSFVHIIDQYLRTLGADTEVVRSRTRSPEELAAARPDAVVLGPGPGHPADSGHVELVHRFAGRVPLLGVCLGHQAIALAYGGRVDVADELMHGRTSTVRHDGAGIYRGLGNSLEATRYHSLVVAEPLPEELLVTAVAADHGYVMGLRHRSLAVEGVQFHPESIMTTAGLTLLENFLSTAGSPTPGGAAAHEDAGLTGARPR

SEQ ID NO: 73841 - protein, 704 aa, Leptospira interrogans serovar Lai str. 56601
MNSVTIIIAMSILAIVTAVVYTLKVTSIKVGTLGGNEKETKKLLEISSAISEGAMAFLVREYKVISLFIAFMAVLIVLLLDNPGSEGFNDGIYTAIAFVSGALISCISGFIGMKIATAGNVRTAEAAKSSMAKAFRVAFDSGAVMGFGLVGLAILGMIVLFLVFTGMYPGVEKHFLMESLAGFGLGGSAVALFGRVGGGIYTKAADVGADLVGKVEKGIPEDDPRNPATIADNVGDNVGDVAGMGADLFGSCAEATCAALVIGATASALSGSVDALLYPLLISAFGIPASILTSFLARVKEDGNVESALKVQLWVSTLLVAGIMYFVTKTFMVDSFEIAGKTITKWDVYISMVVGLFSGMFIGIVTEYYTSHSYKPVREVAEASNTGAATNIIYGLSLGYHSSVIPVILLVITIVTANLLAGMYGIAIAALGMISTIAIGLTIDAYGPVSDNAGGIAEMAELGKEVRDRTDTLDAAGNTTAAIGKGFAIGSAALTSLALFAAFITRTHTTSLEVLNAEVFGGLMFGAMLPFLFTAMTMKSVGKAAVDMVEEVRKQFKEIPGIMEGKNKPDYKRCVDISTSAALREMILPGLLVLLTPILVGYLFGVKTLAGVLAGALVAGVVLAISAANSGGGWDNAKKYIEKKAGGKGSDQHKAAVVGDTVGDPFKDTSGPSINILIKLMAITSLVFAEFFVQQGGLIFKIFH

SEQ ID NO: 73842 - protein, 207 aa, Zea mays
  misc_feature (54)..(54): Xaa can be any naturally occurring amino acid
  misc_feature (68)..(68): Xaa can be any naturally occurring amino acid
  misc_feature (89)..(89): Xaa can be any naturally occurring amino acid
IGRANKRAHRFSRRNPWGDFNIFWIEKAKVIFGKRMAVLWPHECPFFLAIPRNXKKGLRSSKSRKFIXDHFGDLLHTFMDRRAQVDWPXRLIKELYVNQIRELYHSLPYHMVEFVLDDSHCKVTASLRYADLISVVPTRISVLTWRMFNKNAMSRKEVGLSGSHFCTIRLTYAEDALRTLSFSEAYPEIVFTFPQAIRQPYHQKAPA

SEQ ID NO: 73843 - protein, 444 aa, Bacillus cereus E33L
MHILVVSVNYRTAPVEFREKLTFQAAELERAMTTLQNQKSVLENVIVSTCNRTEIYAVVDQLHTGRYYIKKFLADWFQLEIEEVAPYLTIFEQDGAIDHLFRVTCGLDSMVVGETQILGQIKDSFLEAQQVKATGTIFNELFKQVITLAKRAHSETTIGESAMSVSYAAVELGKKIFGELTDCHVLILGAGKMGELALQNLYGSGARKVTVMNRTLSKAEIMAEKYMGHAKPLSELQCALLEADILISSTGASDYVITKEMMTKVEKMRSGRPLFMVDIAVPRDIDPAIDELEGSFLYDIDDLQGVVEANRAERLKEAEKIQFMIEEEIVLFKTWLSTLGVVPLISALRDKALAIQSETMESLERKIPNLSDRERKVISKHTKSIINQLLKDPILVAKEIAAEEGADEKLALFAKIFDLEMEDVESRAEEVEHKRAWTPSVPSL

SEQ ID NO: 73844 - protein, 199 aa, Triticum aestivum
HGTERVEIARVPPPSKLYTYIVQAWPPTVMASSATSVGPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKG

SEQ ID NO: 73845 - protein, 323 aa, Streptomyces bikiniensis
MRVLVTGAAGFIGSHFVRQLLSGSYPELAGAHVLSLDKLTYAGNTENLAEVAGHPRHTFLHGDICDPPTVAQALRGTDLVVHFAAESHVDRSITDSAAFVTTNVLGTQTLLRSALEAGVSRFVHVSTDEVYGSIPEGSSTEADPLDPNSPYAASKASSDLLALAFHRTHGLDVRVTRCSNNYGPHQHPEKVVPLFVTHLLEGLRLPLYGDGLHRRDWLHVDDHCRGIAMVAARGRAGEVYNIGGGTELSNVDLTRRLLGVFGADWSVVDRVPDRAAHDRRYCVDTRKITEELGWAPRVAFDRGLAETVDWYRDNGTWWKALTP

SEQ ID NO: 73846 - protein, 284 aa, Oryza sativa Japonica Group
MAAPPQPVPAPAAASPEVFRLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTPSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 73847 - protein, 305 aa, Streptomyces bikiniensis
MFETPLKRPGVRGIILAGGSATRLQPLTGALSKQQLPVYDKPMIYYPLSVLMLAGIQDILIISSHQHVETFQVMLGDGSRLGIQLDYAVQDEPRGVADAFLVGDKHIGNDRVALILGDNVFHGPGFSTVLKHSLRRLDGCELFGYPSKSPERYGVAEIDEQGHLLSLEEKPSRPRSNLAVTGLYFYDNDVVELAKDLKPSARGELEITDINLSYLEQGRARLTQLGRGFAWLDMGTHDSLLQAGQYVQLLEQRQGVRIACLEEIALRMGFIDADTCYRLGEELSASSYGDYLMEVASGLGATRTG

SEQ ID NO: 73848 - protein, 910 aa, Pseudomonas putida KT2440
MLKACHGSYAQLELEAQHAALAFLRDQGLPVPAVRSAHNGMGLLELDIDAQPLRLRLLDYIEGQPLTRLKHMEPRLMAELGGLCAKLDKALAHFDHPGLARTLQWDPQHAGALIDHLLPVLQDGGQRARIEHATRQANEHLMPLVDQLPSQAVHLDITDDNTVWARDAQRQWQLQGVIDFGDLLRTWRIADLSVTCAALLHHAEGDPLRILPAVQAYQALNPLTEAELRALWPLVLNRAAVLVLSSEQQLTVDPGNQYTRDNIAHEWEIFDTATAVPFALMEAAILQAAGLQPAAPDWNDCAPLLPELAGLAVTRVDLGVLSKHFEAGNWEQPGYDQHLLTSQAAPACSLHGQYRLSQTHIDRPEEPATCALFVELHVPNGSPVQAPAAGTWQHSGDGRGCLRTPHWALWLQGLEDAPADGQAVEKGQALGSSCGFLSVQVCLDNGSQPPRFATPSQAAAWLALCPSPAALLGFDCDAEPLPDPQALLARRDASFARSQKHYYAQPPHIERGWRNYLIDMQGRSYLDMLNNVAVLGHGHPRMVAESARQWSLLNTNSRFHYAAITEFSERLLDLAPEGFDRVFMVNSGTEANDLAIRLAWAYSGGRDLLSVLEAYHGWSVATDAISTSIADNPQALETRPDWVHPVEAPNTFRGRFRGADSAADYLQDVDAKLADLDARGRQLAGIICEPVYGNAGGISLPAGYLRAAYAKVRARGGVCIADEVQVGYGRLGEYFWGFEEQGVVPDIITMAKGMGNGQPLGVVITRREIAEALEAEGYFFSSAGGSPVSCRIGMAVLDVMQEEGLWDNARDTGRYFKARLQALVDKHPLAGAAHGSGFYLGLELVRDRTTLEPATEETMMLCDRLRDLGIFMQPTGDYLNILKIKPPMCTSRASVDYFVDSIDRVLGEGL

SEQ ID NO: 73849 - protein, 410 aa, Streptococcus pneumoniae
MKIAVAGTGYVGLSIAVLLAQHHEIKAVDIVAEKVELINQKKSPIQDDYIEKYLVEKDLNLEATMDAKYAYEDAEFVVVAAPTNYDSKKNFFDTSAVEAVIQQVKKINPKAVIIIKSTIPVGFTESVQKKYQYKNILFSPEFLRESKALYDNLYPSRIIVGTDLEDTYLKDKANIFASLLKEGAIKEDIDTLFMGVTEAEAVKLFANTYLALRVSYFNELDTYAEVKGLDAKAIIDGIGLDPRIGNHYNNPSFGYGGYCLPKDSKQLLANYFDVPQNMMTATVESNRTRKDFIAQRILEKAGVSETDSLDAFKNIQDIVIGIYRLTMKSNSDNFRHSSIQGVMKRLKAKGVTVIIYEPTLKDGETFFGNKVVNNLDKFKEASNVIVANRFEPSLEDVSNKVYSRDIFKRD

SEQ ID NO: 73850 - protein, 536 aa, Vitis vinifera
MLRKGGHAVDAAVATALCVGIVNPMASGIGGGAFMIVRSSSTSKSEAFDMRETAPLAASQNMYENNPRAKYLGALAMGVPGEIAGLHEAWLKHGRLAWRSLFQPAIRLAKYGFVVAPYLAKAIANGAQLILNDPGLRQVFAPNGKLLQAGDICYNLELGNSLEAVAEQGPQAFYNGAVGEKLIKDVRKAGGILTMEDLRNYRVDVTDAMAVNTMGYTIFGMPPPSSGTLGLSLVLNIFNSYGSSDAARGSLGLHRMVEALKHMFAIRMNLGDPHFVNINNYTSDMLSPSFADTIRQKILDNTTFSPDYYLNRYSQLRDHGTSHFCIVDADRNAVSMTTTVNYGFGAGVLSPSTGIVLNNEMDDFSTPTELSPDRLPPAPANFIKPNKRPLSSMTPIIVVKDNQLAGVIGGSGGIYIIPAVLQVFLNHFIFGMEPLAAVQSPRVYHRLIPNVVFYENWTVIDGDHIELSEERKLFLAERGHRLEAKAGGAISQLVVQTLEKPIDMGRKNGKDFNAETFHGTLTAVSDPRKDGRPAAV

SEQ ID NO: 73851 - protein, 447 aa, Rhodococcus sp. RHA1
MSTRDQVAEIYEQVRLRNAGEPEFHQAAAEVFESLQVVLDHHPHYADSGLIERLCEPERQIIFRVPWVDDSGNVHVNRGFRVQYNSVLGPYKGGLRFHPSVNLGIVKFLGFEQIFKNALTGLPIGGGKGGSDFDPKGRSEAEIMRFCQSFMTELHRHIGEYTDVPAGDIGVGGREIGYLFGQYKRLTNSYESGVLTGKGLTWGGSQVRREATGYGVAYFVAEMLKAANSSLDGKTVVVSGSGNVAIYAIEKVHQLGGIAIASSDSSGYLVDEKGIDLELLKEIKEVRRGRISEYADTVPHARFVPNGSIWDVPCDVALPCATQNELDEAAAKTLVANGVQAVAEGANMPTTPQGVQVFRDAAVAFAPGKAANAGGVATSALEMQQNASRDSWGFEYTDERLAGIMRGIHERTVATAAEYGMPGDYVHGANIAGFVKVADAMISLGVI

SEQ ID NO: 73852 - protein, 496 aa, Acidovorax sp. JS42
MEMKTSPLSLLKDPSLLKTDALLGGQWFAGGARFAVHDPATGLKLADVANLGAKEAELAIAAANEAWPAWKAKTAKERSTILRQWFDLLMQHQDDLGRLMTAEQGKPLPEAKGEVAYGASFVEWFAEEAKRVNGETLPQFDNNRRLLVLKQPIGVCAAITPWNFPLAMITRKVAPALAAGCPVVIKPAELTPLTALAAAELALRAGIPAGVLSVLTADAENSIAIGKVLCASDVVRHLSFTGSTEVGRILMAQCAPTVKKLSLELGGNAPFIVFDDADLDSAVEGAFASKYRNAGQTCVCTNRFYVQAGVYDAFVAKFAARVKTAKVGNGFEDGVNQGPLIEPAAVDKVQRHLDDAIAKGASVVTGGKHLAELGAGQFFEPTVLANATAGMLCAREETFGPLAPVFRFETEQEAIAAANATEFGLASYFYSRDVGRIFRVGEALEYGMVGVNVGILATEHVPFGGVKQSGLGREGSHYGMDDYVEIKYLCVGDIQK

SEQ ID NO: 73853 - protein, 397 aa, Wolbachia endosymbiont strain TRS of Brugia malayi
MSDLAKRMLLIKPSPTIAVTDKANRLKDEGKKICILAAGEPDFDTPDHIKKVAIQAIDEGKTKYTAVDGTRELKEAIISKLKRDNNLEYALSQVCVGAGAKQVLFNLFMATVNPGDEAIIPAPYWVSYVDMVSLFGGLPVVIECGQGLKLTPELLKNKVTKKTKWLILNSPNNPAGVVYTYGELEGIAQVLLEYPHVNIITDDIYEHIIYDEKFFTIAQVEPKLYNRVFVVNGVSKAYAMTGWRIGYIAGRSDVVKAISTLQSQSTSNPNSIAQAAAVEALNGDHSFLKERMGIFKSRRDFVIEKLNSAPGLLASIPQGAFYLFVSCKDLLGKSTKSGKVINNDLDFAEYLLEDHLVAVIPGIAFGLKNFIRISYATSQEQLEIGCNSIIKACKMLS

SEQ ID NO: 73854 - protein, 572 aa, Oryza sativa Indica Group
MGKASKKSVAVAVAPAAVPAKGKGGKKREAEDEIEKAVSAKKQKAAAAPPAKAVPAPKADAKKAKKQPPPKKAASSSSGSSSEEDSSESEEEVKVQVKKTTKPVKQESSSDESSDESSDDEDAKPAAPVANNGLKKGKPASSDSESDSDDEMDEDEKPAAPVKKTSVTAQKKKDDSDSSESESDESDSDEDVPTKSKAPVVAAKNDDSTDGSESESDSEDEDAAPKGAAKKESSSDEEDDSSEESSDDEPKQPQQKKAQEESSEESSEEDSDEEDEKLAKTPKKKTPAATKSQNDEPKTPASNQSQGTESATLFMGNLSFNLNQDQVKEFFQEVGEVISVRLATHEDGSSRGFGHVQFASSEEAKKALELHGCDLDGRPVRLDLAHERGAYTPHSRNDTGSFQKQNRGSSQSIFVKGFDSSLEESKIRESLEGHFADCGEITRVSVPMDRETGASKGIAYIDFKDQASFSKALELSGSDLGGYNLYVDEAKPKGDSRDGGGRRGGRSGDRFGGRSGDRFGGRSGGRFGGRDGGRRGGRGGRDGGRRGGRGGFQSRQSAGTASTGKKTTFGDE

SEQ ID NO: 73855 - protein, 139 aa, Francisella tularensis subsp. mediasiatica
DEDVFKKLNKIIDTTITPVVCIGESLDDRQSGKLKQVLATQLSLILENLSVEQLAKVVIAYEPVWAIGTGVVASLEQIQETHQFIRSLLAKVDEKLAKNIKIVYGGSLKAENAKDILSLPNVDGGLIGGASLKAVEFNE

SEQ ID NO: 73856 - protein, 207 aa, Erwinia carotovora subsp. atroseptica SCRI1043
MSYSGEQERQAPHMALVPMVVEQTARGERSYDIYSRLLKERIIFLTGQVEDYMANLVVAQMLFLEAENPEKDIYLYINSPGGVITAGMSIYDTMQFIKPDVSTICMGQACSMGAFLLTAGAKGKRICLPNSRVMIHQPLGGFQGQATDIEIHAKEILKVKAKMNELMAKHTGQPLEAIERDTERDRFLSASEAVEYGLVDSVFTNRG

SEQ ID NO: 73857 - protein, 527 aa, Oryza sativa
MDRQEEEDDDAALREAGGGASFPGGWLRRLSRELHWSFVLAVVAVYGACQGVGDAVGGVAAGYYWKDVQRVQPSAAQFYQGFVSAPWIVKPIWGLLTDVVPVAGYRRRPYFLLAGVIGASSMLTLSLHRKLGIMPAILALTAQSAGAAVADVTVDALVAQNSITHQPLAADMQSLCGFSSSVGALLGFSISGLLVHSMGSQGALGLLSIPSALVFLAGVLLKERRVTGFEGIQVHRKFYKAIQSMGATLKCAEVWRPCVYMYVSLSLSLDIQAGMFYWYTDPIVGPGFSEEFIGLVYSIGSIGSLLGVLLYQISLKDYPFRGVLFWGQVLSSLAGMLDLIMVTRLNTRVGIPDYVFAVIDNSVSQMVGRLKWLPLLVLCSKLCPPGIEGTFYALLMSIQNAGLLMSGWWGGLMLQLLNVTRTEFSNLWVAVLIRNLSRLLPLMLLFLVPQSDQNSMLLPAEMLQDNESTEARKGGQDTAEFSVLVADDSSCHALNVAVEDERIKVVDAGTGTVELIPLMNELQDRGS

SEQ ID NO: 73858 - protein, 139 aa, Francisella tularensis subsp. holarctica
DEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNE

SEQ ID NO: 73859 - protein, 475 aa, Pyrococcus abyssi GE5
MRLPDHKTKIVATIGPATSSRNMIKKLIENGVSVVRLNFSHGSFEEHAKVIEKVRDISQKLDRRVAILADLPGLKIRVGEIKGGYVELKRGEKVVLTTRDVVGDETTIPVEYKDFPRLVSKGDVIYLSDGYIVLRVEEVRGQDVEAVVVSGGKLFSRKGINIPKAYLPVEAVTPRDMEIIKFAIEQGVDAIGLSFVGSVYDVLKVKSFLEKNDAEDVFVISKIERPDAVRNFDEILKASDGIMIARGDLGVEMPIERLPILQKELIRKANTEGKPVITATQMLVSMTAEKVPTRAEVTDVANAILDGTDAVMLSEETAIGKFPIDAVKMMAKIAKVTEEYRESFGMSRLRELVEDGTRGTIKEAIARSIIDALCTLNIKYILTPTRTGRTARLISRFKPKQWIFGFSTNERVCNNLMFSYGVYAFCLEEGFDERDIIRLIKGLGLVESDDIVLMTEGKPIEKTMGTNSIKIFQIA

SEQ ID NO: 73860 - protein, 147 aa, Chlamydomonas reinhardtii
MMTRSPVAGLPRPCSALQRSGCTLQGAFGTFAPQTTRTFVVTWAKGGVMDAPTTTQQPASGVERSQKRPPIYKVLLHNDNYNKREYVVKVLLKVVEQITVDDAVTCMQEAHETGVALVVACPQDNAERYCEGLRLNGLTSTIEPGGC

SEQ ID NO: 73861 - protein, 482 aa, Vibrio vulnificus CMCP6
MKGDIGVIGLAVMGQNLILNMNDHGFKVVAHNRTAAKVDEFLEGPAKGTNIIGAYSLEELVEKLETPRKVMLMVRAGAVVDQFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEPLVEKILDTAGQKGTGKWTGINALDLGIPLTLISESVFSRCLSALKDQRVEAEKLFGKTITPVEGDKKEWVDALRQALLASKIISYAQGFMLMREASNENGWDLNYGNVALMWRGGCIIRSAFLGNIRDAYEANPDLAFLGSDDYFKGILQNSLVAWRKVAAKSLEAGIPMPCTTSALTFLDGYTTARLPANLLQAQRDYFGAHTYERIDRERGEFFHTNWTGTGGNTASTTYDV

SEQ ID NO: 73862 - protein, 316 aa, Bacillus thuringiensis serovar konkukian str. 97-27
MSTVQVPKLNTKDLLTLEELTKEEIISLIEFAIHLKKNKQEPLLQGKILGLIFDKHSTRTRVSFEAGMVQLGGHGMFLSGKEMQMGRGETVSDTAKVLSQYIDGIMIRTFSHADVEELAKESSIPVINGLTDDHHPCQALADLMTIYEETNTFKGIKLAYVGDGNNVCHSLLLASAKVGMHMTVATPVGYEPNEEIVKKALAIAKETGAEIEVLHDPELAVNEADFIYTDVWMSMGQEGEEEKYTLFQPYQINKELVTHAKQTYRFLHCLPAHREEEVTGEIIDGPQSIVFEQAGNRLHAQKALLVSLFKSVEELS

SEQ ID NO: 73863 - protein, 236 aa, Bacillus thuringiensis serovar konkukian str. 97-27
MFFDCIKKLQQQYKVVIVHGGGPEIDAKLKDCNINVEKRDGLRVTPKEVMDVVQMVLCGSTNKKFVMNLQKHNLLAVGCSGCDGKLLQVQPVSEEIGYVGEVSYVETALLKGLINMNYIPVIAPIGIHDNEIYNINADTAAAGIAAALSAKELILITDVDGILHEGKLVKKTDESEIATFIEKGVITGGMIPKVQAALASLKMGVQKISIVNGTKDFTEDTGECIGTTVTRGVSIV

SEQ ID NO: 73864 - protein, 501 aa, Vibrio vulnificus CMCP6
MMVIPENSSIVIFGASGDLTYRKLIPALYHLYASKQLPENFAILGVSRTEYSDESYREKLKRSLQEMEKTEPAILDSFIDHLHYQAINTSDTKDYAKLVVRLDELAAQYQFEQRNTLFYLATPPSLYSVIPASLAHHGLNSEEDGWKRLIIEKPFGYDLASARQLDKEIHDCFQEHQIYRIDHYLGKETVQNLLVFRFSNAMFEPLWNRNFIDYVEITGAEFLGVEERGGYYDGSGAVRDMFQNHLLQVLAMVGMEPPAQINADSMRDEVVKVLQCLKPLEEDDLRNNLVLGQYTASDVRGQHLLGYREENGVADDSRTETYIGLKAYINNWRWNGVPFYVRTGKRLPTRVTEVVIHFKQTPHPVFGQNAPENKLIIRIQPDEGIQMSFGLKEPGAGFKAKEVKMNFHYASLQETQMLTAYERLLLDALNGDATLFARSDAVEACWKYVQPILDFKQDPQALFGYACGTWGPKESDDLLQRDDRAWRFPCKNLTDTDYCEL

SEQ ID NO: 73865 - protein, 422 aa, Pseudomonas syringae pv. tomato str. DC3000
MSDLKTAALEYHANPRPGKLSVELTKPTATARDLALAYSPGVAEPVREIARDPELAYKYTGKGNLVAVISDGTAILGLGDLGPLASKPVMEGKGVLFKRFAGIDVFDIEVDSESPQAFIDTVKRISITFGGINLEDIKAPECFEIEKALIEQCDIPVFHDDQHGTAIVTAAGMINALEIVGKSLESAKIVCLGAGAAAISCMKLLVSMGAKIENIFMVDRTGVIHSGRTDLNQYKAVFAHATEKRSLTDALDGADVFVGLSGPNLLSAENLKLMAKDPIVFACSNPDPEISPELAHATRSDVIMATGRSDYPNQVNNVLGFPFIFRGALDVRAKRINEEMKIAAANALRELAKLPVPQEVCDAYGGIKLEFGREYIIPKPMDTRLLGLIADAVAKAAIESGVATLPYPKHYPLTSVDDVFNG

SEQ ID NO: 73866 - protein, 282 aa, Atriplex canescens
MSKEVISEEGQVHQHGKDYVDPPPAPFFDMGELKLWSFWRAAIAEFIATLLFLYITVATVIGYKKETDPCASVGLLGIAWSFGGMIFVLVYCTAGISGGHINPAVTFGLFLARKVSLLRALVYMIAQCAGAICGVGLVKAFMKGPYNQFGGGANSVALGYNKGTAFGAELIGTFVLVYTVFSATDPKRSARDSHVPILAPLPIGFAVFMVHLATIPITGTGINPARSFGAAVIYNKKRVWDDHWIFWVGPFVGALAAAAYHQYVLRAAAIKALGSFRSNPTN

SEQ ID NO: 73867 - protein, 75 aa, Buchnera aphidicola
GDFFIIGFEEEIGVKNHIALIYGDISLVDPILTRIHSECLTGDALFSLRCDCGFQLESALITIAKAGSGILIYHR

SEQ ID NO: 73868 - protein, 503 aa, Debaryomyces hansenii CBS767
NLINSQRVKNPTTIYPTNITLIDSYTNNYSDGIARVFGLNNCQASELVEFTSGVKGMALNLEAGQVGIVLFGSDRAVKEGETVKRTGKIVEVPTGPELLGRVVDGLGNPIDGKGPLNASSTSKAEVKAPGILPRTSVFEPMQTGLKSVDALVPVGRGQRELIIGDRQTGKTTVALDTILNQKRWNDGKDESKKLYCVYVAIGQKRSTVAQLVQTLEQNDALKYSIIVAATASEAAPLQFLAPFTACAIGEWFRDNGRHAMITYDDLSKQAVAYRQLSLLLRRPPGREAYPGDVFYLHSRLLERAAKMSDANGGGSLTALPIIETQGGDVSAYIPTNVISITDGQIFLEAELFYKGIRPAINVGLSVSRVGSAAQVKAMKQVAGSLKLYLAQYREVAAFAQFGSDLDASTKQTLNRGERLTNILKQKQGSPLAAEEQVPLIYAGVNGFLDEVALDRLAEFEESFASHLKSNDSDILDAIREKGELSKELLEKLRSTTESFVASF

SEQ ID NO: 73869 - protein, 81 aa, Buchnera aphidicola
GEFTLIGFEEISKLEKKNHVALIYGNINLLILKNKAVLVRIHSECLTGDALFSLRCDCGFQLKQSMKIISKKGFGVIIYHR

SEQ ID NO: 73870 - protein, 1510 aa, Arabidopsis thaliana
MSYKNTNNSHLILFKLLLLLILYSADLTASSSCRSECGGCKCGGIAIPYPFGIGKGCYLEKSYEIECLNTSGKLVPFLSVISKEVVSIHLPGRQSFGSVRVRSPITSAGCSSDGKDSAPVMNLTDSPFFVSDINNLVGVGCSSKVSLEHIKQNMVGCELNCSTTNASDSNSIPFFDKTGCSFSYTFAQVCTGNKPEDMGCDGRGCCQASLPREPQQVIGIRIESNDGKSTTSGDCRVAFLTDEFFSLSKLTKPEQLHAKRYATLSLGWIMQTRNTSFVNSLACKIRKDTDTAYSNDQSIKCICDYTMSIISDIRYANCECNLGYKGNPYDSDGCRDIDECKENPKYCKETDTCVNFEGGYRCVGDKTKAIMIGAGTGFGVLVLVGGVWWLRKFLVKRRMAKRKKKFFKRNGGLLLQQELNTRQGVVEKARIFTSKELEKATENFSENRVLGHGGQGTVYKGMLVDGRTVAVKKSKVIDEDKLQEFINEVVILSQINHRHVVKLLGCCLETEVPILVYEFIINGNLFKHIHEEEADDYTMIWGMRLRIAVDIAGALSYLHSAASSPIYHRDIKSTNILLDEKYRAKVADFGTSRSVTIDQTHWTTVISGTVGYVDPEYYRSSQYTEKSDVYSFGVILAELITGDKPVIMVQNTQEIIALAEHFRVAMKERRLSDIMDARIRDDSKPEQVMAVANLAMKCLSSRGRNRPNMREVFTELERICTSPEDSQVQNRIDEEEEEDGVEEEEEVVTIVHRGDSWSIGVTAPASNACQRECGGISIPYPFGIGKDCCLEKYYEIECRNTTSRKLVPLLSFINKEVVSISLPSADSHFAYEVSDQERHESFGLVRVKFPITSAGCFNDGKESGGGSKMNFTGSPFFIDRSNSLIAAGCNSKVSLMYIKPKMVGCELSCNTSKDSYSNSIPFVEAGCSSNVLPYSQDQGCPEEIAEETGCNGIGCCQASLPNEPQQVIGIRTENNDGNSTTKVECTVSAFLTDEIYALPKATKTEHLLAKRYATVSLGWVIQTSNRSFLDSLALACKDREDYRNTTNLERKCTCGRITISETSYANCGCTYGYTGNPYVLNGCKGYRCVRDKTKAIMIGAGTGFGVLVLVGGLWWLRKFLIKRRITKRKKKFFKRNGGLLLLQELNTREGYVEKTRVFNSRELEKATENFSENRVLGHGGQGTVYKGMLVDGRTVAVKKSKVIDEDKLQEFINEVVILSQINHRHVVKLLGCCLETEVPMLVYEFIINGNLFKHIHEEESDDYTMLWGMRLRIAVDIAGALSYLHSSASSPIYHRDIKSTNILLDEKYRAKVADFGTSRSVTIDQTHWTTVISGTVGYVDPEYYQSSQYTEKSDVYSFGVILAELITGDKPVIMVQNTQEIVALAEHFRVAMKEKRLTDIIDARIRNDCKPEQVMAVAKVAMKCLSSKGKKRPNMREVFTELERICTSPEDSQVHNRIDEEEEEEEEEEEVVTTINRGDSWSISVTAPALSIVASSPSSDVEPLFPRLTW

SEQ ID NO: 73871 - protein, 78 aa, Buchnera aphidicola
GEFVLTGFKEIENSNIENHHIALIYGDILKTYPVLVRIHSECLTGDALFSLRCDCGFQLQKSMEIIATEGSGIIIYHR

SEQ ID NO: 73872 - protein, 142 aa, Clostridium perfringens str. 13
MIYSEKVMDHFKNPRNVGEIKDANGIGEVGNAKCGDIMRIYLKIENNIVEDVKFETYGCGSAIASSSMATELIKGKTVEEAWELSNKAVAEALDGLPPVKMHCSVLAEEAIHKAINDYRQRQGLEPWDMKEHSHDIHEHVHG

SEQ ID NO: 73873 - protein, 222 aa, Leptospira interrogans serovar Lai str. 56601
MGVLESYQKIYEELQQLRSENPPTLIAVSKFQPIEKIKEAIGCGVVHFGENRIQEGIEKFSQWLKDKNTSLVLHHIGPVQSGTLRKLFLGYSYAHGVGSVGIVNELLTRALREEKKILYFLQANLTGENTKHGFERKELIEILKQKEKLSNTYCKLEGLMVMGPSDGDLTKTREVFRELSKFKKDYIPEAKLSMGMSGDYKIAIEEGSDFVRIGSAIFGERN

SEQ ID NO: 73874 - protein, 291 aa, Xanthomonas campestris pv. campestris str. ATCC 33913
MSAALFERWVARTERQLDACLPSPALAPQRLHAAMRHAVLGGGKRMRPLLVYASGALFGAEEGSLDAPAVAVELIHAYSLVHDDLPAMDDDALRRGHPTVHIAFDEATAILAGDALQARAFELLAEAPADAALRVGWLQSLASAAGAAGMCGGQALDIDATGQVQALEALQRMHALKTGALIRAAVRMGVLTGGAGIADQQRLDAFADALGLAFQVRDDILDVESSSAQLGKTAGKDAAQSKSTYPALLGMDGAKTKLAELASHMHALLLPYGESGATLASLGRFAVDRAH

SEQ ID NO: 73875 - protein, 203 aa, Brassica napus
  misc_feature (135)..(135): Xaa can be any naturally occurring amino acid
MENQPLISPQSRYPLHPIPENPSSSSFSAAAAAAAVTIPHSTSTPSFSQESIQPHHHDLEKSEPDPDSYFNNPRPLHRCRTAPAMVIIKDLTRNKSTSSEPKKPSPISKSIIKQAIFLLVVYLTLGVSIYSFNRXDHYSGVETHPVVDALYFCIVTMCTIGYGDIAPLTPWTKIFAVVFVWFGFGFLDILLSGVVNYVLGLQE

SEQ ID NO: 73876 - protein, 408 aa, Clostridium perfringens str. 13
MRPKKLEDIVGQKHIVGEGTPLNKLIKNKNIINCIFYGPPGVGKTTLANIISNYTDKKFYKINATTSSIKEIQSITSDIDNLLNFKGIILYIDELQHFNKKQQQALLEFIEDGRVILIASTTENPYFAIHKAILSRSTIFQFKPVSTEDIIIALERAVSKLEKEGYVISLEEGVLKYIGDISQGDVRKAYTVLELAIKSQEKDNILLNKEYVEKLGQSNLKSDSSGDDYYNLLSALQKSIRGSDPDASIHYLARLIKGGNMDSVIRRIGVIAAEDIGLAHPNALQVVNSGIDLALKIGMPEARIILSELVIYLATLPKSNSAYMAIDEALRDLERNNAGDVPKHLKDAHYSGASNLGVGGYLYPHNYPNGYINQEYMPENMRGKEYYKPKDNKYESSIKAYWNNVKNK

SEQ ID NO: 73877 - protein, 273 aa, Leptospira interrogans serovar Lai str. 56601
MILLGLEVRFLEKEIDMKYTIGIAGCGNMGGAIYFSLKERYPTQVLGYDPYIISNQKIELISSWDEFVSKSDLILVCVKPGKVIELLRQIKVPKKIISVAAGIHIDTILKNLPTGSNVVRVMPNLPLLVSEGAIGFFGDEELYETVSEIFQPLGHSVKLGSETLMDAVTGLSGSGPAYVFKFIQALAEGGVLSGLGYQEALDLSIQTVIGSAQLLRKEREKDPTTHPEVWKNKVTSPGGTTIAGLVELEKNGFSNAVLEAVKAAANRSKELGV

SEQ ID NO: 73878 - protein, 281 aa, Candida albicans
MDSAYWSYDNIVPSFRLDGKLVILTGGSGGLAAVVSRALLAKGADVALVDMNLERTQQAARDVLQWGEEQMKGKYESPIGQVSAWSCNIGDAEAVDLTFKAINEHHGKISSVLVNTAGYAENFPAEEYPAKNAENLMKVNGLGSFYVSQAFARPLIQNNMTGSIILIGSMSGTIVNDPQPQCMYNMSKAGVIHLARSLACEWAKYNIRVNTLSPGYILTPLTRNVISGHTEMKTEWESKIPMKRMAEPKEFVGSILYLASESASSYTTGHNLVVDGGYECW

SEQ ID NO: 73879 - protein, 172 aa, Oryza sativa
MSNTRVFFDMTVGGAPAGRIVMELYAKDVPRTAENFRALCTGEKGVGKSGKPLHYKGSTFHRVIPEFMCQGGDFTRGNGTGGESIYGEKFADEVFKFKHDSPGILSTANAGPNTNGSQFFICTVPCSWLDGKHVVFGRVVEGMDVVKAIEKVGSRGGSTAKPVVIADCGQLS

SEQ ID NO: 73880 - protein, 580 aa, Oryza sativa
  misc_feature (224)..(224): Xaa can be any naturally occurring amino acid
  misc_feature (232)..(232): Xaa can be any naturally occurring amino acid
  misc_feature (392)..(392): Xaa can be any naturally occurring amino acid
MHRFLVTALLFSLLNYGAVMATESDEADFFRNCPPSRCSSDGPDIKFPFRLESSSSSCGAPGMQLSCSGQDTLLLHHVLGLSKVTGIDYIYGVINIVPLAESWSQCALQKIISANYSTSVYKQYGFQYASLVSCSEEFIWDSTDSIFGPISCLSNASQSLYLVAPYAFVSILPLYCKVVSTEIMIPYTSNQGRKDYNASASTEFNESAKRITTFSEITFTWSAXLISLMFAXDCERQQRLCGFSSQRRTAFCKPHGSKSPAKVIIVAVSVPTIVVLTLVVASALYLSLKTKNDDEIQLKVEMFLKTYGTSKPTRYTFSEVKRITRRFKHKLGTGGFGSVYKGELSKGVPVAVKMLENSKGEGEEFINEVATIGRIHHVNVVRLLGFCSEGTXLGIAQGIEYLHQGCSQRILHFDIKPHNILLDHSFSPKISDFGLAKLCARDQSIVTLTAARGTMGYIAPELYSRNFGAVSYKSDVFSFGMLVLEMLSGKRNSDPSINSQNEVFVPEWIYETIVSAQESEFAKDMTQEEKEKLRKLAIVALWCVQWNPANRPSMRKVVNMLTGSLQNLKNPPRPFVSSLS

SEQ ID NO: 73881 - protein, 179 aa, Candida albicans
MGLTISKLFASLLGRREMRILMVGLDAAGKTTILYKLKLGEIVTTIPTIGFNVETVEYKNISFTVWDVGGQDKIRPLWRYYFQNTQGIIFVVDSNDRDRINEAREELQSMLNEDELKDAVLLVLANKQDLPNAMNAAEITEKMGLHSIMNRPWFIQATCATTGDGLYEGLEWLSNQVGK

SEQ ID NO: 73882 - protein, 363 aa, Thermosynechococcus elongatus BP-1
MLRAGIVGLPNVGKSTLFNALVANAKAEAANFPFCTIEPNVGVVAVPDERLEVLAKISQSAQIVPTRIEFVDIAGLVKGASKGEGLGNQFLANIREVDAIVHVVRCFEDDDIVHVAGRVNPVEDIAVINLELALADLAQIEKRIERTRKAARSQKEAQIELTALEKLLGVLNEGQPARLCQLTEEEEAAIRFLGLLTRKPVIYAANVAEEDLATGNEWTAAVQEIAKQEGAEVVIVSAQVEAELVDLPEGDRAEYLASLGVREGGLRSLIRSTYKLLGLQTFFTTGPKETRAWTIPAGAKAPQAAGVIHSDFERGFIRAETVSYDDLVACQSMTVAKEKGLVRSEGKDYVVQEGDVMLFRFNV

SEQ ID NO: 73883 - protein, 506 aa, Vitis vinifera
MYRTAASRVRALKGRAGSRALIRFASSSAVATSSSSSGGLFSWLIGDKSKTLPPLDFPLPNVALPPALPDYVEPSKVKITTISNGVKIASETSANPAASIGLYVDCGSIYETPISFGATHLLERMAFKSTINRSYLRVIREVEAIGGNVTASASREQMGYTFDALKTYVPEMVELLIDSVRNPAFLDWEVSEQLEKVKAEIGEASNNPQGLLLEALHSAGYSGALANPLLAPESAINRLDSTILEEFVALNYTAPRMVLAASGVEHEELLSVAEPLLSDLPSVPRPEEPKSVYVGGDYRCQADSGKTHFALAFEVPGGWHKEKEAMTLTVLQMLMGGGGSFSAGGPGKGMYSRLYLRVLNTYPQIQSFSAFNSIYNNTGLFGIQATTGSDFVSKAIDIAAKELVAVATPGQVDQVQLDRAKQTTKTAVLMNLESRMVASEDIGRQILTYGERKPVDHFLKAVDEVTLKDIASITQKLLSSPLTMASYGDVIFVPSYENVSSKFQSK

SEQ ID NO: 73884 - protein, 471 aa, Thermosynechococcus elongatus BP-1
MATPQEILNLIDSKYELIDLKFTDMPGTWQHLTVHKSQISESSFTEGVPFDGSSIRGWKAINESDMVMVPDPNTAWEDPFMKEPTLSLICTIKDPRTGELYDRCPRSIATRAIEYLKATGIGDTAYFGPEAEFFVFDDVRYDQNQKSGYYYIDSIEGVWNSGREEEGGNLGYKIRGKEGYFPVAPTDTLQDLRTEMLLTMAKCGVPIEKHHHEVATAGQCELGFRFGTLVQAADWLMTYKYCVKNVARKHGKVATFMPKPVFNDNGSGMHTHQSIWKDGQPLFWGDGYANLSQIALWYIGGILKHAPALLAFTNPTTNSYKRLVPGFEAPVNLAYSQGNRSASVRIPLTGPNPKAKRLEFRCPDATSNPYLAFAAMLCAGIDGIKNQIDPGSPLDVDIYDLSPEELAKIPSTPGSLMAALENLQKDHSFLTAGGVFSEDFILNWIQYKLDTEVIPMSLRPHPYEFALYFDA

SEQ ID NO: 73885 - protein, 420 aa, Listeria monocytogenes EGD-e
MSQKIQVENGVLKTPNNPVIPFIEGDGTGPDIWAAAKRVLDAAVKKAYNGEKEIAWKEVLAGEKAFKQTGEWLPQATLDTIDEYLIAIKGPLTTPIGGGIRSLNVALRQELDLYVCLRPVRYFKGVPSPVKRPEDTDMVIFRENTEDIYAGIEFKEGSIESKKLIDFLKSEFGVDKIRFPETSGIGIKPISKEGTERLVRSAIEYAIKEGRKSLTLVHKGNIMKFTEGAFKNWGYDLCEREYGDKVFTWNEYDRIKEAEGTEVADAKQNEALAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINQSMEKTIAAKTVTYDFARLMDGATEVKCSEFADELIKNF

SEQ ID NO: 73886 - protein, 551 aa, Agaricus bisporus
MTGSLASNYASWKQLQEIYDKDRAKIVLRDLFAADPQRFSKLSATYNSQSGPGVQILLDYSKHLVTEPILQKLFNLLREAKVEDARDKMFSGEHINTSEDRAVLHVALRNFNDFSIKEEGVDEVSKVLQHMKEFSESVRSGQWKGYTGKTINTIVNIGIGGSDLGPVMVTEALKPFSKRDLNAHFVSNIDGTHIAETLRLCDPERTLFIVASKTFTTQETITNAESARDWFLGFAKDKAHVAKHFVALSTNTSAVTAFGISEANMFQFWDWVGGRYSLWSAIGLSIALVIGFDNFEKLLRGAHAMDQHFKTTPLEKNLPAIMAALGIWCNDFYGAQTLALLPYDQYLHKFADYFQQGDMESNGKFITKNGDRVNYQTGPIIWGASGTNGQHSFYQLIHQGTKIIPADFMAPATSHNPIANSKHHRILLSNFFAQPEALAFGKTEEEVRKELGQNASEALVKSKVFEGNRPSSSLMFDKLDPATLGALIALYEHKIFVQGVVWGINSFDQMGVELGKVLAKQILAQLDKSDDVKGHDSSVRHLPFILQVDHC

SEQ ID NO: 73887 - protein, 3788 aa, Streptomyces bikiniensis
MSSTSPATNEEKLRDYLRRAMTDLHEAREQIRRTESARHEPIAIVGMGCRLPGGVSSPEGLWDLVASGVDAVSPFPTDRGWDVGGLFDPEPGVPGRSYVREGGFLHEAGEFDAGFFGISPREALAMDPQQRLLLETSWEALERAGIDPHTLRGSRTGVYAGVMYHDYGSTATVSVASDDETAGFLGTGTSGSVASGRISYVLGLEGPAVTVDTACSSSLVALHLAVRALRSGECDLALAGGVTVMAEPGVFVEFSRQRGLAADGRCKAFAAAADGTGWAEGVGVLAVERLSDAVRHGRRVLAVVRGSAVNQDGASNGLTAPNGPSQQRVIRQALADARLGVADVDVVEGHGTGTRLGDPIEAQALLATYGQRDAGRALRLGSLKSNVGHTQAAAGVAGVIKMVMAMRHGVLPKTLHVDEPTAEVDWSAGAVSLLREQEAWPEVGRLRRAAVSSFGVSGTNAHVVVEEAPASEAPVAGEPVEPVEPGAVGLLPVVPVVVSGRSAGAVAELASRLNESVRSDRLVDVGLSSVVSRSVFEHRSVVLAEDSAELHTGLVAVGTGVPSPGVVSGVASVEGGRSVFVFPGQGTQWAGMALGLWAESAVFAESMARCEAAFAGLVDWRLADVLGDRSALERVDVVQPASFAVMVSLAELWRSLGVVPDAVVGHSQGEIAAAVVAGGLSLEDGARVVVLRARLIGRELAGHGGMASVALPVAVVEERLAAWAGRLGVAVVNAPSATVVAGDVDAVAEFVTACEVEGVRARVLPVDYASHSAHVEELRAELEQILAGIDPVAGETPLYSTVEAGVVDTASMDAGYWFRNLRRPVRFQETVERLLADGFRVFVECGAHPVLTGAVQETAESTGRQVCAVGSLRRDEGGLRRFLTSAAEAFVQGVEVSWPVLFDGTGARTVDLPTYPFQRRRYWLESRPPAAVVPSGVQDGLSYEVVWKSLPVRESSRLDGRWLLVVPETLDADGTRIAHDLQHALTTHGATVHTLALDPSAAHFDGLFDGILQEETDVTGIFSLLGLASGPHPDHGEVELAGAASLTLMRQAQRDGFRAPVWAVTRGAVSVVPGEVPETAGAQLWALGRVAGLELPDRWGGLIDLPADADARTAGLAVRALAAGIADGEDQLAVRPSGAYGRRLVRATARRGRKDWRPQGTVLLAGHLDAVGEPLARWLLTGGADHVVLADPALTELPATLADLAQTVTTAAAPDLADRAVLAALVTEYVPATVVVVPPAAELAPLASISPADLAAAVTAKSATAAHFDALLDGPHAPELVLISSVAGIWGGVRQGAYAVGAAHLDALAARRRARGLSAASVAWTPWAGSVTADGSAAESLRQYGIAPLEPQAALAELDRALNQQLHGGGGDAAVADIDWERFLASFTSVRPSVLFDELPEVRRLREAEAAAMADQAAARTGAPGGTELARSLRAKSLNAQRTALLELVTAHVAAVLGESVPEAIDRSRAFKDIGFTSMTAMELRNRLKEATGLALPASLVFDHPHPGALADHLREELLGEDGAAGADSAAEEPSATSPTVQDEPIAIIGMACRLPGDVGTPDELWELLETGRDAMSDLPVNRGWDVAGLYDPDPDAAGRSYVREGGFLHDAGEFDAEFFGISPREALAMDPQQRIVLELAWESFERAGLDPAGRRGSRTGVFMGTNGQHYMPLLQNGNDSFDGYLGTGNSASVMSGRISYTLGLEGPALTVDTACSSSLVALHLAVRALRNGECDLALAGGATVMSTPEVLVEFSRQRAVSADGRCKAFSASADGFGPAEGAGVLLVERLSDAVRHGRRVLAVVRGSAVNQDGASNGLTAPNGPSQQRVIRQALADARLGVADVDVVEGHGTGTRLGDPIEAQALLATYGQRDAGRPLRLGSLKSNVGHTQAAAGVAGVIKMVMAMRHGVLPKTLHVDEVSPHVDWSAGAVSLLTEQEPWPEVGRPRRAAVSSFGLSGTNAHVVVEEAPVGEAGQAAGDARLAVVPVVVSGRSAGAVAELASRLNESIRSDRLVDVGLSSVVSRSVFEHRSVLLAGDSGELHTGLVAVGTGVPSPGVVSGVASVGGGRSVFVFPGQGTQWAGMALGLWAESSVFAESMARCEAAFEGLVDWSLADVLGDGSALERVDVVQPASFAVMVSLAELWRSLGVVPDAVVGHSQGEIAAAVVAGGLSLEDGARVVVLRARLIGRELAGRGGMASVALPVAVVEERLAGWAGRLGVAVVNGPSATVVAGDVDAVAEFVTACEVEGVRARVLPVDYASHSAHVEDLKAELEEVLAGIGPVTGGIPFYSTSEAAQIDTAGLDAGYWFGNLRRPVRFQETVERLLADGFRVFVECGAHPVLTGAVQETAESTGRQVCAVGSLRRDEGGLRRFLTSAAEAFVQGVGVFWPALFDGTGARIVDLPTYPFQRRHYWYNDPARRTGDATSFGMAQAGHPLLDAGTELPESGEHLYTARLAADSHPWLLEHTLLGAPLLPGAAFVDLVLWAGGEVGCDLIEELTLTSPLLLSDSAALQLRLVVGTADAEGRRTITVHSRPDGDPRTTRTPAASSETSPDAESDTEIRRDTSAWTKHAQATVAPAPDVPPSGVDAEGDAVRPAVEWSVAATESDAFQAEDFYASFAAHGYGYGPLFQGVRSGRQDGTDVYAEVALDHDRLPSAEQFGLHPALLDAAFQTMRLGSFFPDDGQARVPYTFRGIRLYAPGAARLRVRVSAVGADAVRVECADERGRLVCEIDALVVSTVSPDQLRPAGQDATQDMLHRIEWPVLSPPTGSATSPAPPRWIVVGGEDEGLGLGGLRLDGPRLDGPGLAEALSEAGMGTERHRNLADALSAVRTPVDTAGSAAAAGTTSLIAVPVPQSPTMDAGAVRHAVHRALELVQGWVAADEAAEEGGSDGAAADRRLVLVTSGAVSTGDADPLRDPVAAAVWGLIKSAQSEQPGRIVLVDLDEGAVDGAALAAAISTGEPQLALRDGDVHVPRLAPLSVRDSQTLLPPAGTRAWHLVGAGTGTLSDLALVPAQTDTVALAPGQVRIAVRAAGLNFRDTLIALGMYPGEGVMGAEGAGVITEVGPDVVSLAVGDRVLGMWTDGFGPYVVADHRMVAPMPRDWSYAEAASVPAVFLSAYYGLRHLAGLRAGQSVLVHAAAGGVGMAAVQLARHFGAEVFGTAGTAKWDALRAQGLDDRHIAGSRTLDFADRFLDATEGRGVDVVLNSLAGDFVDASLRLLPRGGRFVELGKADVRDAAQVAADRPGTVYRAFELMEAGPELIGRMLNELLELFESGALRLLPVTPYDIRRAPDAFRTLSQAGHVGKLVLTMPPAFEPHGTVLITGGTGNLGGTLARHLVTEHGVRHLLLAGRRGPEAEGAAELVRELHDLGASVTVAACDVADRAALRKLLGGIPPERPLTGVVHAAGVLDDGVVTSLTPDRVDGVLRPKVDAALNLHEAALDPELGLDITAFVLFSSVAALLGGSGQGSYAAANGFLDGLAQYRRGRSLPALSLGWGLAGSGRMTSHLDSRALLRRMARGGVLPLSPAESMALFDAAQGFDEALQVPARFHTAALGADGNVPPLFNGLIRGGTAHAEARRRTVGASPAGGPAGGEPVNLADRLSGLTEDEQRALLLDTVRTHAALVLGHTGTDGIQADRAFKDLGFDSLTAVEMRNRLTAATGLHLAATLVFDHPAPADLAEHLRSRLVPEGTDVPPLLAELGRLETAFKKLTTADLASVVPDDIARDEIAVRLAALGSLWNGLHGNGLSGDAAQKHGDSIVEDIDSADDDEIFAFLDESFGDS

SEQ ID NO: 73888 - protein, 246 aa, Lactarius deliciosus var. deterrimus
DPRVKVLAVNDPFIDLQYMVYMFKYDSVHGRFKGTIEIKDGKLVIDGHPITVFQERDPANIQWGSVGADYVVESSGVFTTVDKASAHLKGGAKKVIISAPSADAPMFVVGVNLDAYDSKYTVISNASCTTNCLAPLAKVINDKFGIVEGLMSTIHATTATQKTVDGPSNKDWRGGRAVNGNIIPSSTGAAKAVGKVIPALNGKLTGLAFRVPTNDVSVVDLVVRLEKEATYDEIKLAVKEAADGPL

SEQ ID NO: 73889 - protein, 307 aa, Vitis vinifera
MCVLTEESSKMGIDLNRANLQGTLVKELSVLTDMSLLHLSGNRFTGTVPESFRYLLSLKELDLSNNHFSGPFPTVTLLMPNLIYLDIRFNNFAGPIPDDLFNKELDAIIINNNQFDGELPPNLGNSPASVINLANNKFSGNIPTSFAYMNPKLKEILFLNNQLTGCIPEGVGMWDGMEVLDLSHNSLMGHLPNSISCLEEIEVLNLAHNKLSGSLSDLVCSLRSIVNLTVAYNFFSGFGQECSKLFFRNVGFDFSVNCIPGRDMQRPQPDCSVIPGGGLNCLRIPSARPLICGLVGSPETDPSPSSP

SEQ ID NO: 73890 - protein, 152 aa, Brassica napus
  misc_feature (2)..(3): Xaa can be any naturally occurring amino acid
  misc_feature (12)..(13): Xaa can be any naturally occurring amino acid
  misc_feature (16)..(16): Xaa can be any naturally occurring amino acid
  misc_feature (19)..(19): Xaa can be any naturally occurring amino acid
  misc_feature (26)..(26): Xaa can be any naturally occurring amino acid
  misc_feature (29)..(29): Xaa can be any naturally occurring amino acid
  misc_feature (35)..(35): Xaa can be any naturally occurring amino acid
  misc_feature (40)..(41): Xaa can be any naturally occurring amino acid
  misc_feature (47)..(47): Xaa can be any naturally occurring amino acid
  misc_feature (49)..(49): Xaa can be any naturally occurring amino acid
  misc_feature (51)..(53): Xaa can be any naturally occurring amino acid
  misc_feature (63)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(85): Xaa can be any naturally occurring amino acid
  misc_feature (91)..(91): Xaa can be any naturally occurring amino acid
  misc_feature (100)..(101): Xaa can be any naturally occurring amino acid
  misc_feature (106)..(106): Xaa can be any naturally occurring amino acid
  misc_feature (108)..(108): Xaa can be any naturally occurring amino acid
  misc_feature (111)..(111): Xaa can be any naturally occurring amino acid
  misc_feature (125)..(125): Xaa can be any naturally occurring amino acid
MXXSMLSSAAVXXSPXQAXMVAPFTXLKXSAAFPXTRKAXXDITSIXSXGXXXTCMKVWPPDXKXKFETLSYLPDLTEVELXKEXDYLLRXKWIPCVEFXXEHGFXYXEHXSTPGYYDGRYWTMXKLPLVGCTDSAQVLKEVQECKTEYPNA

SEQ ID NO: 73891 - protein, 375 aa, Trametes hirsuta
MALSTKVPHLMTLADLTPGQIQRIITHSYHLKRTAQPWLAPQGRAGSGGKYSNAPHKLRMPSQSLFSKSIALLFSKRSTRTRLSAETAALLLGGQALFLGREDIQLGVNETCPDSARVIGGMCQGIFARVGDHSEIEELARYSPVPVLNALSSLWHPTQVLADILTLHEHAALFDPASASPTPSAADAFSQKYTKLGEVRPLTVAYVGDSANVLHDMLVTYPRLGHQLRVASPENDKYRAPKAVWDRVVELGCDKNIFWTADPRAAVKGADLVVTDTWISMGQEAEKAQRLKDFAGYQVTEALCREGGANPDWKFMHCLPRKQDEVDDEVFYGPRSLVFQESDNRKWTIMALFDLLFGKWSLLARNGEGADAGSE

SEQ ID NO: 73892 - protein, 139 aa, Francisella tularensis subsp. novicida
DEDVFKKLNKVIDTTITPIVCIGESLDDRQSGKLKEVLATQLSLILENLTVEQLAKVVIAYEPVWAIGTGVVASLEQIQETHQFIRSLLAKVDERLAKSIKIVYGGSLKAENAKDILSLPDVDGGLIGGASLKATEFNE

SEQ ID NO: 73893 - protein, 299 aa, Mycobacterium sp. JLS
MHAMVYHGPGRRSWEQVPDPEVQRATDAIVRVDAVTICGTDLHILKGDVPEVQPGRILGHEAVGTVIEIGSAVEKLAVGDRVLVSCISACGSCRYCRDGQYGQCLGGGGWILGHLIDGTQAEYVRVPFADNSTHKVPAGVSDEQMVMLADILPTSYEVGVLSAAVRPGDTVAIVGAGPIGLAAVLTAKLFSPSHIVVIDIAESRLEAAKNMGADVVVNSTSQDARSVLDELTDGLGADVAMEAVGMPETFEQAVRLVRAGGHVANIGVHGKPATLHLEDIWIKNLTITTGLVDTHSTPP

SEQ ID NO: 73894 - protein, 408 aa, Chromobacterium violaceum ATCC 12472
MALIVQKYGGTSVGTTERIKNVARRVAKWKAQGHDVVVVVSAMSGETNRLIALAKEIQDYPDPRELDVVVSTGEQVTIGLLAMALKEIGVPAKSYCGWQVKVVTDQAHTKARIQSIDDEAMRGDLKEGRVVIVAGFQGVDEEGSITTLGRGGSDTSAVALAAALKADECQIYTDVDGVYTTDPRVVPEARRLKTVTFEEMIEMASLGSKVLQIRSVEFAGKYKVRLRVLSSFEDEGEGTLITFEEDESMEKAVVAGIAFDRNEARINVKGVPDKPGIAYQILGPIADANIEVDMIIQNVGENGTTDFSFTVPRGEFNRALTILREVQTHIGAAKIDADDKVAKISIVGVGMRSHCGIASTMFRTLAEEGINIQMISTSEIKVSVLVDEKYLELAVRVLHKAFGLDQAA

SEQ ID NO: 73895 - protein, 433 aa, Arabidopsis thaliana
MRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRRERHV

SEQ ID NO: 73896 - protein, 508 aa, Triticum aestivum
MQPYLELASLRITATIPLSPRIYSTIFLEAMAAMAYIALRGAALAAIVALIHWVYRWRHPKCAGTLPPGSMGIPIIGETLQFFAPNPTCGLSPFVRDRVKRYGSMFKTSIVGRPVVVSADPDVNHYVFQNEGKLFESWYPDTFTEIFGRDNVGSLHGFIYKYLKTLVLRLYGQENLKAVLLAETDAACRGSLAAWAAQPCVDIKDGLSTMIFDLTAKKLIGYEPTKSSESLRENFTAFIRGLISFPLNIPGTAYHECMEGRKKAMKVLKGMMQERMADPERKCEDFFDHVIQELRREKPLLTETIALDLMFVLLFASFETTALALTLGVKLLTENPRVVDALTEEHEAIVRNREDPDAAITWAEYKSMTFTAHVIMEIVRLANIVPGIFRKALQDVEIKGYTVPAGWGIMVCPPAVHLNPDIYEDPLAFNPWRWQDKPEITGGTKHFMAFGGGLRFCVGTDLTKVLMATFIHNLVTKYRWKTVKGGNIVRTPGLGFPDGFDIQLFPKN

SEQ ID NO: 73897 - protein, 273 aa, Geobacter sulfurreducens PCA
MPFLQIDHNLTIHYDDEGDGFPLVLVHGWAMEGGVWAFQRPLASSFRVITVDLRGHGRSTAPGDGYGLADFAADIVVLFDELGLERAAIVGWSLGAQAALEAAPLLGDRLAALVLVGATPRFSATDGWLHGLPATECRGLGLRLRRTFDAALDGFFHSMFAEGELSDESERLIGQEITASWRRPAATAAQAALVTLAESDQRHLLEKIRVPTLVIHGDRDAICPLEAGAHLADHLPLGRFLLFAGTGHAPFLSRPREFNSEVTRFLREVAGDD

SEQ ID NO: 73898 - protein, 208 aa, Cynodon dactylon
MAAKSSEKGSNNGKESSMADVYRGELTPLQRHVAFFDRNKDGVIYPAETYEGFRAIGAGVPLSAVGAAFVNGFLGPKTIPENEKVGPFKFPIYVKNILKGKHGSDSGVYDAHGRFVPEKFEEIFKKHAHTRPDALTAKELQELLQANREPKDFRGWLGGFTEWKVLYALCKDKDGFLHKDTVKAVYDGSLFDKMEQERKAKKESAKKK

SEQ ID NO: 73899 - protein, 271 aa, Streptococcus pneumoniae TIGR4
MTNTSFSIEQFSLKGKIALITGASYGIGFAIAKSYAEAGATIVFNDINQDLVNKGIEAYREVGIQAHGYVCDVTDEDGIQAMVKQIEQEVGVIDILVNNAGIIRRVPMCEMSAADFRKVIDIDLNAPFIVSKAVIPSMIKKGHGKIINICSMMSELGRETVSAYAAAKGGLKMLTRNIASEYGGANIQCNGIGPGYIATPQTAPLRELQEDGSRHPFDQFIIAKTPAARWGNTEDLMGPAVFLASDASNFVNGHILYVDGGILAYIGKQPE

SEQ ID NO: 73900 - protein, 181 aa, Rhodopseudomonas palustris CGA009
MTPEFANDLKASVRAIPDYPKPGIIFRDITTLLGEPRAFRRAIDELVQPWAGSKIDKVAGIEARGFIIGGAIAHQVSSGFVPIRKKGKLPHTCVSMEYALEYGTDKIEVHVDAITPGERVILVDDLIATGGTAEGAIKLLRQIGAEVVAACFVIDLPELGGAAKIRAMGVPVRTLVAFEGH

SEQ ID NO: 73901 - protein, 420 aa, Triticum aestivum
TVPDYLDQKRIQKLLLLGPPSAGTSTIFKQAKYLYGSRFTQDELDAIKLMIQSNMFKYLGILLEGRERFEEEALSRLDQTNSEDEAAQKDENKANGSDSCIYSINARLKKFSDWLLDIIAMGDLDAFFPAATREYAPFVEEMWKDPAIQATYKRKDELHFLPDVAEYFLSRAIEVSSNEYEPSEKDVIFAEGVTQGNGLSFIEFTLDDRSPMSEPYIDNPEAHSQPLTKFQLIRVSAKGMNDGCKWVEMFEDVRMVIFCVALSDYDLVGTPVNGNLQNKMMQSKELFEATIRQPCFCDTPFVLVLNKYDLFEEKISRAPLTACEWFGDFSPVRTQSNNQTLAQQAYYYVAMKFKEAYNDHTGRKLFVWQARGRDGQTVDEAFKYIREVLKWEEDKDENYYQEESFYSTTEMSSSPFIRAE

SEQ ID NO: 73902 - protein, 365 aa, Zea mays
MMAACLEAKKPYLIALAIQIIGTGMFVISKAAFDDGMSTFVFIFYRMAAASLILVPTAIVHQRKNMRSMSGKLLLKLFLLALIGNTFSLNTYNLTLKLTSATVGSALANSVPVFTFCLVLVLRMETVNLRTAAGVAKAAGVALCVAGVLVLAFYAGPAMSPVNHHRAFAAPRQHAASTGGPPSRSRWITGTLLMVLANVTWALWIVLQSALLKEYPNRMLVTATQCVFSMMQSFVVAVVAERGDMSKWKLRCDITLVAVLYVGFVVTGLSHYLQAWCMELKGPVFLAMTNPLCFVFTIFSSSFFLGEIVHLGSILGGALLVAGLYSVHWGKLKEDRRSEAAEQEKTKPQEEPAAVAGVPSVLDQA

SEQ ID NO: 73903 - protein, 257 aa, Neisseria gonorrhoeae FA 1090
MYRQIGMWDQKWVIGNWKMNGRLQNNNALMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEERETGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 73904 - protein, 94 aa, Zea mays
  misc_feature (18)..(18): Xaa can be any naturally occurring amino acid
KRKKLPGGVISEEYFLEXGTDKIEMHVGAVQANDGVFVVDDFFAPGGTFWAAVKFIERVGAKVVECACVIEFPERRGGDKLGDGPVFVFVEADA

SEQ ID NO: 73905 - protein, 75 aa, secondary symbiont of Panaphis juglandis
GDFLMVGFEELATGHDHVALIFGDISGNKPVLARIHSECLTGDALFSLRCDCGFQLEAALAYIAEEGRGLLLYHR

SEQ ID NO: 73906 - protein, 414 aa, Methylococcus capsulatus str. Bath
MNTAPAAVPAFDVARIRTDFPILGQQVHGKPLVYLDNAATAQKPKAVLDCIAHVYGEDYANVHRGVHTLSQRATELFEGAREKVQRHLNARHSHEIVFTRGTTEAINLVAQSYGRPRFKAGDEILITAMEHHSNIVPWQMLCEQTGAVLKVVPIDRTGTLELDRFEALLSNRTRLLAVAHMSNALGTINPVETLIEQAHRRGVPVLVDGAQAIPHMAVDVQALDCDFYAFSGHKLYGPAGIGILYGKEELLNKMPPYQGGGDMIRRVTFEKTEYNTLPYKFEAGTPSIVDAIALGAAIDYVNGIGMETIAGHEQRLLAYATEQALRIPGLELFGQAAEKGAILSFTLHRIHPHDIGTILDHLGIAIRAGHHCAMPVMDFFGIPATARASFGLYNTFEEVDALIAGIHKVIEVFG

SEQ ID NO: 73907 - protein, 387 aa, Ralstonia eutropha JMP134
MIRARFTGILDRVQTTRHTRPERDTAMTKPSPASFRIAAIAGDGIGNEVLPEGLRVVEAAARKFDLLIEVRHFEWANCDYYLRHGKMMPDDWKQQLDGFDAIYFGAVGWPDKVPDHISLWGSLLKFRREFDQYVNLRPVRLLPGVPCPLAGKKPGDIDFYVVRENTEGEYSSVGGRMYEGTERELVMQQSIFSRHGTDRILKYAFELAQSRPRKKLTSATKSNGIAVSMPWWDERTAAMGAQYPEIEWDSQHIDILCARFVLQPERFDVVVASNLFGDLLSDLGPACTGTIGLAGSANLNPERKFPSLFEPVHGSAPDIFGKQIANPIGMIWSGAMMLDFLGGEAGRQAHDAILAAIETVLREGPLTPDAGGKAGTSDVGKAIAEAV

SEQ ID NO: 73908 - protein, 75 aa, Buchnera aphidicola
GDFLIFGFEEKKNGKNHIALVYGNIQKNIPILARVHSECLTGDAFFSLRCDCGIQLEIAMSKIASEGNGILIYHR

SEQ ID NO: 73909 - protein, 585 aa, Listeria monocytogenes EGD-e
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEILPAFEKSAAVVVEEGGLTSHAAVVGINLGIPVIVGAKDATSLVKDGEIITVDSRQGVVYNGKTATH

SEQ ID NO: 73910 - protein, 341 aa, Pseudomonas putida KT2440
MTEQQPVAVLGGGSFGTAVANLLAENGVPVRQWMRDPAQAEAMRVNRENPRYLKGIRLHDGVEPVNDLLATLQASELIFVALPSSALRSVLAPHAELLRGKGLVSLTKGIEAQSFKLMSQILEEIAPEARIGVLSGPNLAREIAEHALTATVVASEHEDLCQQVQAVLHGRTFRVYASADRFGVELGGALKNVYAIIAGMAVALGMGENTKSMLITRALAEMTRFAVSQGANPMTFLGLAGVGDLIVTCSSPKSRNYQVGYALGQGQSLEEAVNRLGEVAEGVNTLKVLKTKAQQVQVYMPLVAGLHAILFEGRTLNQVIEHLMRAEPKTDVDFISISGFN

SEQ ID NO: 73911 - protein, 539 aa, Arabidopsis thaliana
MAYASRIINHSKKLKDVSTLLRRENAATIRYYSNTNRAPLNREDIFNSRLGYPPLERISICSTSTLPVSIIFSTTRSNLSSAMGRPIFGKEFSCLMQSARGFSSGSDLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDTEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKENSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 73912 - protein, 361 aa, Thermosynechococcus elongatus BP-1
MATTYRIAVLAGDGIGPEITAVALDVLRAIAPRFGLDFDFVPALVGGCAIDAVGEPLPAATLATCRQSDAVLLAAIGGTQWDSLPRHLRPETGLLALRSGLGLFANLRPAKIFPQLLHASSLKPEVIAGVDLMVVRELTGGIYFGQPRGIFTTETGEQRGVNTMAYTATEIDRIGRVAFETARKRQGKLCSVDKANVLEVSQLWRDRLTALSAEYPDVELTHLYVDNAAMQLVRAPKQFDTIVTSNLFGDILSDIAAMLTGSIGMLPSASLGESGPALFEPVHGSAPDIAGQDKANPLAMVLSAAMMLRYGLNQPAAAQAIEEAITAVLDQGYRTGDLMSEGCTLVGCREMGNLLIKELSR

SEQ ID NO: 73913 - protein, 583 aa, Torenia fournieri
MGSYRVCMCFTRKFRVTEAEPTQDVKEVFKRYAGDGGTHMNAEQLRRFLVEVQGEPADSAGEAAEAIVRQILQKRHHIAKLTRQALALEDFHHYLFSTELNPPIHHKVHHDMTAPLSHYYIFTGHNSYLTGNQLTSNCSDVPIIKALKKGVRVIELDIWPNSTKDDVLVLHGRTVTTPVELIKCLKSIKEHAFIASPFPLIITLEDHLTSDLQAKVAQMLTQTFGEMLFCPESDCLSEFPSPEDLKHRVIISTKPPKEYLEAQNSLDKGNNSQKEKDSDEDVWGKEPSSLTAYEEDEDKIDVEVTDPDNSCDSKVYEPPVYKSLIAIHAGKPKGGIEEALKVEADKVRRLSLSEQALEKYAETHGADIVRSTQRNILRVYPKGTRFNSSNYKPQVGWLHGAQMVAFNMQGYGRSLWLMQGMFKANGGCGYVKKPDIFMDSNQLFDPKAEYSVKKTLKVKVYMGDGWHMDFKQTHFDAYSPPDFYTRIGIAGAPADEMMKKTKKKEDNWAPVWNEEFEFPLTVSEIAILRIEVHEYDMSEKDDFAGQTCLPVSESKPGIRAVPICDRKGEKYNSVRLLMRFEFV

SEQ ID NO: 73914 - protein, 371 aa, Nicotiana tabacum
MANEENKASPTNTSRASNNRAFDDTLAAASSNGNDPLLKRVVLGELTNLEYVVGSTKTNTHNSKRKIKLKKTAPTKRKKVAKQSFKSDAATNFSPNDDLQKCAYAPLIYQHLHSLEVEERRRPLSNYMEKIQNDVTPTMRMILVDWLVEVADEYKLVSDTLYLTVTFIDRFLSSHVLARNSLQLLGVSCMLAASKYEEISPPHVEDFCYITDNTYTGEEVVNMERELLNFLDFEISNPTTKTFLRIFTKAAQDNVDFLTLHFEFLGCYLTELSLLDYSCVQFLPSVVAASAIFLSRFTILPKVHPWNLALQQCTGYKPSELKDCVLVIHELQSGRRAASVQAVRKKYMDHKYKCVAALHPPDIPACFFDDA

SEQ ID NO: 73915 - protein, 250 aa, Physcomitrella patens subsp. patens
ATTIGMMDAAYFVGRNEILSWVNNTLELSLSKVEEAASGAVYCQLMDVVHPGMVSMHKVSFDAKSEYEMIQNYKVLQDVFNKLKIGRHIEVSKLVKGRPLDNLEFLQWMKRYCDQINDNQVNSAYNAAERREACKGGKETNRRALGMGYSSQSSNKPASSASVKASSGAARRVSAVNEDYVKQITELKLSVESLEKERDFYFTKLRDIEILCQAPELSHIPVVKAVQRILYAAEDEPSVIAEAKAMMEES

SEQ ID NO: 73916 - protein, 483 aa, Nicotiana tabacum
MATTQNRRSSVSSATAKRQAMTANSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 73917 - protein, 482 aa, Nicotiana tabacum
MATTQNRRNSVSSAVAKRQAMAENNHGKLPAGGAKKRPALTNISNHTTASARNSLSHSSKLAPCTSKVVSIKKNNSNAASSVLPTSSSFVKPISKTVSLPRSDAAVPKITAIPPLPSTCSMDISPSHSDGSLVSMDETMSTSNSLRSPDVEYIDDNQTAAFDSIEKKAFSTLYISEDVKAADICKRDVLVDMESGDKIANIDNNLVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVMALHSLCCNNNNSSLPAIREKYSQHKYKFVAKKYCPPTIPVEFFQNISC

SEQ ID NO: 73918 - protein, 110 aa, Cicer arietinum
QAYESVRDAFKRLTQNLRSAEGVAIFDTCYDLSSLRSVRVPTVSFHFGNDRVWDLPAKNYLIPVDSDGTFCFAFAPTSSSLSIIGNVQQQGTRVSFDIANSLVGFSPNKC

SEQ ID NO: 73919 - protein, 135 aa, Brassica napus
  misc_feature (118)..(119): Xaa can be any naturally occurring amino acid
MGKIPSSFRSLTSTQLIKKPTPPPPPRNSQNRITGTHHDSPKPPQTTPSRNPFKSPNLSSAKSLFNSIAATSKTPLDTKFHNSVLQSYASIATVDDAVKLFHHILKSQPSFSPEPSTXXILLSHACRSPDSPLSN

SEQ ID NO: 73920 - protein, 472 aa, Glycine max
MSMASLPNSPALSFSSSLSTTANLLPCRRFTAFPRRRASSFSVQAKIREIFMPALSSTMTEGKIVSWIKSEGDMLSKGDSVVVVESDKADMDVETFYDGILAAIVVADGETAPVGAPIGLLADSPEEVAEAKAKAAKSVPSGSPAPASPSDPSPATPPPPPPPAKSVSEGPAKIVATPQAKKLAKQHKVDIATVAGTGPFGRITPADVEAAAGIAPSKRNVAPAAIPAPATPAPPSKAASGSAAPAPIPGSSVVPFTTMQSAVAKNMMESLSVPTFRVGYPVTTDALDALYEKVKPKGVTMTAILAKAAAMALVQHPVVNATCKDGKNFVYNGNINVAVAVAINGGLITPVLQDADKLDLYLLSQKWKELVEKARAKQLQPHEYNSGTFTLSNLGMFGVDRFDAILPPGQGAIMAVGASKPTVLADKDGFFSVKNKMLVNVTADHRIIYGADLAAFLQTFSKIIENPESLTL

SEQ ID NO: 73921 - protein, 301 aa, Lactobacillus johnsonii NCC 533
MKVRKAVIPAAGLGTRFLPATKAMPKEMVPIVDKPTIQFIVEEAKKSGIEDILIVTGKNKRSIEDHFDANPELEQDLEEKGKTELLHLTQSITNLGVNLYYTRQPHPAGLGDAILRARSFVGDEPFAVMLGDDLMEDKVPLTKQLIDRYDKTHASTIAVMPVPHEEVSKYGVIDPDSEIEPGLINVKAFVEKPDVDKAPSDYAIIGRYLLTPEIFDILAHQKPGRGGEIQLTDAIDTMNKTQRVFAHVFNGERHDVGNKEGYLETSIEYGLSHPQIKDDLREYIINMAQKLQKEDKNSKKK

SEQ ID NO: 73922 - protein, 423 aa, Wolbachia endosymbiont strain TRS of Brugia malayi
MLKTFILIMNMENEKAHITKVKLPIFLDYQSTTKVDPRVLEMMIPYFSEFSNAHSRSHSFGWAAEEVVEKARRHIADLVNADSKEIIFTSGATESNNMAIKGVAHFYKNKGDHIITVCTEHKCVLDSCRHLENEGFKVTYLPVKRNGIIDLSKLEEAITDRTILVSVMMVNNEIGVIQPVKEIGAICRRHNVFFHTDAAQSFGKVPVDVNGMNIDLMSLTSHKVYGPMGIGALYVRRKSPRVRLTPLISGGGQERGMRSGTVPTPLAVGFGEAARIAKEEMKKEASKLEELRDILYNKIKEAFPDVVLNGDYNNRIPGNLNLSFPYVEGESLIMAIKDLAVSSGSACTSASLEPSYVIRSLNSGYDLEHSSIRFGLGRFTTKDEILYAADLIAKNVGRLREMSPLWEMVQEGIDLNTVKWDSH

SEQ ID NO: 73923 - protein, 274 aa, Lactobacillus johnsonii NCC 533
MITIKSKRELQGMQKSGRVLAAMFEGLRDVIKPGISTWEIEEFAQDFMKKHGGRLSEQGFEGYKYGTCISVNDEIAHAIPRKDKILKEGDLVSVDVTCNVDGYETDSCTTYGVGEISAEDKKLMDVTKKAMYMGIDQAVVGNRIGDIGSVIQNYVEDENGYGDVRELVGHGIQPSIHEDPEVPHWGKAGHGLRLREGMTITVEPMVEAGGDWRIEQKTVSDPNDDWVYYATPDGSKAAQFEHTFAITPDGPKILTLQKPYDGYEKYLPHFLDED

SEQ ID NO: 73924 - protein, 256 aa, Pseudomonas syringae pv. tomato str. DC3000
MNDQRKGSDAEPTTHFGYKNVPESQKAEKVAEVFHSVAAKYDLMNDLLSGGMHRLWKRFAIELSGVRTGNRVLDIAGGTGDLTRKFSNLVGPTGQVVLADINASMLKVGRDRLLDLGVSGNVEFVQADAEKLPFPDNHFDCVTIAFGLRNVTHKEDALRSMLRVLKPGGRLLVLEFSKPTNKLMSKAYDAYSFAFMPLMGKLVTNDSESYRYLAESIRMHPNQETLKSMMVDAGFDRVTYHNMTAGVVALHRGIKP

SEQ ID NO: 73925 - protein, 389 aa, Nostoc punctiforme PCC 73102; identical to SEQ ID NO: 1266

SEQ ID NO: 73926 - protein, 127 aa, Saccharomyces cerevisiae
  misc_feature (4)..(4): Xaa can be any naturally occurring amino acid
  misc_feature (43)..(43): Xaa can be any naturally occurring amino acid
  misc_feature (52)..(52): Xaa can be any naturally occurring amino acid
GSHXSAGIGESRTELLTWLNGLLNLNYKKIEECGTGAAYCQIXDSIYGDLPXNRVKFNATAEYEFQTNYKILQSCFSRHGIEKTVYVDKLIRCKFQDNLEFLQWLKKHWIRHKDESVYDPDARRKYR

SEQ ID NO: 73927 - protein, 819 aa, Pyrococcus abyssi GE5
MAYRFIKWFEELRKEDVPLVGGKGANLGEMTNAGIPVPPGFCVTAEAYKYFVENVKISKEDVKRILGEKANKGTIAEVLAQAPDEPRPLQEWIMDIINRTNVDDSKQLQENTAVIRELIKSLDMPAEIADEIKQAYKELSQRFGKDEIYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVTVKVAEYLGPEWVEKQVLTDEQIIEVAKMGQKIEEHYGWPQDIEWAYDKDDGKLYIVQSRPVTTLKETTTEEVEEVEEAEVILKGLGASPGIGAGRVVVIFDASEIDKVKEGDVLVTTMTNPDMVPAMKRAAAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIARSVGLEPHKDVAWGIMIEVPAAAIIIEDLIKEGIDFVSFGTNDLTQYTLAIDRDNERVAKLYDETHPAVLKLIKHVIKVCKRYGVETSICGQAGSDPKMARILVRLGIDSISANPDAVQLIRQVVAQEERKLMLEAARKRLFEEEEEEEEFLF

SEQ ID NO: 73928 - protein, 367 aa, Arabidopsis thaliana
MESDSEMVPFPQLPMPIENNYRACTIPYRFPSDDPKKATPNEISWINVFANSIPSFKKRAESDITVPDAPARAEKFAERYAGILEDLKKDPESHGGPPDGILLCRLREQVLRELGFRDIFKKVKDEENAKAISLFPQVVSLSDAIEDDGKRLENLVRGIFAGNIFDLGSAQLAEVFSRDGMSFLASCQNLVPRPWVIDDLENFQAKWINKSWKKAVIFVDNSGADIILGILPFARELLRRGAQVVLAANELPSINDITHTELTEILSQLKDENGQLLGVDTSKLLIANSGNDLPVIBLSRVSQELAYLSSDADLVIVEGMGRGIETNLYAQFKCDSLKIGMVKHLEVAEFLGGRLYDCVFKFNEVQS

SEQ ID NO: 73929 - protein, 432 aa, Arabidopsis thaliana
MAKRVNTCKCVATPQEKIEYKTKVSRNSNMSKLQAGYLFPEIARRRSAHLLKYPDAQVISLGIGDTTEPIPEVITSAMAKKAHELSTIEGYSGYGAEQGAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGRTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSGFGPGGEGFVRVSAFGHRENILEACRRFKQLYKHHHHHH

SEQ ID NO: 73930 - protein, 639 aa, Ehrlichia ruminantium str. Welgevonden
MFVRVLNTLLILICCFIISCSNKTKYQFSRKYSPVYNPGGESFESNQEFSRAYSVYKERRDALVGDGNQQNVSKKKYGKLDNKHINRYDPIQDDGLSESKDLQLMVDSNGINLADVAGARFVQSIDDDYENDNVIKKHNDLQDKSGKLSKKNVKHVSSKSVSKKLDVKEKLLDDHVPVEEKYEAVEKDKAKVSTESKSSELDKSKVHIKEDNSKSLPEDTSKLDISKLPAIKEDKAKLSTESKSSELDKSKVHVKEDKSKSLPEDTSKSDVSELPAIKEDKAKLSTESKSSELDKNKVHIKEDKSKSLPEDTSKSDVSKLPAIKEDKAKLSTEGKSSELDKNKVHVKEDKSKSLPEDTSKLDVSKLPAIKEDKAKVSTESKSSELDKNKVHVKEDKSKSLPEDTSKSDVSKLPAIKEDKAKLSTESKSSELDKNKVHIKEDKSKSLPEDTSKSDVSKLPAIKEDKAKVSTESKSSELDKNKVHVKEDKSKSLPEDKSKLDISKLPVVEGKDHSNTDESKLHLLLDFSKDNDKEKDLGNHQPLKGDNNSKTIINDHKDSKQDTTHKVTHFLPELSEQNVTKDVEKNNSKGPGDNNLPLSDNVNKKYDNKNQQKSVKQHDKKDVKVKEEYDEDYSITYYYE

SEQ ID NO: 73931 - protein, 147 aa, Gibberella zeae PH-1
MFRSAVLRSLRVAARPAAVRSFAAPRVASVAVPKIQSFQAVRFYSAGGALNKDEVEGRIMSLLQGFDKQLPNSIEAEANVIFKVNDVSNIKSSAHFANDLGLDSLDTVEVVMAIEEEFSIEIPDKDADSIHSVNQAVEYILNQPDAA

SEQ ID NO: 73932 - protein, 467 aa, Oryza sativa Japonica Group
MVLTHVEAVEEGSEAAAAVFASRYVQDPVPRYELGERSISKDAAYQIVHDELLLDSSPRLNLASFVTTWMEPECDRLILEAINKNYADMDEYPVTTELQASNQTNQTIYPRLLHILSLHCVVVDRGCSMRRLGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGWGYKSVMKNCMESARTLREGLEKTGRFTIISKEEGVPLVAFTFKDGAGAQAFRLSSGLRRYGWIVPAYTMPAALEHMTVLRVVVREDFGRPLAERFLSHVRMALDEMDLAARAPVPRVQLTIELGPARTAGEEASIRVVKSEAVPVRKSVPLVAGKTKGVC

SEQ ID NO: 73933 - protein, 278 aa, Pseudomonas chlororaphis
MHHYVIIDAFASAPLEGNPVTVFFDADDLSATQMQRIAREMNLSETTFVLKPRNCGDALIRIFTPVNELPFAGHPLLGTAIALGAHTDNHRLFLETQMGTIAFELERQNGSVVAASMDQPIPTWTALGRDVELLKALGISDSTFPIEIYHNGPRHVFVGLPSIAALSALHPDHRALSSFHDMAINCFAGAGRRWRSRMFSPAYGVVEDAATGSAAGPLAIHLARHGQIEFGQQIEILQGVEIGRPSLMFARAEGRADQLTRVEVSGNGVTFGRGTIVL

SEQ ID NO: 73934 - protein, 373 aa, Glycine max
  misc_feature (253)..(253): Xaa can be any naturally occurring amino acid
MANLPNSKLYGKEKMKGEQELEDEESFSRAMLLCSSVVVSMALQSATELGVFDVLQEAGAKLSAKEIASKLSCDNNPEADSMLDRLLALLASHSILNCSLILDHQNLGTFQRLYTITPVARFFARNSDGVSLGPLMALLQDKIFLHSWSELKDSIREGGIPFNRVYGTHAFEYPRLDARFNQVFNTAMINHTTIVMKKVLECYKGFENIKMLVDVGGGLGININLITSKYPHIQGINFDLPHVLEHAPSYPGXVEHVGGDMFENVPKGDAIFMKWILHDWSDEYCLKLLKNCYDAIPDDGKVIVVEAVLPIIPETSNAAWKAVSQTDVLMMTQNPGGKERSDQEFMDLATAAGFSGIRYECYVRTFWIMEFFK

SEQ ID NO: 73935 - protein, 240 aa, Zea mays
  misc_feature (64)..(64): Xaa can be any naturally occurring amino acid
MAATTPTTNNAPLLLLLLLLAVLPIAALSSRAGPPAAHKSHGHGHGHDHGHGHRPSAKHPPPPXSPSSSLTPPPPPPAAALVRTTCNSTSYYALCVSALAADPSSATADVRGLSAIAVSAAAANASGGAATAAALAANGTAPAGTATSAADSAVQALLQTCAAKYASARDALAAAGDSIALDDYDSASVHVSAAAEYPQVCRTLFRRQRPGQYPAELAAREETLGQLCSVSLDIIALLSS

SEQ ID NO: 73936 - protein, 384 aa, Nicotiana tabacum
MKKQEKEAIMADLENCGRVTRLAKKRAAEAMASHQQQHPSKKRVVLGEIQNFSNLGVSQIKGLNTEPKKQPKSKQQQSKRKLKRAVTSKIDKEELNVDNVDANYDDPQMCSAYVSDIYDYLRKMEIEEKRRPLPDYLEKVQKDLSPNMRGVLVDWLVEVAEEYKLLSDTLYLAVSYIDRFLSTNVITRQKLQLLGVSSMLISAKYEEISPPHVEDFCYITDNTYTKEEVVKMEADVLKTLNFEMGNPTVKTFLRRFTGVAQEDYKTPNLQLEFLGYYLAELSILDYSCVKYVPSLLAAAVVFLSRFTLQPNTHPWSLALQQYSGYKAADLKECILILHDLQLSRRGGSLAAVRDKYKQHKFKCVSSLTSPVEIPASFFEDMRQL

SEQ ID NO: 73937 - protein, 461 aa, Thermosynechococcus elongatus BP-1
MTYDYDLFVIGAGSGGLAASKRAASYGARVAIAEGDKVGGTCVIRGCVPKKLMVYGSKFSHLFEDAVGYGWHPVKAKLNWERLIRAVDQEVNRLSQLHISYLEKAGVELLPFFARFADPHTLELVDRQGQVQGRVTAAKILIAVGGEAIKPNVPGIEHSITSREMFLLPKQPKRLAILGGGYISVEFAGIMQGLGTEVIHFLRGDRPLRGFDQDIQDGVYGGMIRHGIDVRPQCHITGLKLTKKGNIRIRYEQQGQTRETKVDTVLCAVGRAPNLQGLGLDRAGVHLRTNRQGIVAIAVDEYYRTNQEHIFAVGDCTNRVNLTPVAIAEGRAFADTQFGNLPRTLSYENIPSAVFSQPEAASVGLSEAQAKAKLGEENVKIYRAAFRPMYHSLTGRPEQVIVKLVVENNTERVLGAHMVGDNAAEVIQGIAIALKMGATKKDFDATLGIHPSTAEEFVTLR

SEQ ID NO: 73938 - protein, 388 aa, Pseudomonas putida KT2440
MNLHEYQGKQLFAEYGLPVSKGFAVDTPEQAAEACDKIGGNEWVVKAQVHAGGRGKAGGVKLVRSKEDAKAFAAQWLGKNLVTYQTDANGQPVSKILVESCTDIAKELYLGAVVDRSSRRIVFMASTEGGVDIEKVAHETPEKILKATIDPLVGAQPFQGRELAFQLGLEGKQVQQFAKIFVGLAKLFKDHDLALLEVNPLVIKADGDLHCLDAKINIDANAMYRQPKLKTFHDPSQDDAREAHAAKFELNYVALEGNIGCMVNGAGLAMGTMDIVNLHGGKPANFLDVGGGATKERVTEAFKIILSDSNVAAVLVNIFGGIVRCDMIAEGIIGAVKEVGVKVPVVVRLEGNNAELGAKVLAESGLNIIAATSLTDAAQQVVKAAEGK

SEQ ID NO: 73939 - protein, 316 aa, Listeria monocytogenes EGD-e
MTMYAKNNTSGKDMLSLLEWNKEELTDIIKLAVAMKTNPAHYSHILSGKILGMIFDKPSTRTRVSFEAGILQLGGQAIVMSSKELQIGRGEPIKDTAHVMSEYIDAIMIRTFSHEKVEELAYHAEIPIINGLTDLHHPCQALADLMTIYEWKDQLEGIKLAYIGDGNNVCHSLLLAGAMVGIDIRLAMPKGYEVDETILAKAENLAKQSGGKIFVTEDSKLAVTDADFIYTDVWTSMGQEDENAKRLADFGEKYQVNAELVSGAKPDYHFLHCLPAHREEEVTTEIIDGIHSVIYQQAGNRLHAQKALLAAILEAK

SEQ ID NO: 73940 - protein, 369 aa, Picea sitchensis
MESCKQPDLDNALHFEKTRGQYDSDFGDTDSELIPGLPHDIGILCLARVPRRDHQLLKCVSKKWRDFISSELYFYRQRLGIADGWIYAVCRDSSECVHCYVLDPARRKWKKLPGLPYACSKRFGMTCEVLGRKLYLLGGCGWTEDATNEVYCYDPLLNKWENVANMETARFHFVSGASDGCLYAIGGMGSNSEALTSWETYDSEANKWTSHEDLNILPDLGESLAFDSRIYIRHISTNVFPATYAAVYDTSNDVWSPVDNEMTMNWCGPAIVVGDDVYMLDQTAGIKLMMLDKENQSWVSVGRISTYLIKTPCRITAIGNTLFVIGRGLQTLMLDLDKVGRVKGTLMTTSIPGLDSVDDIIVSCKTIAI

SEQ ID NO: 73941 - protein, 237 aa, Lolium perenne
MDMTGSEQWSSPSLSSSSQEQGAAVWVTPPKRPAGRTKFKETRHPVYRGVRRRGNAGRWVCEVRVPGQRGERLWLGTYLTAESAARAHDAAMLGLLGRSASACLNFADSACVLIVPPALSDLAAVRRAALAAVAGFLRREAASGAATVPTEEAILSASADNADGSSATLQPYADGMFEVPTALGSDMFELDMSGEMDLGTYYADLAEGLLLDPPPPEHSSACWDTGDGGADPALWSY

SEQ ID NO: 73942 - protein, 240 aa, Gloeobacter violaceus PCC 7421
MRRKVLAGNWKMYKTRGEARAFLEAFVPLISPGAENREVILCGPFTCLDLLSAQAGPYAVGAQNVHWADHGAYTGEIAPQMLVELGVHYVIVGHSERREYFNETDSTVNRRLNNAQDHDLVPILCVGETESVRKDGITEAHIRSQLDRDLELVDMRRLIIAYEPIWAIGTGKTCEANEANRVCAMIRKHVNFEGVPILYGGSVKPENIDELMAQSDIDGVLVGGASLEAKSFARIVNFEV

SEQ ID NO: 73943 - protein, 478 aa, Pseudomonas putida KT2440
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQAVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLASDSGVTIDERGYIFVDDYCATSVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 73944 - protein, 386 aa, Listeria monocytogenes EGD-e
MKHVFPTYKRFPIDLVNGTGTVVTDKNGKTYLDFTSGIAVCNLGHCPTNVAEAVQQQLGNIWHTSNLYECALQDSVAELIADGKERLVFFCNSGTESNEAALKLARKYTGKEKIITFEKSFHGRTFGSMSATGQAKIHQGFGELVPGFTYVPYNDIEAFRAEIDENTAAVMLEVIQAEGGVIPANAAFLLEVQLLCKKMGALLIIDEVQTGLGRTGTLYGFEQIGLDPDIFTLAKGLGNGLPIGAMVGKSDLISAFGPGSHGSTFGGNKLALAAAKEILLTMKQTGFLEEVNAKADYFRNLLEANLEVLDNVSDIRGGGFLIGIELENAAEPVITELRDKGLLILTAGTNVLRILPPLTVSYAEIDQAIYLLKSVLENQLIGSEEG

SEQ ID NO: 73945 - protein, 250 aa, Listeria monocytogenes EGD-e
MENTIVIKLGGVASDNLTEGFFRQITEWQAANKKIVLVHGGGHYITKMMEALAIPVETKNGLRVTNKATLEVTKMVLIGQVQPAITTAFQKRNISVIGLNASDTGLLEADRLSDTDLGLVGKITKVKTNLIEQLLSENIITVIAPLGINSEHDWLNVNADTAACEVASALHAEALYLLTDVPGVKNGSEIIGEIATAEIEKLQSTGVIKGGMIPKLASAAFAAENGVGQVIITDSLNNSGTKIKNKVAIG

SEQ ID NO: 73946 - protein, 381 aa, Oryza sativa
  misc_feature (94)..(94): Xaa can be any naturally occurring amino acid
  misc_feature (225)..(225): Xaa can be any naturally occurring amino acid
  misc_feature (232)..(232): Xaa can be any naturally occurring amino acid
  misc_feature (245)..(245): Xaa can be any naturally occurring amino acid
  misc_feature (262)..(262): Xaa can be any naturally occurring amino acid
MDHHQRWHPAGNEREFIERALQSDLRVNGRRPFDFSRLKILFGREDGSAEVQLGDTSVMGYATAQLVKPNKDRANEGTLAIFTEFSPMGDPAFXPGRPGETAIELGRVVNRGLRESRAVDMESLCVVAGKHVWSVRVDLHMLDNGGQLNVHDAMVLSLMNLIDAANIAAVAALSTFRRPECTAGWEDGRAATLHDPDVRDPLPLTIHHHPIAVTFAYLGECHIMXVIDPTYXSEAVMGGRMNATXHSNVDVCPTRKLGGRGXMSNVNVNWLKIAWIKRAQKGGINQEGGGETPMGRFLAGVWLLLEGENLGLPASQGFSFIGGVGFFPKGSPFGEKSHPPLGPGTGHKHKELFSPPPGGKKKKKGFFLALFFYRKELYQKW

SEQ ID NO: 73947 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTHQRNPQEALDQSLQRLGLDYVGLYLVHWPVPLRTENIKDGNLFQFAEKPDGSKDVDLEWNFIKTWELMQKLLESGKTKAIGVSNFSVNNLKDLLAAPTTKVTPAVNQVEFHPLLPQEELIQYCSEKGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 73948 - protein, 320 aa, Rhodococcus sp. RHA1
MARFDSLIDTLGDTPLVGLPRLSPSWNGTAPVRLWAKLEDRNPTGSVKDRPALRMIEQAENDGTLTPGATILEPTSGNTGISLAMAAKLKGYQLICVMPENTSVERRQLLAMFGAQIIDSPARGGSNQAVAVAKELSAEHPEWVMLYQYGNPANALAHYETTGPEILRDLPEITHFVAGLGTTGTLMGVGRYLREHVDGIEIVAAEPRYGELVYGLRNIDEGFVPELYDESVLTSRFSVGPADAVRRTRQLIDNEGIFAGISTGAILHAALGVARKAVKAERAANIAFIVADGGWKYLSTGAYGGTVEEAEEALEGQLWA

SEQ ID NO: 73949 - protein, 242 aa, Lolium perenne
MDMTGSEQWSSPSLSSSSQEQGVPVWVTPPKRPAGRTKFKETRHPVYRGVRRRGNAGRWVCEVRVPGQRGERLWLGTYLTAESAARAHDAAMLGLLGHSASSTCLNFADSAWLLDLPPTLSDLAHVRRAALAAVAGFLRQEADSGAATVRADEAAYSASVPSSVDNAGGLSATSQPYADGMFELPSALNSDMFELDMSGEMDLGTYYAGLAEGLLLDPPPPEHTSACWDTGDGGADSALWSY

SEQ ID NO: 73950 - protein, 236 aa, Lolium perenne
MDTGIDGWTSCSLSPSTPEHGAAHAHPKRPAGRTKFKETRHPVYRGVRRRGSAGRWVCEVRVPGKRGERLWLGTYVAAESAARAHDAAMLALRGCSASVSALASLNFPDSAWLLAVPPWLSDLAAVRRAAVEAVAVFLRRELADGAVAVVPVYEATSTESISSSVQNADGLFEVPTFSALDLGSDLFELDMSGEIDLDTYYAGLAEGMLLEPPPTPYWESRECGNGGGGDAALWSY

SEQ ID NO: 73951 - protein, 389 aa, Nostoc punctiforme PCC 73102
MKAVCWHGANDVRVETVPDPKILNPRDAIVKITSTAICGSDLHIYDGYIPTMQKGDILGHEFMGEVVELGSAVKNVNVGDRVVVPFTISCGSCFFCNRDLWSLCDNSNPNAWLVKKQMGHSPAGLFGYSHLFGGYAGGQAEYARVPFADVGLFKIPDGLTDEQVLFLTDIFPTGYMAAENCNIKPGDIVAVWGCGPVGQFAIKSAYMLGAERVIAFDRIPERLQMAKEYGKAEVLNYEEVNIGEALKEMTGGRGPDACIDAVGMEAHGTDFMAFYDQVKQAVRLETDRPTALRQVIVSAAKGGHVSLVGVYGGFLDKIPMGAAMNKGLTFKMGQTNVHKYLKPLLEHIQNGEIDPTFIITHTLPLEQAPHGYEIFKHKKDNCIKVVLKP

SEQ ID NO: 73952 - protein, 242 aa, Lolium perenne
MDAGHDNWITTPSSSTSSRENAMAPKRPAGRTKFKETRHPVYRGVRRRGSAGSWVCEVRVPGRRGERLWLGTHVTAESAARTHDAAMLAMRGSSAASSCLNFADSASLLAVPSPLFEFADVRQAALAAVADFQRRNAANGPPAASAGAVVEATSSSSAPSPGDNTGSSTASSEATADGLFEVPAALGSYMFELEMSGEMDLGTYYADLAEGLLLDPPSPAGTEACWENGDHGGADAALWSYH

SEQ ID NO: 73953 - protein, 507 aa, Acidovorax sp. JS42
MDASTSQAVKAPTVKLLIGGQFVESKTTQWRDVVNPATQQVLARVPFATPDEINAAVASAKDAFKTWKKTPIGTRARIFLKLQQLIRENMKELAALLTAEQGKTLPDAEGDVFRGLEVVEHAANIGTLQLGELANNVANGVDTYTLMQPLGVCAGITPFNFPAMIPLWMFPMAIATGNTFVLKPSEQDPMVTMRLCELALEAGVPPGVLNVIHGGEDAVNAICDHPDIKAISFVGSTKVGTHVYNRASLNGKRVQCMMGAKNHAIVMPDANKEQTLNALAGAAFGAAGQRCMALSVAVLVGEARNWIPELVEKAKTLKVSAGTEPGTDVGPLVSCAALSRVEGLIERGIADGATLELDGRKPQVAGYEKGNFVGPTIFSGVKPGMSVYDQEIFGPVLCLAGAEDIDEAIEFINANPNGNGTAIFTQSGAAARKFQEDIDVGQVGINVPIPVPVPLFSFTGSRASKLGDLGPYGKQVVLFYTQTKTVTARWFDDSTTSHGVNTTISLK

SEQ ID NO: 73954 - protein, 289 aa, Geobacter sulfurreducens PCA
MERFFIVGCGDIGKKVARIALADGAGVAALIRSPEKAESLREMGVTALEANLDERDSLAGMPTRGAVVFYFAPPPGGGVTDPRVRAFCDAIAPGEEPRKIVYLSTSGVYGDCGGDVVTEETPPNPQTSRARRRYDAETVFRQWGAERGVPVVILRVTGIYGPGRLPLQQLTSGQPVLEESLAPFTNRIHSEDLARICLAAAEHGEDGDIFNVSDGHPTTMTAYFDACADALGLPRPRRVTLEEARRVMTPLMFSYVTESRKMDNRLMREKLHVTLLYPTMQEGVRSSVA

SEQ ID NO: 73955 - protein, 170 aa, Triticum aestivum
  misc_feature (88)..(88): Xaa can be any naturally occurring amino acid
  misc_feature (110)..(110): Xaa can be any naturally occurring amino acid
  misc_feature (115)..(115): Xaa can be any naturally occurring amino acid
  misc_feature (134)..(134): Xaa can be any naturally occurring amino acid
  misc_feature (151)..(151): Xaa can be any naturally occurring amino acid
  misc_feature (156)..(156): Xaa can be any naturally occurring amino acid
  misc_feature (158)..(159): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKWVPCXLRFSKVGFRLPVSTTSSPGYYXGRYWXTMWKLPMFGCTDATQVLNXWRSQEGVPDPIPCIGFXTAQVXCXXYRKHKLQDPAG

SEQ ID NO: 73956 - protein, 432 aa, Arabidopsis thaliana
  misc_feature (30)..(30): Xaa can be any naturally occurring amino acid
  misc_feature (78)..(78): Xaa can be any naturally occurring amino acid
  misc_feature (138)..(138): Xaa can be any naturally occurring amino acid
  misc_feature (162)..(162): Xaa can be any naturally occurring amino acid
  misc_feature (181)..(181): Xaa can be any naturally occurring amino acid
  misc_feature (242)..(242): Xaa can be any naturally occurring amino acid
  misc_feature (244)..(244): Xaa can be any naturally occurring amino acid
  misc_feature (263)..(263): Xaa can be any naturally occurring amino acid
  misc_feature (331)..(331): Xaa can be any naturally occurring amino acid
MAKRVNTCKCVATPQEKIEYKTKVSRNSNXSKLQAGYLFPEIARRRSAHLLKYPDAQVISLGIGDTTEPIPEVITSAXAKKAHELSTIEGYSGYGAEQGAKPLRAAIAKTFYGGLGIGDDDVFVSDGAKCDISRLQVXFGSNVTIAVQDPSYPAYVDSSVIXGQTGQFNTDVQKYGNIEYXRCTPENGFFPDLSTVGRTDIIFFCSPNNPTGAAATREQLTQLVEFAKKNGSIIVYDSAYAXYXSDDNPRSIFEIPGAEEVAXETASFSKYAGFTGVRLGWTVIPKKLLYSDGFPVAKDFNRIICTCFNGASNISQAGALACLTPEGLEAXHKVIGFYKENTNIIIDTFTSLGYDVYGGKNAPYVWVHFPNQSSWDVFAEILEKTHVVTTPGSGFGPGGEGFVRVSAFGHRENILEACRRFKQLYKHHHHHH

SEQ ID NO: 73957 - protein, 498 aa, Francisella tularensis subsp. tularensis SCHU S4
MSILKELDLGLQAYITNDTNNVIETLNPATGELLAKVRNQSVTTMQEAIAKATEVAKQWRQVPAPKRGELVRLIDEELRRNKDHLGSLVSLEMGKSKQEGDGEVQEMIDMADFAVGQSRMLYGMMMNSERHNHRMYEQWHPLGVVGVISAFNFPVAVWSWNAFIAVICGNTVVWKPSEKIPLCSIAVHNICQKVIKEHNYPEIFYTVISKDVEVSKTLVNDERVNLVSFTGSTKVGQDVGQQVAKRFGKSILELGGNNATIIDESANLKLAIPAAVFGAVGTAGQRCTSLRRLFIHESIYDLVKEKMVNAYKQVKVGDPLDQANLMGPLIDQAAVDNFTRTVEQAINQGGKVLTGGKSIAKPGFFVEPTIIEANHNMPIVAEENFCPILYIMPFKDIDEAIALNNSVIYGLSSSIFTDNLQNAEKFLSSLGSDCGIANVNIGTSGAEIGGAFGGEKHTGGGREAGSDAWKAYMRRQTSTINYGKDLPLAQGIKFNLGE

SEQ ID NO: 73958 - protein, 259 aa, Francisella tularensis subsp. tularensis SCHU S4
MSVDILDKLWDQYIRDNPHAKEIYDLFVNNGENPINDHIALRTLDDDRINIYKLAEVFIDKGYSICDDYDFAVKHLEHSDKTQPKVFISQLLTNEFSEELQQTLKRCVDLIPQQLLNNPENLLLSGVSWQIDYATYQKLLEESEYAAWFYAFGFRANHFTVFINNLKKFSEVSQVNTFLKENGFRLNSSGGEIKGSKDELLEQSSTMSGLAEVNFKDGKREIPSCYYEFAKRYPDNSGKLYQGFVAKSADKIFESTNTK

SEQ ID NO: 73959 - protein, 1437 aa, Pyrococcus abyssi GE5
MRDMEEVREVKVLEKPWVEKYRPQKLEEIVGQEHIVKRLKHYVKTGSMPHLLFAGPPGVGKCLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHNTTAALALARELFGENWRHNFLELNASDERGINVIREKVKEFARTKPIGGASFKIIFLDEADALTQDAQQALRRTMEMFSSNVRFILSCVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHNCNYSSKIIEPIQSRCAIFRFRPLNDEDIAKRLRYIAENEGLELTEEGLQAILYIAEGDMRRAINILQAAAALDRKITDENVFLVASRARPEDIREMMLLALKGNFLKAREKLREILLKQGLSGEDVLVQMHREVFNLPIDEPMKVYLADKIGEYNFRLVEGANEMIQLEALLAQFTLIGKKK

SEQ ID NO: 73960 - protein, 174 aa, Francisella tularensis subsp. tularensis SCHU S4
MTKKVPNVTFKTRVRDESIGGSNPFRWQDVTSADIFDNKRVIVFSLPGAFTPTCSTYQLPGFENNAARFKELGIDEIYVLSVNDSFVMNKWIQVQGIQNIKPIPDGNGEFTEALDMLVDKSNIGFGKRSWRYAMIVNNGEIEKMFVEPGKRDNADNDPYGESSPENLLKYLESK

SEQ ID NO: 73961 - protein, 479 aa, Pyrococcus abyssi GE5
MPEVPWVEKYRPRRLSEIINQEDAISKVKAWIEAWLHGNPPKKKALLLAGPPGSGKTTTVYALAREYNFEVIELNASDERTYDKIARYVQAAYTMDILGKRRKIIFLDEADNIEPSGAPEIAKLIDRARNPIIMAANHYWEVPKEIRDRAELVEYKRLTQRDVINALVRILKREGITVPKEVLVEIAKRASGDLRAAINDLQTVVAGGYEDARYVLAYRDVEKTVFQALGLVFASDNAKRAKLAMMNLDMSPDEFLLWIDENIPHMYLKPEEMARAYEAISKADIYLGRAQRTGNYSLWRYAIDMMTAGVAVAGTKKRGFAKFYPPNTLKMLAESKEERSTRNSIIKKIMSEMHMSKLEAIETMKIIKTIFEKNLDLAAHFTVFLGLSEKEVEFLAGRENAGTIWGKALAIRRKLKKEEEKIRKERKEEEKVEVREEKPEEKVEEKREERETKKEKEKKEEKKAEKKGKQVTLFDFIKK

SEQ ID NO: 73962 - protein, 421 aa, Ehrlichia ruminantium str. Welgevonden
MANVKINNISARQILDSRGYPTIEVQITLSNNVFAKASIPSGASVGKFEAVELRDHDTNYYHGYGVTKAVNLINSEIGQKIIKLETLDQEKIDNALIEIDGTNNKSRVGANSILAISLAVAKAAASTLNIPLYQYLGGITAKILPTPLINIINGGMHADNNLDFQEFMIIPHGANSFEDAIRMSSEVFHTLKKILKQKQYNTNVGDEGGFAPNIKDNTEVFDIIIDAIEKSGYKVYKDFSLGLDVAASTFYKNEKYKFSDYQFSTHELVEYYKNIVTQYPIISLEDPIAEEDTLGWKMITKELGDKIQIVGDDLFVTNCKLIKNGIDNNMANAVLIKPNQIGTLTETLNAIRLAQKNNYNVILSHRSGETNDTTISHIAVAVNCGQIKTGSLSRSERLAKYNELLYIEKLLNTSAIYQGML

SEQ ID NO: 73963 - protein, 307 aa, Zea mays
MAGILAWAADVVGGAGGSDDEADDDARAAASAAMTPAQRLRAADLDARAASLRRAIQDLRLRVPPPHVAQRLPHLHADSLASSAALALQLNAHSSTKEQEMEVTEHNLKTQLENALKELEAAQHKASTATSGTAENALLEAKSVTDLKSKDLEEKKRELELLDNKVQTLEKEWSVVEEESLKKPTPAQREKVLERQLHSLIEQLTAKQAQAEILATDVHSKEKELERLNHLHRNLYGGANETGAPRSRLSRGLLSGPEDYYYDPKAGRKPYQAGVRTEGQNRLMILRSAIVLYVLLLHVIVFIKISV

SEQ ID NO: 73964 - protein, 283 aa, Bacillus cereus E33L
MIRVGYLGPEATFTNMAVSRFFPEAEHVPYRTIPDCMDAAANGNVDYAVVPLENAIEGSVNITVDYLVHEQPLSIVGEITVPIQQHLLVHPQYAEVWEEVYAVHSHPHAIAQCHKFLNEELKGITARDMTSTSAAAQYVKEHPEEKIAAIANEAAAEKYGLTIVRRGIHTHKNNHTRFLVLHKKKKAILPNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 73965 - protein, 175 aa, Oryza sativa
  misc_feature (149)..(149): Xaa can be any naturally occurring amino acid
MSEAPVLDNWGDYFYNISPYSWAYVGIGIALGASVIGAAWGIYISGASILGAAVKAPRIRSKNLVSVIFCEAVAIYGVIMAIILQGKINQSECLNYAQCAFSGYALFWTGISVGFSNLFCGICVGISGSGCAIADAQNPDSFVKILVVXIFGSALGLFGVIVGIIQCSEGTFPKD

SEQ ID NO: 73966 - protein, 407 aa, Pseudomonas putida KT2440
MAIEIKAPTFPESVADGTVATWHKKPGEAVKRDELIVDIETDKVVLEVLATADGVLGDIVKGEGDTVLSDELLGSIVEGGAAAAPAAAAAPAAAPAAAAADAGEDDPIAAPAARKLAEENGIDLATVAGTGKGGRVTKEDVVAAVAKKKSAPAAAPAAKPAAAAAAPVVVAAGDRTEKRVPMTRLRAKIAERLVEAQSNMAMLTTFNEVDMTEVMALRSKYKDLFEKTHNGVRLGFMSFFVKAATEALKRFPAVNASIDGNDIVYHGFADVGVAVSSDRGLVVPVLRNAESMSLAEIENGIATFGKKARDGKLSIEEMTGGTFTITNGGTFGSMMSTPIVNPPQAAILGMHNIIQRPMAINGQVVIRPMMYLALSYDHRLIDGKEAVTFLVTIKNLLEDPSRLLLDI

SEQ ID NO: 73967 - protein, 180 aa, Gloeobacter violaceus PCC 7421
MTVFEGNLQDTRDLKFAIVIARFNDLVVGKLLSACEDSLRRHGVAVGPDSHQVDYAWVPGSFEIPMVARQLALSGRYDAIVCLGAVIRGQTSHYDHVASEVAKGIQALAFQTGVPVTFGVLTTDTMQQAIERAGIKSNLGWEYGENAIEMATLTRKIRHLVAVRAVQPELPEQTPPSLLQ

SEQ ID NO: 73968 - protein, 486 aa, marine gamma proteobacterium HTCC2080
MGAAEHQNLTGFDTQDLDALIKLQRSKFRAEGEVTYATRIDRLKRLKALILENKVEFANTTKREFNGARSYEFSLFSEFGSKVEAIDYSIKHLKEWMKPEKRKTNKPMNFLGGKGQVRHFPKGVVGIISPWNLPFGLTVAPLTSALAAGNRALLKPSEFVPETAALFAEVVPKYFSKDEVAVVTGGAEISQKFAELPFDHLLFTGSTRVGAQIMQAASKNLVPVTLELGGKSPVIIGRSANLELAGTRLTFSKFLNGGQLCLSPDYVLVPRELEEQLVARVIHEAQSMYPNVTENEDYAGVINERHFARLQNYIDDAVAKGAKLTIVGADQTRASEDNRRMPLHILQNVNEDMLVMHEEIFGPILPIMSYGDITEVPDQVEPRRNPLAMYYFGKDKSEQEYLLSHVPSGGVCINDITLHYVQEDLPFGGVGASGMGAYHGPEGFKTLSHPRAIYSQTMIDVLPIIGARPPFGEKFRKNIRKILGAI

SEQ ID NO: 73969 - protein, 129 aa, Vitis vinifera
MVSLAPLHTLFPGNSLKQSSLPGFYARPTPVGSAVSWKKKNRSLTVVAAVGEVSTDGTIYLIAGAVAVTVLGTAFPIFFSRKDVCPECDGAGFVRQSGVALRANAARKDQAQIVCARCNGLGKLNQVDK

SEQ ID NO: 73970 - protein, 262 aa, Actinobacillus pleuropneumoniae serovar 1 str. 4074
MKVTQLNLYPIKSTAAYRVEQAFVELKGLNFDREFMITETDGKFITARKDAELYNLSVFPNATGIVICHASGQKCVVLYQDFQYVQTSEVWGTHFDSLVAKTEVNQWLSEIFGREVQLRWLGGKSQREVVNFKQHPLSFADSNPVSLMSEKSLEQVKLWSPVEISMERFRPNIVIDGNIAFEEEQWEQVQIGEVLFTKSALCTRCVMITRDLTTLELDPNVEPFRTLKQMHTNEKGKPVFGIHLVPQNSGVIRLGDQVLIKS

SEQ ID NO: 73971 - protein, 252 aa, Lolium perenne
MDAGHDNWISTPSSSTSSHEHATAPWSPSPKRPAGRTKFKETRHPVYRGVRRRGSAGRWVCEVRVPGRRGERLWLGTHVTAESAARAHDAAMLAMRGSSAASCLNFADSASLLAVSSAVFEFADVRRAALAAVADFQRRNAANGAATASAGAVVEATSSASAPSPGDNAGSSATSSEATADGMFEVPAALGSDMFELDMSGEMDLGTYYADLAEGLLLDPPSPAAGTEACWDWENGDYGDHGGADAALWSYY

SEQ ID NO: 73972 - protein, 355 aa, Burkholderia vietnamiensis G4
MKIAVLPGDGIGPEIVNEAVKVLNALDEKFELEHAPVGGAGYEASGHPLPDATLKLAKDADAILFGAVGDWKYDSLERALRPEQAILGLRKHLELFANFRPAICYPQLVDASPLKPELVAGLDILIVRELNGDIYFGQPRGVRAAPDGPFAGAREGFDTMRYSEPEVRRIAHVAFQAAQKRAKKLLSVDKSNVLETSQFWRDVMIDVSKEYADVELSHMYVDNAAMQLAKAPKQFDVIVTGNMFGDILSDEASMLTGSIGMLPSASLDKNNKGLYEPSHGSAPDIAGKGIANPLATILSAAMLLRYSLNRAEQADRIERAVKTVLEQGYRTGDIATPGCQQVGTAAMGDAVVAAL

SEQ ID NO: 73973 - protein, 496 aa, Vitis vinifera
MNSIRQYQVPLQKYMAMMDLQERNERLFYKLLIDNVEELLPVVYTPTVGEACQKYGSIFRRPQGLYISLKEKGKILEVLKNWPERRIQVIVVTDGERILGLGDLGCQGMGIPVGKLSLYTALGGVRPSACLPITIDVGTNNEKLLANEFYIGLKQRRATGKEYSEFLQEFMSAVKQNYGEKVLIQFEDFANHNAFDLLAKYGTTHLVFNDDIQGTASVVLAGIVSALRLLGGTLADHKFLFLGAGEAGTGIAELIALEMSKQTKCPIEETRKKIWLVDSKGLIVSSRKDSLQQFKKPWAHEHEPVKDLLHAVKVIKPTVLIGSSGVGKAFTKEVIEAMASCNEKPLILALSNPTSQSECTAEEAYTWTQGRAIFASGSPFDPVEYNGKTFVPGQANNAYIFPGLGMGLVISGAIRVHDEMLLAASEALARQVTQENFDKGLIYPPFSNIRKISAHIAANVAAKAYELGLATRLPQPENLVKYAESCMYSPVYRSYR

SEQ ID NO: 73974 - protein, 247 aa, Lolium perenne
MDAGHDNWISTPSSSTSSHEHATAPWSPPPKRPAGRTKFKETRHPVYRGVRRRGSAGRWVCEVRVPGRRGERLWLGTHVTAESAARAHDAAMLAMRGSSAASCLNFADSASLLAVPSAVFEFADVRRAALAAVADFQRRNAANGTPTASAGTVVEDTSSASAPSSAGNAGSSTTSSGATADGMFQVPAALGSDMFELDMSGEMGLGTYYADLAEGLLLAPPSPAGTEAFWENGDYDYGGPEGALWSY

SEQ ID NO: 73975 - protein, 147 aa, Oryza sativa
PREEAPIKENEIRITTQGRMRNYITYATTLLQDHGSDEVVFKAMGRAINKTVMIAELIERRIVGLHQNTTTGSTDITDMWEPLEEGLLPLETTRHVSMITITLSKKELDTSSIGYQSPLPADQVTPLVEYQNEEDDPSPCWPTEKAW

SEQ ID NO: 73976 - protein, 223 aa, Lolium perenne
MDAASSSDQEKGPHRTVWSEPPKRPAGRTKFKETRHPVYRGVRRRGRAGRWVCEVRVQGTRSSRLWLGTFTTAEMAARAHDAAALALSGRDACLNFADSAWRMLPVLAVGSFGFGSEREIKDAVALAVLAFQRQQQQQQPAASLTPSSSPVQAVDGEKELHGSPAPSTLSMSSSDLLDEHWFGGTDAGSYYDNLTQGMLVEPPTSRTWQEDGVQTPLWSYLFE

SEQ ID NO: 73977 - protein, 224 aa, Lolium perenne
MDAASSSDQEQGPQTHRTVWSEPPKRPAGRTKFKETRHPVYRGVRRRGRAGRWVCEVRVLGTRSSRLWLGTFTTAEMAARAHDAAALALSGHDACLNFADSSWRMLPVLAAGSFGFGSAREIKDAVALAVLAFQRRQQQPAASLVPSSLPAQAAADEKDFHGSPAPSTLSMSSSDLLDEHWFGGTDAGGSCYDHLTQGMLVEPPTSRTSQEDGLQTPLWSHLFE

SEQ ID NO: 73978 - protein, 886 aa, Oryza sativa
MPCSPPSYLFIIVTGVLLVLVHSQTSLDEDFISIDCGLPSGFSYVDEKTNITYISDDQYIDTGENHNISSQLQGAEQFRSGLNLRSFPTGGRNCYTLYPAIKGQKYLIRGMFMHGNYDNKGQDLVSSPVTFDIRIGLNFWNRLNIINATMTYTSEAIVVAIVNSVSVCLVDNGEGTPFISSLEMRPMKSSNYPAATPNHPLLLQDRRSMGASRIIRYPDDPYDRVWWLPQITSGLIKISTRSLISRYTDDVYEVPVAVLKTAATTSSTSTALNFLWAAPTGWDATPGYLIGLHFTDFQQGQLREFDPTYNNDLWNYDNKKTKPPYLLANYINGTTPYTSDNYLYNISLVATNASVLPPMLNAIEIYYQVQQDEKMTYSEDVEAMMTVKIDYQVKKNWMGDPCLPEKYTWSGLKCRSQGVTSRIISLDLSSSDLQGAISEQFSMLRSLEYLNLSNNDLTGSLPESLTNLPNIHVLDLSGNQLNGTFPEALCKNRALTLRYDTANGDPCSPRSSKKKHKAVLAVAVVVPVVIVVILISAMLMLLFWKKQAIVKSRGQEQYGDHIHIPENREFTYEELVKITNNFSVFIGEGGFGPVFHGQLKDGTQLAVKMRSPTSMSGKGMPEFLAEVESLTTVHHRYLVLLVGYCTDQDHLGLVYEYMPNGSLYDHLRGKNAIIQRLSWQHRAKIAHEAAQGLDYLHTGCVLPIVHRDVKSHNILLGCDLTAKISDFGLSKSYLNVAQSHITATAAGTLGYIDPEYCLSGRLTISSDVFSFGVVLLEIVTGEPPIIPTNGHIVQRIKEKVNMGNIEAIADPRLHGEFDISSIWKVVDIALLCTKEASSERPTMSMVVAQLKDALALEEARLSYSTSDISQGGANAELSINSMPTAR

SEQ ID NO: 73979 - protein, 162 aa, Lolium perenne
MRVQGGRGYRLWLGTFATAEMAARAHDAAALALSGSAACLNFADSAWRMLPVLAAGSSGFGSAREIKEAVALAVVAFQLCPVAESSLAAETDVDGPPTPTALFYMSSGDLLELDEEHWFDGMVAGPYYESLAQGMLVEPPDAGAWREDGGVAETPLWSYMFQ

SEQ ID NO: 73980 - protein, 392 aa, Geobacter sulfurreducens PCA
MPYDFKLPDLGEGITEAELRRWLVKEGDTVAEHQPVVEVETDKAVVEVPSPRAGRVITRARLEGETVMVGETLLTIAEEEATPPVRKPSVGIVGELPEAEEAVGTQQPAILATPLVRKLARERGIDLATVRGSGPRGSITPEDVAGAGAPARPDAGEFGPAERIPLRGVRRSIARNVMTSQRNTAFVTGMEEADITELWHLREREQQAVEQRGTHLTFLPFFIKAVQHALREHPYLNAAIDDVAGEIILKKHYHFGIAVETPDGLMVPVIRNVDAKSIIELASELQELGRKARERTITLDEMRGSTFTLTNFGHFGGVFATPVINWPDVAILGFGRIADRPWVHAGQIVVRTILPLSLTFDHRVTDGADAAQFLSKVVRYLEDPALLFIESI

SEQ ID NO: 73981 - protein, 386 aa, Klebsiella pneumoniae subsp. pneumoniae MGH 78578
MTEENPLLALRDKISALDEKLLALLAERRGLAVEVGKAKLASHRPVRDIDRERDLLERLMTIGKRHNLDAHYITRLFQLIIEDSVLTQQTLLQQHLNKINPHSARVAFLGPKGSYSHLAARQYAARHFEQFIESGCAKFADIFNQVETGQADYAVVPIENTSSGGINDVYDLLQHTSLSIVGELTIPIDHCVLVSTSTDADKIQTVYSHPQPFQQCSQYLSRYPHWKIEYTESTSAAMEKVAQANSPAVAALGSEAGGALYGLQVLEHCQANQTQNITRFLVLARKAVNVSDQVPAKTTLLMATGQQAGALVEALLVLRNHNLIMTKLESRPIHGNPWEEMFYLDIQANLDSLPMRKALKELADITRSMKVLGCYPSENVVPVDPV

SEQ ID NO: 73982 - protein, 336 aa, Pseudomonas syringae pv. tomato str. DC3000
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPETTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 73983 - protein, 402 aa, Clostridium tetani E88
MVKMFKFNSIEEAIADIKEGKMVIVVDDEDRENEGDLLMAAEKVTPENINFMIKYGRGLVCMPIIGERLKELNLNQMVDINTDTNGTAFTVSIDFIDTTTGISAYERAHTISKVLDSSVKGEDFKRPGHVFPLEAKEGGVLKRAGHTEASVDLARLAGFYPAGVICEIVGEDGKMARLPQLMEYSKEHNLKIINIADLIAYRRKKETLVKRVVEAKMPTRWGEFKIIGYENKINGEHHVALVMGDIENGEDVLVRMHSECLTGDALGSVRCDCGYQYEAAMKAISEERRGVLVYMRQEGRGIGLINKLKAYNLQDKGMDTVEANIALGFPPDLRDYGIGAQILNDLGIKKINLMTNNPKKITSLSGYGIKIVKRVPLEIHENEESEFYLKTKKEKMGHLLHF

SEQ ID NO: 73984 - protein, 546 aa, Arabidopsis thaliana
MASRIINHSKKLKHVSALLRRDHAVAVRCFSNSTHPSLVGREDIFKARLNYSSVERISKCGTGNVTMLSGISTTSTKLSSPMAGPKLFKEFIRYLPDAISERIFIQFRYLVLYYLPPHQEIGMPSLSPTMTEGNIARWLKKEGDKVAPGEVLCEVETDKATVEMECMEEGFLAKIVKEEGAKEIQVGEVIAITVEDEDDIQKFKDYTPSSDTGPAAPEAKPAPSLPKEEKVEKPASAPEAKISKPSSAPSEDRIFASPLARKLAEDNNVPLSSIKGTGPEGRIVKADVEDFLASGSKETTAKPSKQVDSKVPALDYVDIPHTQIRKVTASRLAFSKQTIPHYYLTVDTCVDKMMGLRSQLNSFQEASGGKRISVNDLVIKAAALALRKVPQCNSSWTDEYIRQFKNVNINVAVQTENGLYVPVVKDADKKGLSTIGEEVRFLAQKAKENSLKPEDYEGGTFTVSNLGGPFGIKQFCAVINPPQAAILAIGSAEKRVVPGTGPDQYNVASYMSVTLSCDHRVIDGAIGAEWLKAFKGYIETPESMLL

SEQ ID NO: 73985 - protein, 153 aa, Clostridium tetani E88
MNIIEGKLIGQSLKFGITIGRFNEFIGGKLLDGAVDALIRHGVDEKDIEIAWVPGAFEIPLIAKKMAKSKKYDGIICLGAVIRGATTHYDYVASEVSKGIAKITLDEEVPVIFGVLTTENIEQAIERAGTKAGNKGYEAACTAIEMANIINII

SEQ ID NO: 73986 - protein, 542 aa, Castanea crenata
MAKPILLYTSLCFLVLFINGCLAHRQWQQQQEFNQCQLDSLDALEPNNRIEAEAGVTEAWDPNNKQFQCVGVAVVRRTIEHNGLLLPQYTNTPQLIYIEKGYGILGVVLPGCPNTYQESQEQQQGQDRRSQDRDQYQKIRNFRQGDIIALPAGVTHWLYNDGESEVVALSLLDIKNQANQLDQNPRNFYLAGNTEDEFQQQNRSRRHQQEQGQGRREGGRHGQQQGQGNNLFSGFRAKDLAEVFNVNEDTIRNLQGLQEDRSNIVRVKGGLQVARPPRSREERERLERQEREQEREDEREQRESRRGGSGHGREEREQEERQQEREEEQEQEMERRESRRIGRGLGRGCARYNGIEETLCTLRLRENIHDPSRTDIYNPDAGRISTLNSHNLPILRWLQLSAEFGRLQKDAIYAPHWNLNAHSVIYVLKGRAQVQVVDNFGLTVFDDELQQEQILTVPQNFAVVKRAGSEGFEWVAFKTNDKAQISPLAGRTSVLRAIPADVLANAFQLRQEDVLELKVNMERQGNTLIRPSRSSSQRRAIA

SEQ ID NO: 73987 - protein, 546 aa, Methylococcus capsulatus str. Bath
MLKKHPTFPGISGPVVTVVMDGFGYSPKTTGNAIAQAYTPTLDRLLATCPHTLLKAHGKAVGMPSDDDMGNSEVGHNALGSGQIYHQGAALVAEAIASGALFEGTAWREIMDNARQHGSTLHFIGLLSDGNVHSHIDHLKAMIVRAKAEGQRRVRIHILLDGRDVPETSALEYVGPFEAFLAELRDETFDARIASGGGRMNITMDRYEADWGMVERGWHTHVLGEARHFESATQAIETLRAEHTGIIDQDLPPFVVAHDGEPVGQIFDKDSVIFFNFRGDRAIEISRAFEEEEFAPFDRVRHPGVTYAGMLQYDGDLGIPRRYLVAPPAIHGTVGEYLAAEGITQLAISETQKYGHVTYFWNGNRSGKFNESLETYVEIPSDRVPFEQRPWMKSAEITDELIRQIKTGRHRTVRVNYANGDMVGHTGHYQATIIAVEAVDLALSRLLPVIDALGGVALITADHGNADEMYELDKKTGEPQRTPSGAPKAKTSHTLNSVPFIYYDRLNRAVIQNPGDAGLSAVAATTVNLLGYEAPDLWDRGLLAFG

SEQ ID NO: 73988 - protein, 301 aa, Corynebacterium glutamicum ATCC 13032
MNNRIVVVGSINADLNVLVDRHPAPGETLLGSGGHITAGGKGANQAVAAALQGADVAFVGAVGKDPYAAPALEFLRSSGVDLTAVSEVDDTTGLAVITVAKDGENNIVVIPGANSLVNCDYVSSQSALLAEAGILLLQGEIPADGFKEAIHHTMGRVVVNLAPVIEVEKSALLEADPIIANEHEAGLILDQFGAGIDSMDPHELAQALLDAGFASVVLTLGSAGALVADATGITDIATPTVQAVDTTGAGDAFAGAFCARLIKGDSLIDAATHAARVGAYSVQTAGAQASYPDASVSLPSV

SEQ ID NO: 73989 - protein, 324 aa, Corynebacterium glutamicum ATCC 13032
MSKTEEGRSAAIIIYAFPTFILLGAIIAFIFPEPFIPLTNYINIFLTIIMFTMGLTLTVPDFQMVLKRPLPILIGVVAQFVIMPFLAIVVAKMFNLNPALAVGLLMLGSVPGGTSSNVIAFLARGDVALSVTMTSVSTIVSPIMTPFLMLMLAGTETAVDGGGMAWTLVQTVLLPVIIGLVLRVFLNKWIDKILPILPYLSILGIGGVVFGAVAANAERLVSVGLIVFVAVIVHNVLGYVVGYLTGRVFKFPEAANRTMAIEIGTQSAGLASGMAGRFFTPEAALPGAVAALVHNITGAVYVGLVRNRPLTKASRKKESVAVSS

SEQ ID NO: 73990 - protein, 334 aa, Phaeodactylum tricornutum
MPVSLGINGFGRIGRLVMRAALEHPDATVVAVNDPFLTPEYAAYQFKYDSVHGTYSEDVSFEEGYLVVGDKKIRFFSERNPEEIGWGSVGAEIVCESTGVFTTIDKAQAHINGGAEKVVISAPSADAPMYVMGVNHTTYSGATVFSNASCTTNCLAPLAKVLHEEFGIVEGLMTTIHAGTATQLVVDGPAKRGKDWRAGRSSLANLIPASTGAAKAVGKVIPELNGKLTGMAVRVPTADVSMVDLTIRTEKAVSAAELKAALKKASEGPMKGILGYTEDAVVSQDFVHDPRSSIVDASAGIALNDNFHKVIAWYDNEWGYSNRLVDLAIYTSGK

SEQ ID NO: 73991 - protein, 376 aa, Odontella sinensis
MKLSIAALLVGSAAAYAPSSFSGTSLKASSNGASMSMSTGMGVNGFGRIGRLVTRIMMEDEDCSLNAINAGSATPDYMAYQYKYDTIHGIAKGSVEIDGDFLVLNGKKIQTSRCRDPKEVGWGALGADYVCESTGVFLTKEKAQAIIDGGAKKVIYSAPAKDDSQTIVMGVNQAEYDGSEDFISCASCTTNGLAPMVKAIHDEFVIEEALMTTVHAMTATQAVVDSSSRKDWRGGRAASGNIIPSSTGAAKAVTKVIPSLQGKLTGMAFRVPTIDVSVVDLTCRLEKATTYEEICAYVKSKAEGDMKGFLGYSDEPLVSTDYEGNTISSIFDADAGIMLNPNFVKLVAWYDNEWGYSCRVVDLMKHVAAVDAKVEA

SEQ ID NO: 73992 - protein, 229 aa, marine gamma proteobacterium HTCC2080
MSNESSTIHTIQFSGSGVFNPDVLDATHKQLDAVEADSSIEAVFLRGEGKNFSQGLDLEFLMANPDIFSEFVTSTMHLAARFLTFPVPVVSLVNGHAFGLGAMLVLASDYAVMRGDRGFFCLPEIDIGMTLTVRMNALVKASMSAYAIRETLLTGGRLTGEQARSMGVVDAVGDDSELEAIALQVSAPMRGKPRELLSGLKYGVHQELVDLMMSDAPDDAYTQVKIWPR

SEQ ID NO: 73993 - protein, 339 aa, Odontella sinensis
MTVSLGINGFGRIGRLVMRAALENPDTTVVAVNDPFMNIDYAAYQIKHDSVHGMYPGSVEVDGDSLVFDGTTKVKFFAERDPASIPWGASGAEYVCESTGVFTTIEKASLHLKGGAKKVIISAPSANAPMFVMGVNHKSYDGSADVVSNASCTTNCLAPLAKVLHENFGIEEGLMTTIHAATATQLVVDGPSKGGKDWRGGRSAMANMIPASTGAAKAVGKVLPELNGKLTGMAVRVPTPDVSMVDLTVRTTKACTGAEIDAALKAASESEDLKGILGYTDLPVVSQDFVHDKRSSIVDSTACIHLSDTFHKVISWYDNEWGYSNRLVDLCLFMKTVDN

SEQ ID NO: 73994 - protein, 468 aa, Yersinia aldovae
MLLPVIMAGGTGSRLWPLSRTLYPKQFLALTSELTMLQETLTRLDGISHQPALIICNEEHRFIIAEQLRQLHIEHSGIVLEPAGRSTAPAIALAALLARSRGEDPLLLVLAADHVIQDRTTFIDSIISALPLAEAGKLVTFGIVPDAPESGYGYICRGMSVGDNAYKVDAFVEKPDQSTAEKFIASGGYYWNSGMFIFKASRYLQELELYRPEIFASCKKAIDGCRNDLDFIRLNEEPFLNCPEDSIDYAVMEKTSDAVVVPMDAKWSDVGSWSALWALNEKDGNGNVIRGDVLIENTNDSYIYSKNKLVATVGVNDLIIVETKDAILVAHKDKVQDVKSIVAQLKKNSRTEHLQHREVYRPWGSHDSIAEGERYHVKHLIVRPGQRTAMQIHHHRAEHWVVVSGTAKVYRGDEIFLVTENESTYIPVGLAHAIENPGKFDLEIIEVRSGSYLQEDDIVRIDHKNAGY

SEQ ID NO: 73995 - protein, 615 aa, Odontella sinensis
MISGTARALASSASNASKRAFHASARSDARKFFVGGNWKCNGSVQQVNDLVSMLNQSTLSTDTEVVVCPSQVYVQGVSEKLRKDIGVGAQDCWVQGNGAFTGETSADMLADMGVGWVVIGHSERRGKGEADEEVARKAKYALDKGLKVIACCGEPLESREAGTTNDFVFPQIKAYADVFSKEDWANVVIAYEPIWAIGTGLTATPEQAQDTHADIRQYLGEVAGADVAESTRILYGGSATGATAPGLSAKPDIDGFLVGGASLKPEFADIVNCQGGETSLKPVNIGINGFGRIGRLVMRAAQNDPMVNIVSVNDPFIPVNYMEYMLQYDTVHGEYPGTVKQTGDDTLSIDGKDVKVFGEMDPSKIQWGSVGADYVIESTGVFTSTEKASMHMKGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPELNGKLTGMSFRVPTANVSVVDLTARLDKGASYETICAAIKEASEGKMKGILGYQDKDIVSSDFISDRHSSIFDEKAGIALTDDFVKLVSWYDNECGYSNRVLDLIKHMDVSK

SEQ ID NO: 73996 - protein, 429 aa, Arabidopsis thaliana
MVRSDENSLGLIGSMSLQGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 73997 - protein, 642 aa, Xanthomonas campestris pv. campestris str. ATCC 33913
MTQESSAPLLFADLGLSDAVMKAVAAVGYETPSPIQAATIPALLAGRDVLGQAQTGTGKTAAFALPVLSNADLNQVKPQALVLAPTRELAIQVAEAFQKYAEAIPGFRVLPVYGGQPYAQQLSALKRGVHVVVGTPGRVIDHLDRGTLDLSQLKTLVLDEADEMLRMGFIDDVEAVLKKLPEKRQVALFSATMPPAIRRIAQTYLKDPAEVTIAAKTTTSANIRQRYWWVSGLHKLDALTRILEVEPFDGMIIFARTKAATEELAQKLQARGLAAAAINGDMQQAAREKTIAQLKDGKLDILVATDVAARGLDVERVSHVLNYDIPYDTESYVHRIGRTGRAGRNGDAILFVTPREKGMLRAIERATRQPIEEMQLPSVDAVNDTRVARFMTRITETLAGGQIEMYRDLLQRYESENNVPAIDIAAAMAKLLQGNAPFLLTPPVRGAREDFAPRERNDRADRGERPRFEPKFERGPRAPDGERGARPPRPDRPAYGEDAGAERPRREPSAPRGEPEFGMESYRIEVGHTHGVKPANIVGAIANEAGLESRYIGRIDIQDDYSILDLPADMPRELLTHLKKVWVSGQQLNMRKLEEGEAAAAAASKPKFPRGPRPAGRPNRPMDRAGAPHRKGPPKPRGPRSE

SEQ ID NO: 73998 - protein, 310 aa, Leptospira interrogans serovar Copenhageni str. Fiocruz L1-130
MRNTSLKSVYQLALQDPRVVYIGSDLGAGVLDEMKQNIPDRFYMEGVSEQHIIGMSAGMAMEGYIPYVNTIATFLTRRCFEQVAIDLCLHDLPVRLIANGGGIVYAPLGPTHLAVEDIAILRALPNMTIIAPCDAEEMKRLMPLTLDWPHPIYIRLAKGGDKVISKPEFGFEIGKAIVMQEGKDGLFVTTGVMTQLALEAIQQLESEGVSCGVIHMHTIKPLDGEILKKWIPKVSAIVTVEEHTRIGGLGSAILEYCNDLMPSESGKIRRIGLPDRFSEKYGSQESLLNYFGINKDSLVQTMRDAISIKK

SEQ ID NO: 73999 - protein, 379 aa, Phaeodactylum tricornutum
MKFSAATFAALVGSAAAYSSSSFTGSALKSSASNDASMSMATGMGVNGFGRIGRLVTRIMMEDDECDLVGINAGSATPDYMAYQYKYDTIHGKAKQTVEIDGDFLVLDGKKIITSRCRDPKEVGWGALGADYVCESTGVFLTKESAQSIIDGGAKKVIYSAPAKDDSLTIVMGVNQEAYDGSEDFISCASCTTNGLAPMVKAIHDEFVIEEALMTTVHAMTATQAVVDSSSRKDWRGGRAASGNIIPSSTGAAKAVTKVIPSLVGKITGMAFRVPTIDVSVVDLTAKLEKSTTYEEICAVIKAKSEGEMKGFLGYSDEPLVSTDFEGDLRSSIFDADAGIMLNPNFVKLIAWYDNEYGYSGRVVDLMKHVAAVDAKIKA

SEQ ID NO: 74000 - protein, 181 aa, Listeria monocytogenes EGD-e
MAERLVGTQAPRFEMEAVMPNQTFGKVSLEKNIEDDKWTILFFYPMDFTFVCPTEIVAISARSDEFDALNARIIGASTDTIHSHLAWTNTPIKEGGIGKLNYPLAADTNHQVASDYGVLIEEEGVALRGLFIINPKGEIQYEVVHHNNIGREVDEVLRVLQALQTGGLCPINWQPGEKTIV

SEQ ID NO: 74001 - protein, 180 aa, Bradyrhizobium sp. ORS278
MNQPASAYFIEERHDPNETHTLSVLVQNEPGVLARVIGLFSGRGYNIESLTVSETESQKHLSRITIVTTGTPMVIQQIKHQLDRMVPVYRVVDMTLTKRAIERELAMVKVRGTGDPRVEALRLADAFRARVIDATTESFVFEITGNTDKINQFIDLMRPLGLVEVARTGVAAIGRGPEGM

SEQ ID NO: 74002 - protein, 210 aa, Lolium perenne
MDAASTSSQEQPHSHRTVCSEPPKRPAGRTKFHETRHPVYRGVRRRGRVGQWVCEMRVHGARGSRLWLGTFATAEMAARAHDAAALALSGPDACLNFADSAWRMLPVLAAGSFGFGSTREVKAAVALAVVAFTVRATPVAEKVVISSPAPSAALFYMSSGDLLELDDEHWFGGMVAGPYYESLAQGMLVEPPDAGAWREDGGAVQTPLWS

SEQ ID NO: 74003 - protein, 302 aa, Pantoea agglomerans
MTVCAKKHVHPTRSAAEQLLADIDRRLEQLLPVEGERDFVGAAMREGALAPGKRIRPMLLLLTARDLGCAVSHEGLLDIACAVEMVHAASLILDDMPCMDDAQIVGGRPTVHCQYGEHVAILAAVALLSKAFGVIADADGLTALAKNRAVSELSNAIGMQGLVQGQFKDLSEGDKRRSAEAILMTNHFKTSTLFCASMQMASIVANASSERRDYLHRFSLDLGQAFQLLDDLTDGMADTGKDINQDEGKSTLVNLLGSRAVEERLRHSLHLASEHLSAACQNGHSTQQFIQAWFDKKLAAVS

SEQ ID NO: 74004 - protein, 364 aa, Glycine max
MATTRSAPLLKHLLTRLNPSRSVTYMPRPGDGTPRGVTLIPGDGIGPLVTGAVEQVMEAMHAPLYFEKYEVHGDMKAVPAEVLESIRKNKVCLKGGLATPMGGGVNSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATRYPGIKYNEIIVDNCCMQLVSKPEQFDVMVTPNLYGNLVANTAAGIAGGTGVMPGGNVGADHAVFEQGASAGNVGNDKVVEQQKANPVALLLSSAMMLRHLQFPAFADRLETAVKKVILEGKYRTKDLGGTSTTQEVVDAVIDALD

SEQ ID NO: 74005 - protein, 337 aa, Yersinia aldovae
MTILVTGGAGYIGSHTVLTLLEQADDDVVVLDNLSNASAESLLRVSTLTGRNAIFYQGDVLDRGCLKRVFSDHKIDSVIHFAGLKSVGESVVKPIEYYQNNVIGSIVLLEEMVAAGVTKLIFSSSATVYGDPEFIPLTEDARTGGTTNPYGSSKVMVEQILKDFSVAHPDFSITALRYFNPVGAHPSGLIGEDPNGIPNNLLPFITQVAIGKLPKLAVYGNDYPTVDGSGVRDYIHVMDLAEGHLCALNKLTKGFKVYNLGSGTGYSVLQMITEFERISGKKVPYHIVARRSGDIAECWASAELALKELDWKAKRSLTDMLTDAWNWQQSNPNGYVR

SEQ ID NO: 74006 - protein, 334 aa, Actinobacillus pleuropneumoniae serovar 1 str. 4074
MKTLGEFIIEKQAEYPEAKGELSGILSSIRLAAKIIHREINRAGLSQDILGVAGSENIQGEAQMKLDVFANETMKKALLAREEVAGFASEEDDNFVAFENDRAKNAKYILMTDPLDGSSNIDVNVSVGTIFSIYKRVSPIGSPVTMEDFLQEGRKQVASGYVTYGSSTMLVYTTGNGVNGFTYDPSLGLFILSHPDMKIPTEGKYYSINEGQYVTFPMGVKKFIKYCQESDEATKRPYSSRYIGSLVSDFHRNLLKGGIYIYPTSTVYPKGKLRLLYEGNPMAFLAEQAGGMATDGFNPILDIKPSELHQRVPFFVGSTSMVKQADKFMQECAE

SEQ ID NO: 74007 - protein, 475 aa, Thermosynechococcus elongatus BP-1
MSGHRFQALEYEPAFLSLGEQYWDKVQAATFPQHILRFRNDALLPLMGLDPAEVTDADFIAAFGQFQGREPFLAMRYHGYQFGEYNPHLGDGRGFLYGQFRGVDGQLYDLGTKGSGTTPYSRGGDGRLTLKGGVREVLASELLHRLGVRTFRSLSLVETGESLWRGDEPSPTRSSVLVRLGRSHIRFGTFERLHYLRRPDLIQRLLDHVIAYYYPHLLEIPDPKERNCAFYRELVARTADLAAQWLVAGFCHGVLNTDNMAITGESFDYGPYAFLERYDLGFTAASFDYYGRYAYGNQPAICAWNLEKLQIPLSWVIPLEEMAAALKTFGDRCQTTYLKLMLKRLGWADLPLELGRSLVVETQAFLSRSLISYPQFFISLRQEFSPEWAADVGHLFSGSPTLTPADQKLLEAWKRCYFERLQQATPPQRVAIPQTLRAANPLVIVTRPHIEQIWQAIDQEDDWSRFRATLELMQV

SEQ ID NO: 74008 - protein, 239 aa, Triticum aestivum
  misc_feature (128)..(128): Xaa can be any naturally occurring amino acid
MSAFVGKYAEELIKTAKYIATPGKGILAADESTGTIGKRLASINVENVEANRQALREMLFTAPGALEYLSGVILFEETLYQTAADGTPFVDILKAGNVVPGIKVDKGTVDIAGTVGETTTQGLDSLGXARCAKYYEAGARFAKWRAVLKIGPRRPGRPDLPGKQNAEGAGPGPRFFWQEKRAWSPIRGSPEIPHRSGPARNFKGLAPAAHPGRSSARRSYKVRLTEPTRGPPPKGAPFL

SEQ ID NO: 74009 - protein, 317 aa, Pseudomonas syringae pv. tomato str. DC3000
MSDIPQAPADGRSSHWQLQRIVSQLRGAREDWRARNRRVSGEHGGRELPSRAAMGEILEALSGALFPMRLGPVDLREESEDFYVGHTLDVALNALLAQARLELRYVAHQQGADLKGIDAHALELIQGFATALPAIRLLLDTDVLAAYHGDPAARSVDEVLLCYPGILAVIHHRLAHHLYRAGLPLLARISSEIAHSATGIDIHPGAQIGPSFFIDHGTGVVIGETAIIGERVRIYQAVTLGAKRFPADEDGQLQKGHPRHPIVENDVVIYAGATILGRITIGQGSTIGGNVWLTRSVPAGCNLTQANLLQQDDCSKK

SEQ ID NO: 74010 - protein, 332 aa, Pseudomonas syringae pv. tomato str. DC3000
MIKNQLARFNRLDLISAPTALEKLERLSLWADRDIYIKRDDTTTLALGGNKVRKLEYLAADALAQGADTLITAGAIQSNHVRQTAALAARLGLGCVALLENPIGTEDPSYLKNGNRLLLELFDAKVELVENLDNADDQLHALAARLRSSGKKPYLVPIGGSSPVGALGYVRAGLELAEQIKQTGIDFAAVVLASGSAGTHSGLALALAHELPQLPVVGVTVSRSEEAQLPKVQGLAERTAQLLDIALPEHFKVELWDEYFAPRYGEPNAGTLAAIKLVASQEGLLLDPVYTGKAMSGLLDGIGRQRFNDGPLIFLHTGGAPALFAYPDAFDQ

SEQ ID NO: 74011 - protein, 321 aa, Ralstonia solanacearum GMI1000
MNEKITKAVFPVAGLGTRFLPATKASPKEMLPIVDKPLIQYAVEEAAAAGITEMIFITGRAKRAIEDHFDKAYELESELAAKNKHALLEMVQSIKPAGVECFYVRQPETLGLGHAVLCAQKLVRDEPFAVILADDLLDHEPSVMQQMTELYDHYRCSIVGVETIAPQASRSYGVVAGREWDDRLIKLDGIVEKPAPEHAPSNLGVVGRYILTPRIFDHLRNLAPGTGGEIQLTDAIQRLMAEEQILAYRYRGQRFDCGSKFGYLQATVELALRHPEVGADFEAYLYARMGLPHELPAAVEAPASTVTPVSKKVLPLEGVAA

SEQ ID NO: 74012 - protein, 70 aa, Prunus persica
FTVIGVYLEDKAVPLLAVKWKGKTAQELTESVEFLREIVTGPFEKFTQVTTILPLTGQQYSEKVTENCVA

SEQ ID NO: 74013 - protein, 447 aa, Ralstonia solanacearum GMI1000
MHQPQASAVAGAHVPAHDAVHEGAHDVRRRLRSIFSGSVGNLVEWYDWYVYSAFALYFAKSFFPKGDQTAQLLNTAAVFAVGFLARPVGGWLMGIYADRYGRKRALLVSVVLMCLGSLIIALTPGYATIGVAAPTLLVLARLLQGLSVGGEYGTSATYLSEVATRESRGFYSSFQYVTLIAGQLVALALLIALQQFVLSPAQLDAWGWRIPFFIGALCALIAMRLRSTMEETQSFTSTTMETKKRGSLRELAKHPRAVATVVGLTLGGTVAFYTYSIYMQKFLANTVGLSKDQATLVSGATLLLFALLQPVVGGLSDRVGRRPILIAFGVLGTLFTVPIMTGISQTSSPWTAFFLIMAALVIVSGYTSINAVVKAELFPTEVRALGVGLPYALTVSIFGGTAEYIALWLKQAGHEPWFYWYVTGTIFLSLLVYVFMRDTRAHSRIGH

SEQ ID NO: 74014 - protein, 474 aa, Streptococcus pneumoniae TIGR4
MTKANFGVVGMAVMGRNLALNIESRGYTVAIYNRSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVADVLEEISAKAPEDGKPCVTYIGPDGAGHYVKMVHNGIEYGDMQLIAESYDLMQHLLGLSAEDMAEIFTEWNKGELDSYLIEITADILSRKDDEGQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 74015 - protein, 415 aa, Bifidobacterium longum NCC2705
MKALQRDHAAELKLAAERLKGTARHTEIIPSPVLSEMTGHEILLKPENLQVTGSFKIRGAYNKIASLTEEQIAHGIVTASAGNHAQGVAYAARERGAKATICMPQITPPLKVDATKAYGADVVLYGDVFDESAAHAAELADKEGMIYVPPFDDYEVICGQGTIGLEILEDVPNVTDVVVPLGGGGLGAGVALAIKTFKPEVRVIGAIPEGSPAWKDSLAAGRVSPADHVVTSAEGVAVKHPGDLPFALINEFLDDLVTVTERDINEMILLMLEKHKLVVEAAGAVSLAALEHLNLRSRKFAAATGPHVVVPIMSGGNIDTVTMGAVIQKGMIARGRIMNFEVELPDTPGQLVKVATLLAEQRANVIQLDHDQFKASGHYTNAVSLGVTVETNGPEHIDRILAALREAGFQPKRIY

SEQ ID NO: 74016 - protein, 527 aa, Triticum aestivum
MALEAAFHYLQLAGIHGTSTPAVLLTILLLLIIRLAWVRTTTASTRFGKQQQLPPSPPGKLPIIGHLHLLGSQTHISIRDLDAKHGRNGLLLLRIGAVPTLFVSSPSAAEAVLRTHDQIFASRPPSMAADIIRYGPTDIAFAPYGEYWRQARKLLTTHMLSAKVVHSFRHGRQEEVRLVINKIHEAATRGTAVDMSELLSGYTNDVVCRAVLGESHRKEGRNRLFSELTEINVSLLGGFSLENYIPPNMVMADVLLRLVSVKARRLNKRWDELFNEIIEEHLHPSKPSSGEQQAVDFIDLLLSLKEEYGLTTDNIKAILVDMFEAGIETSYLTLEYGMAELMNNRHILKKLQEEVRSQGKKLDMITEEDLGSMAYLRATIKETLRLHPPAPFLLPHFSTADCKIDGYLIPSNTRVLVNAWALGRDPSSWERPEDFLPERFLQDQDGDVDTQMRGKDLRFLPFGFGRRICPGMNFGFATMEVMLANLMYHFDWDVPNMVGTGAGVDMAESFGLTLRRKEKLQLVPRIP

SEQ ID NO: 74017 - protein, 614 aa, Phaeodactylum tricornutum
MLASSRTAAASVQRMSSRAFHASSLTEARKFFVGGNWKCNGSVQQAADLVSMLNQSSLSQDTEVVICPSQVHLQSVQSTIRGDVAVGAQDVWTQGNGAFTGETSANMLKDLGVKWAVIGHSERRGKGEPDAQVAAKAKYALDQGLSVIACCGEPLEAREAGTTNEYVFPQIKAYVDALEPKDWDRVVIAYEPIWAIGTGLTATPEQAQDTHEAIRQYLGQVAGAEVAANTRILYGGSASAKTAPGLSAKPDIDGFLVGGASLKPEFADIVNCQGDTKSLKPVNIGINGFGRIGRLVMRAAQNDPMINIVAVNDPFIPTDYMEYMFQFDSTHGLYTGTVNMVDESNIAVDGKPIRVFNERDPSKIQWGSAGADYVVESTGVFTTTEKASAHMVGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPALNGKLTGMSFRVPTIDVSVVDLTCRLDKGAPYATICAAIKAASEGPMKGILGYQNKDVVSSDFISDSHSSIFDEKAGIALTDDFVKLVSWYDNEAGYSMRVLDLIKHMEKSK

SEQ ID NO: 74018 - protein, 426 aa, Aquifex aeolicus VF5
MNKTTFENVYYWEGKAQIPQEGQFIKLKEDKTLEVPDNPIIPFIEGDGIGPEITQAMLLIINTAVEKTYNGSKKIYWVELLAGDKAEEKTGERLPQETLDVLKESIVGIKGPLGTPVGKGVRSINSALRRAFDYYSAVRPVYWMGQATPIPNPERVDLVVFRENTDDVYAGVEFFAGTPEAKKVREFLIKEMGAKEEGFPEDVGITVKPMSEFKTKRHVRKALRYALENNKKNVAVIGKGNIMKATEGAFINWAFEVAEEPEFKGKVVTDPEAEPGEGQVKLTKVITDQMLMQLVLKPEAWDVIIAQNLNGDYVSDLAASLIGGPGFVPSGNIGDGYALFESTHGTAWDIAGKGIANPLSLTLSGAMMLEYIGWKEAAQKVYDAVRRTLAEHIGTPDIASGFQKQGIEAKAVGTMEFAEEISKRIE

SEQ ID NO: 74019 - protein, 463 aa, Gloeobacter violaceus PCC 7421
MRVCVIGTGYVGLVTGACLAHIGHDVVGVDNNAAKVAQMQAGISPIVEPGLETIMTGAMQAQRLAFTTDIAAGVRHGEVIFIAVGTPALPSGESDTRAVEAVARAIGTHLDGNYKVIVNKSTVPIGSGDWVRMLVSENAAPDVDFDVVSNPEFLREGSAVFDTFNPDRIVLGGSGRRAVALMKKLYEPITQRQVAAEAALPPVPVVVTDLASAEMIKYAANAFLATKISFINEVANICDRVGADVQQVALGMGLDSRIGGKFLQAGLGWGGSCFPKDVAALVHTACDYGYEAKLLAAAVAVNRSQRYLAIEKLRQSLGILKGKTIGLLGLTFKPDTDDLRDAPALDLAAECRRLGARVKAYDPTVRPERPPAGLEAGVAVCPESLAVGCDALVLVTEWAEFRTLDYAGLARSMARALIVDGRNFLDPQILAAAGFTYVGIGKPGAKAAPAAPEKAAPVLAIAG

SEQ ID NO: 74020 - protein, 540 aa, Bifidobacterium longum NCC2705
MTDIMDSQAVKAAAAASAANAAQPSAHQPLRTAVVKAAELARAAEERARDKQHAKGKKTARERLDLLFDTGTFEEIGRFQGGNIAGGNAGAAVITGFGQVYGRKVAVYAQDFSVKGGTLGTAEGEKICRLMDMAIDLKVPIVAIVDSGGARIQEGVAALTQYGRIFRKTCEASGFVPQLSLILGPCAGGAVYCPALTDLIIMTRENSNMFVTGPDVVKASTGETISMADLGGGEVHNRVSGVAHYLGEDESDAIDYARTVLAYLPSNSESKPPVYAYAVTRAERETAKRLATIVPTNERQPYDMLEVIRCIVDYGEFVQVQELFGASALVGFACIDGKPVGIVANQPNVLAGILDVDSSEKVARFVRLCDAFNLPVVTLVDVPGYKPGSDQEHAGIIRRGAKVIYAYANAQVPMVTVVLRKAFGGAYIVMGSKAIGADLNFAWPSSQIAVLGAAGAVNIIHRHDLAKAKASGQDVDALRAKYIKEYETSTVNANLSLEIGQIDGMIDPEQTREVIVESLATLATKRRVKRTTKHHGNQPL

SEQ ID NO: 74021 - protein, 122 aa, Brassica napus
MASKLIQVQSKACEASKFVAKHGTSYYRQLLEKNKHFIQEPATVDKCQELSKQLLYTRLASIPKRYETFWKELDYAKNLWKNRSDLKVEDAGIAALFGLECFAWYCAGEIPGRGFTFTGYYP

SEQ ID NO: 74022 - protein, 348 aa, Gloeobacter violaceus PCC 7421
MKVLITGVAGFIGYHLAARLLQEGSKVYGIDNLNSYYDVRLKEARLARLVPHPQFTFRHLDIARRPAMFELFESESFDCVVHLAAQAGVRYSLKNPFAYVDSNLSGFVNLLECCRTSGIGHLVYASSSSVYGANTKAPFSVSDNVDHPVSLYAATKKANELMAHAYSHLYALPTTGLRFFTVYGPWGRPDMAYFKFVQAIEAGKPIDVYNHGHMQRDFTYIDDIVEGIVRLLPRVPTHAGAAPYRIYNIGNHQPVSLIEFIEVIEQALGKRAVKNLLPMQPGDVPATCADVDDLMREVGFKPSTPLTVGIERFVCWYRDYLSAASPVVRTTTTVRPRWPAVAPVEVAG

SEQ ID NO: 74023 - protein, 295 aa, Burkholderia vietnamiensis G4
MLKVTKAVFPVAGLGTRFLPATKASPKEMLPVVDKPLIQYAVEEAINAGITEMIFVTGRSKRAIEDHFDKSYEIEAELEARGKEKLLELVRGIKPSNVDCFYVRQPEALGLGHAVLCAEKLVHGEPFAVILADDLLHGEQPVLKQLVDVFDHYHSSVIGVETIAREDSRSYGVVEGREWEEDIIKLAGIIEKPAPEDAPSNLGVVGRYVFMPTIFDHLRRIKPGAGGELQLTDAVQSLLANEQVLAYRYYGTRFDCGSKLGYLKATVEFALQHPEVSREFEAYLRTCLPALAAVA

SEQ ID NO: 74024 - protein, 573 aa, Beta vulgaris
METPEVPIRNPAHKIIAVTAGEAHTLALSEVGKVFSWGRGTFGRLGNGSESDESFPVPIKLDNDGSLNEKPLNFVGIAAGAYHSLALADDGSVWCWGYNTYSQLGFDGDNVSVPRQLDKLLQLDSPRSLGDDSKGKSKHPLKVCAIEAGGMMSVAIDNLGALWMWGNIPQQSSPEDDAFSLGSVPTPVPMFDFYGHTVVKVACGNEHIVALVSAGEKHVGDDLVCYTWGNNMHGQLGLGDTESRLHPQAVAQFSEGSAWRAYEVACGAFHTVVLSLKKRPSDTLESVCWTFGLGENGQLGHGTTQSVSLPEPARELPENAYFVSVDCGLFHTSVVSSAGEVWSWGMEKGLGLCPDVSFSGIDHGDAILPLQILCNRPQGPKFPEPVGIACGAAHTVLVADDGYKLWSWGRGRSGVLGDGKGSDSYSPSMVLWPPLSEDFKDGLNSPDTESKKPEKKAEVTEVDEKVSPTLEEMKRLQSKLSVMERYVTILHGSLFGRPFEEREIPASLLESDSFDVSEAWKTMLEAADRKELRRLEMFYGNMLDGVKDKIMKRKIQEIVRECLQSSSTPTTQY

SEQ ID NO: 74025 - protein, 483 aa, Rhodococcus sp. RHA1
MTAAVTENNGAGSGSSVAGRVVRVIGPVVDVEFPRGAIPELFNALHAEITLPSVAKTLTLEVAQHLGDNLVRTVSMQPTDGLIRGTSVSDTGKPISVPVGDVVKGHVFNALGDCLDAPGTGRDGEQWGIHRKPPAFDQLEGKTEILETGIKVIDLLTPYVKGGKIGLFGGAGVGKTVLIQEMITRIAREFSGTSVFAGVGERTREGTDLHLEMEEMGVLQDTALVFGQMDEPPGTRMRVALSALTMAEYFRDVQGQDVLLFIDNIFRFTQAGSEVSTLLGRMPSAVGYQPTLADEMGELQERITSTRGRSITSLQAIYVPADDYTDPAPATTFAHLDATTELSRPISQMGIYPAVDPLTSTSRILEPGIVGAEHFRVANEVKRILQKYKELQDIIAILGMDELQEEDKVLVGRARRLQKFLGQNFIVAEKFTGEPGSVVPLRDTIEAFDRICKGEFDHLPEQAFNSCGGLDDVEAAAKKIAGK

SEQ ID NO: 74026 - protein, 527 aa, Chlamydomonas reinhardtii
MSEPGEEPVAAPAGPAPDPVLNELYGSERPAVELLPGVPLSPIVNSCWLPADAKAMLAESWIPVPPEDAGEEAGPPPPAFEAAAPEYNELVRRLAKTAPFRKWNELTIQAKQLEQEVAGLKGPDAEAKQAELENVKVQIADAEAAVAEVKQSFSDDPLSLTGWMQALTDLADGGMTTFEVSGQGWPYCSLRQLFGEMPSAAPPAGFFDGVERVLGTFKRRYEKERGPGSVQLMLKLAPNVFSDAWSTGGAPAAVAAVEAYVERARANVFGPDGGVTPEGVPEPLDLVQLVWWDFAAADPLPVLKALQRMATDQLQVDEDSGEVSVSEPKKIRGIGLVDFPADRLKAAIQAGVPITCVQVEHSVLVRSAQPVLDLCAKYGIKVLARGGTLGGLLSAKYLGAPPPDPVRGDADLDSVPGCLDAVNNVGGWARLQAALAVIKGIADKHGVKPETVALRWQIDAGCFPLVTTRWSSRVWRQFGYEGWSSFEVSGGRPGVDGPLFQVESFLDVEDVRALAGLAAVHLGPKAG

SEQ ID NO: 74027 - protein, 409 aa, Chlamydomonas reinhardtii
MPGKKAVLIGCNYPGTNAALRGCINDVWGMKEILITYYGFTDADLTILIDTDKSYLQPTGKNIKAKITEMVSAAQDGDVLFLHFSGHGTQIPSADGDEKDGKDEAICPTDMNLICDDDLRVLLKPLETKPGVKFTFIADCCHSGTLLDHESVQISGPKSGAPPPPAIDMGALAGFLGALGQPDGRDLKNRALPFSELCGMLSQLLGGVPVDARTVRSSMGTIFGADSSAKIQQFIGMYQALTAGTKGAAAGGAGGILQMLCACLAPPADQNGPSGTPANAQSGPGAHYAAPAAAGNLAEPDLKVNYTPGAKPPANEQLGADVGILITGCQSNETSADACPSGNPDKAHGALSNAIQTVIKQQQQQSPGQPITYRNLVIAVREMLTKTGFAQNPCLECSNKNADTPFIVC

SEQ ID NO: 74028 - protein, 510 aa, Acidovorax sp. JS42
MQDILDQLEKKRELARLGGGQKRIDAQHKKGKLTARERIELLLDDGTFEEWDMFVEHRCTDFGMENTKIPGDGVVTGYGMINGRLVFVFSQDFTVFGGALSETHAEKICKVMDQAMKVGAPVIGLNDSGGARIQEGVASLGGYADVFQKNVLASGVIPQISMIMGPCAGGAVYSPAMTDFIFMVKDSSYMFVTGPEVVKTVTHEEVTAEELGGAVTHTTKSGVADMAFENDVEALMMLRRLYNYLPLNNREKAPVRPSNDPADRMDLSLDTLVPENPNKPYDMKELILKTVDDGDFFELQPEYAKNIIIGFARMEGQTVGIVANQPLVLAGCLDIKSSIKAARFVRFCDAFNIPVVTFVDVPGFMPGTSQEYGGIIKHGAKLLYAYAECTVPKITVITRKAYGGAYDVMSSKHLRGDVNLAWPNAEIAVMGAKGAVEIIFREDKNDPAKLAAREAEYKARFANPFVAGARGFIDDVILPHETRKRICRSLAMLKNKQLDNPWRKHGNIPL

SEQ ID NO: 74029 - protein, 894 aa, Rhodospirillum centenum
MSSKWVYSFGEGRAEGRAEMKNLLGGKGANLAEMSNLGLPVPPGFTITTEVCTWFYANGRSYPADLRAQVDAALAAVEAVVGMRFGDARNPLLVSVRSGARASMPGMMDTVLNLGLTDATVQGLADRSGDARFAYDSYRRFIQMYGNVVLGVEHHHFEEVLEEVKRERDYTFDTELKAEDWQAVIAGYKAVVDRTLGRPFPQDPVEQLWGAIGAVFGSWMNQRAITYRKLHDIPADWGTAVNVQAMVFGNMGDDCATGVAFTRNPSTGENRFYGEYLINAQGEDVVAGIRTPQHLTIAGKEANGSTLPSMEESMPEVFRQLDAVRLKLERHYRDMQDIEFTVQQSKLYMLQTRTGKRTAAAALKIAVDMAREGLIDERTAVLRIEPKSLDQLLHPTLDPKAKKQIIAKGPAGLAGAASGKVVFTAEEAERLSELGESVILCRVETSPEDIHGMHAARGILTTRGGMTSHAAVVARGMGRACVAGAGELRIDYKRGTMLVRGVEVKAGDILTIDGSTGEVMLGEVPTIQPELSGDFALLMGWADRFRRMKVRTNAETPLDARTARKFGAEGIGLSRTEHMFFDADRIVAVRGMILADTEAGRRAALARIEPMQRQDFVELFKIMTGLPVTIRLLDPPLHEFLPASEAEMEEVAASTGTDLQKVQQRAHQLHEANPMLGHRGCRLGISYPEIYEMQARAIFEAAVVVFQETGETVTPEIMIPLVGTRKELDILKAVIDRVATEVSQRSNRPLDYLVGTMIELPRAALRAAEIARTAEFFSFGTNDLTQTTFGISRDDAASFLPDYQRTGIFEQDPFVTLDTDGVGELVQIAAERGRGARPGIKLGICGEHGGDPSSIYFCEKVGLDYVSCSPYRVPIARLAAAQAAILGEKAASEA

SEQ ID NO: 74030 - protein, 426 aa, Azoarcus sp. EbN1
MTIIAVIGLGYVGLPLAVEFGKKFKTIGFDLSADKVAAYRDFVDPTGEVSSDDLRAAIHLGCHSDPAHIREADFIVVAVPTPVDIAHKPDFTPLIHSSETVGRNLKRGAVVVFESTVYPGATEEVCIPIIERESGLKWKQDFFVGYSPERINPGDKERTVTKIVKVVSGDTPQTLQKVKEVYGAIISAGVYPASSIKVAEAAKVIENTQRDLNIALMNELAVIFHKIGIDTTEVLQAAGTKWNFLPFRPGLVGGHCIGVDPYYLTHKAEMLGHHPQVILAGRRINDGMGKYVAEQTVKQMIQAGHSIRGCDVIVLGLTFKENCPDLRNSKVIDVIRELESFGCTVHVHDPVAAPAEAAREYGMRLEPWEALPKAAAMVAAVSHAPYLDMQLDEFAGKLLPGGVFSDVKSSYDADALAKAGVTVWRL

SEQ ID NO: 74031 - protein, 375 aa, Pyrococcus abyssi GE5
METLLMLALMLAVAKLSGWVFERFNQPIVLGQIIAGVIMGLLIERNEIIVEFANLGVLMLLFLAGLESDFEEFKRVGRPSILVASVGVLFAFLFGFLIAYPFFDFGTALLYGAIMTPTSVSITVKVLMELGKLRTKEGATILAAAVVDDVLGILILTIVISMLREGSVHYDVIVEVLLEVAGFLAVFLYLGPVVMENVFRRLSKVDLPESTTSFAIVFLVLFAYLAEHLNLASILGAYLIGLSIGQTSYKKRIEGPMNVIGYSIFIPVFFVEVGMRIDPRFLFEAKTFAFLYAVFAMISKVIGCGLGAYLSKFDWRTSIKIGIGMIPRLGVELAMISTAMAAGVAGSDVLTVAMTMVFLTTLITPIMLRKTYIIT

SEQ ID NO: 74032 - protein, 604 aa, Arabidopsis thaliana
MHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKWRPMVLPDRYIEHGSPMDQLAEAGLTASHIAATALNLMGTPREALFWE

SEQ ID NO: 74033 - protein, 521 aa, Chlorella vulgaris
MAAIAESPSTELQGEASGYSNRDEWHCGFSEELCLTIVVAGASGDLARKKTYPALQFLFQHGFLPSNVAIIGYARTDMNDDKLREKLKPKLVGSDDDIDKFLKRCTYVAGSYDGAEGWQGLAKVLDKRESKCSKNPAGRLYYLALPPSVYPQVCAGLKEHCDNLRSVEGSWIRVIVEKPFGHDLQSSEQLADQLGKLYPEHQLYRIDHYLGKEMAQNLFVMRHANMFLAPVWNRTCISNVQITFKEDFGTEGRGGYFDTFGILRDVLQNHLAQMLAMVAMEKPLSVHPDDLRDEKVKVLRCIKPVEPHNVVLGQYTAANGQPGYTDDPTVPDDSKTPTFAAVTLYIDNDRWAGVPFVLKAGKALNERKAEIRVQLRATPHFVFNGEPESMRNELVVRLQPDEAIYLKMIVKKPGLEFDAAISELDLDYSRQYPEVDIPDAYPRLILDSIRGDQQHFVRRDELRAAWGIFTPLLHKIDAGEVEVHPYPYGSRGPAEADELLARADFVKNVAYNWKDPGSCKL

SEQ ID NO: 74034 - protein, 466 aa, Pyrococcus abyssi GE5
MINMTKWDEIKKYTSKKVDENLKIVELDEEYLPRAIGFKYYPLVIERAKGSRVWDKDGNEYIDFLTSAAVFNVGHAHPKVVEAIKEQVDKFLNYTIGYLYTEPPVRLAELLSEMTPGDFEKKVTFGFSGSDAVDSSIKASRAYTKKVHIISFRHSYHGMTYGALSVTGIVDEKVKSIVQPMSNVHIVDYPDPYRNPWNIDGYENPSELANRALDEVEKKIKELNGDVAGIILEPIQGDAGVVIPPLEFIKGLKKLTDEYGMVFIDEEVQTGMGRTGKWWAIEHFEVVPDLLVSAKALGGGMPISAVVGRAEIMDSVPSPLFVFTHVGHAVNASAAIATIKVIKEEKLVERAKELGDYALKRFRELQEEYPIIGDVRGKGLMIGVDIVKEGTKDPNRELAQKICWRAWEKGLIIITFGKHGNVLRIAPPLTISKEDFDRGIEIIEEAIKDAINGKVPDDVIKFLRAW

SEQ ID NO: 74035 - protein, 70 aa, Oryza sativa
  misc_feature (62)..(62): Xaa can be any naturally occurring amino acid
LCPGGGYTIEVEIHDGPYNVIKNWNYTGVVEAFQNGEGKCYTAKVRTEEELKEAIEEAQGPXKKDCLVLA

SEQ ID NO: 74036 - protein, 465 aa, Ehrlichia ruminantium str. Welgevonden
MQNYDIVVIGGGPGGYKCAIRSAQLGLKVACVDKNEILGGTCLRVGCIPSKALLHFSHEYYHIKNHLDEVGITCNSLSFNLDKIMSFKNKNITELSNGINYLFASNKIDRLCGVGKIRSINSNNFDITVTGNNGEEKITAKYVVIATGSEVASFPGIEIDEKNVVSSTAALSFKEVPKKLVVVGAGAIGLEMSSVWSRFGSEVTVVEFFDKIAPSMDIDISKALLASLKKQGINFKLSTKVTSIDKSSDNLTIHLESVKDGKSEIIEAEKVLISIGRMPYTDGLIDQNCIECDSRGFIKVNNKYETNIPGIFAIGDVIGGAMLAHKAEEEGIAVAELIAGNIPHVDYDIIPSVIYTHPAVASIGKTEESLKNINYAYNVGKSNFSANSRSKITNNGEGFVKVLTSKENNAILGVHIIGAYADTIINEAAIAMAYRASSEDVFRISHSHPDVNEAFKDACEAAYLK

SEQ ID NO: 74037 - protein, 379 aa, Coccidioides immitis RS
MMPDEALTRPHATASTKSSHPASNLGSSPYGTSRSGHEAGFVQPSSYLRPRAASRPIVPVERPVDREERQALWHIRDFLKSHTSYDVLPLSFRLIVFDTSLSVKESLNILIQNGIVSAPLWDSHTSTFAGLLTTSDYINVIQYYFQNPAALAKIDQFRLSSLREIERALGVAPPETISIDPEKPLYQACRYMLSSRARRIPLVSYDSQTDRPLVVSVVTQYRILKFMAVNVPQTQSLRKPLKEIGLGTYKNIVTASIDTPVIDIIHKLVERSISSVPIVNSEGVVYNVFEAVDVITLIKGGVYDDLSLPVGEALKKRSPDFPGIYTCSVEDGLDTILDTLRKSRVHRFIVVDEFFRLKGVLTLSDILHYLVIEGELDEP

SEQ ID NO: 74038 - protein, 168 aa, Triticum aestivum
  misc_feature (20)..(20): Xaa can be any naturally occurring amino acid
  misc_feature (98)..(99): Xaa can be any naturally occurring amino acid
MLLCMQSAEAAKMVKICCIXVGYVRGPTMVVIAIKCPTIEVVVVDISKPRIHAWNNDTLPIYEPGLDDVVKACRGKNLFFSTDVEKHIAEADIIFVSXXTPTKTRSLGAGKAADLTYWESAARMIADVSNSDKIDVDESTVPVKTAEAIEKILTHNKKGINYQILTNP

SEQ ID NO: 74039 - protein, 376 aa, marine gamma proteobacterium HTCC2080
MSKRDYYEVLGVDRSTADPDIKKAYRRIAMKFHPDRNPDDKDADAKFKEATEAYDVLMNADKRAAYDQFGHAGLEQGAGGGGFQGGSNFSDIFGDVFGDIFGGGGGGGRQGPQRGSDLRYTMEVSLEEAVRGATREIKVPTLQHCNTCDGSGAKPGTKPVTCGSCGGAGQVRMQQGFFQVQQTCPKCRGQGKTISDPCRDCRGQGLLEKTKTLSVKVPPGVDTGDRIRLSGEGEAGPSGGPSGDLFVQIAVRQHNLFERDGRNLYCEVPINFVDAALGGELEVPTLDGKVKLKIPSETQTGKMFRLRGKGVLPVRGGPIGDLMCRAVVETPINLSAQQKQLLQEFRSTLDEGGNRQSPRQSSWFEGVRSFFDGMTK

SEQ ID NO: 74040 - protein, 501 aa, Ehrlichia ruminantium str. Welgevonden
MTNHSVILCILDGWGNNKNSQFNAIAQADTPYWDSIISQYPQSNIVTHGPDVGLPDRQIGNSEVGHISLGSGRIVLQDLCRINEEIKNIRKNTHLLEFTEQIKRNNGICHIAGLLSDGGIHSSLSHMLDIIDALSYLKIQVVIHIFLDGRDTPPISALKYINILCSHIKDLSNVSIATISGRYYSMDRDNRLDRTTKAYNSIAFGHGKRYEDPISAVQDNYNAGITDEFIIPCVIGNYQGMNPTDGFIMTNFRSDRVIQILKMITEDQNTNHITLKNTIGMIKYSNELNIPCLFPNKKISNTLGEIISNQQLHQLRIAETEKYAHVTFFFNGGREEVFENEERIIIPSPSVTTYDLVPEMSAYEITDTLIKKINLQKYSLIIINYANADMVGHTGNIEATKKAITTLDQCLGKILKCIHNTNYILVITADHGNAEEMFDVQNNMPYTAHTLNPVPFVVCNYPKKIKLKNGRLSDVAPTILEILNIKQPEEMTGISLIDTSN

SEQ ID NO: 74041 - protein, 374 aa, Ehrlichia ruminantium str. Welgevonden
MSQIKNYLNAILMLSDGKYFLGKSIGNKSNAVGEVCFTTSMTGYQHTITDPSFAGQIITFTFPHIGNIGINKEDFENTQVLAHGIVVKTISEDSHSSSYSNLENWMIENKITGISEIDTRALTRHLRNYGSQNGIIHHFHDMNSLNLKELQNTASQYNYVNHCQSISQAFISDYNQEPKYKTLYNIVVINFGVKSSILNALSNIGCKVHIVPGHEFNLIDKILSFNPDGIVLSNGPGDPSAISEHTIQQIRSIIELKVPTLGICLGHQLIALALGAQVKKMLFGHRGSNHPVYNKMLNNIEITSQNHGFTIDENSLSSNIQITHTSLFDNTIEGIKVENYPIISVQYHPEGSPGPNDTKYILEDFVNLIQEKTV

SEQ ID NO: 74042 - protein, 296 aa, Physcomitrella patens subsp. patens
MSLQDVEELKANLYSYKEQLQQVKELLVVDPNNEEYQEMEKGLTEVSISEKALRGCDPCECWLDYANGGGQSVCGRLRDSWKKLQQRQGYAVSVGRLAVGTKVQAMWSEDGQWYKATVEAVTPGGYFVVYDEWGNKEEVCAEVVDDANVDPLLSAEQQANLTKLALKRKIEEAAKIDVISKDLPPKLRIKPDDSEDVKAAKKKKIHAFKSKARLEQMELTQNKHQNAWQQFQTTKGKTKKQVGFFTGRKRESIFKTPDDPKGKVGVTGSGKGTTEFHKREKHLHLKVGGVDGDDYE

SEQ ID NO: 74043 - protein, 204 aa, Zea mays
PPAWGTEAKPKRPFPFALFDPSKKTAAEMVYYALLVGAELDGLTNLQPSGGCDDPSFPYYLKLKCENCGEVTAKSTYVTLSEQVDLPKGHGTAHLVQKCKLCGRDGTIVMIPGQGTPLTIEQSQKEEKTCLMVFDCRGYEPVEFSFGAGWKAESVHGTPFEIDCSEDEFSEYDEKGECPVELSKLQSTFKVVKKHEKGGKTRFV

SEQ ID NO: 74044 - protein, 2455 aa, Ehrlichia ruminantium str. Welgevonden
MYNFIKNHFIKLLLLLLMTACESNQHPVPRCVPADVFTEGRTTSVSAYFDPTSENFMSDNKALGNSVEDNQVVRWKYTGYVTNGHPIVLRAEGMWTSWAKKSNNVTEVQKNTTDYGDDDVDRYNAILAVDRVCGPYKKIEKTFSNGTNQCKVSCEMISGVQDNLETGTYGPPCWFRNGYGAYLLFKRPEDPEPNETITNMRYPTSPVMHIGYKPLELAGTHGISTSSKKIKDSSCKDVELKPGWKIYIKILDRNYYDNVGGYTVTFIDGIKAEQEFSAFEWVRKEVRGRLDKAGEDLFKNIVKNPVFKNFVFSLLTLFLIFGSLAYILGIVRTPFADIIVRLLKISLMLLLISPNSWDFFYNHLLRLFIHGTDQIIAMINSYTGDYNPQAPFSFMDIMIRDKIFSPVIWKIKIRALIVANFSSIFAVLVIVIAVLIYIALCIYGFVIYLTAFVGITFLVGLMPLLLLGILFSQFKSLFDGWLTQCISFSLQAILIFTLISLFGTLIMNYYYRIFGFTVCYNEWMKVKICLFGRVGCLVDKSLFGWTPGQMYDPKVIGITSDFNVSDKKASSDDPDDIKMSGNARYKFTGGGGYISVPPDHKYKDFRYIDYPFLDPDTESDSNPHGVNVAKDSPFKELSHLVNALLTTDKKYIVARLVADIKTELEKLVKNKTITSDSQNKVLKIIDDRIKKDKDAGKSELDKYGDQSFKSQIIRSVIDNVIDGAAITPTSQEKLNEQYDYALIQGIRAGDLILWSEVGSLFLAALLIWQMRAFVQSVAVSLAGGSMMSQTIASMYEEGFLKTFSSIPVVGKVFKTIDGGLDSYKLLVGNYITETARRPLNMLQKVPVLGHAVKFTGKVAGGLTSSYGEYDRRHSSNFKQLNYARAFIGAHLGFSPLSAMKYLGGYAAGKMLGSRSGGLIHNMVQDRKAALDSLKAHILGPEQHKPSPYIPKQKEDDSNPFVKNDAKNLVGDSSSPGSKNYEGNVRGEPHSIARTDTGNVRGDSYDTNYAGNVIGDAAVAKGYAGGVVGSSGPITRLELQNQHSLLDDAGNVRVGKDNLADALEAREQLKTMRENTKDETALININYDIDRLDSALHKHLGHDFEQVTQDYANSHMAVQHSSDLSATDYSRLNIDDISRLDGTAQISSASVPDTGQDILHSNAAAQSSMLDVGRDEISDFISASALKEETIPHEVIELNVLGTSSGQSLSSETGVHVQDEVQVDRSEAVTSPSDTTQPSALDVELSGDRVSEISSTGVSQGETSPEQQLSSEVGVYVQDGVQVERSEAVTSPSDTTQPSALDVELPGDGLSNISSTGVSQGETSPQSEEIELNVLGATPEQQLSSETGVHVQDEVQVDRSEAVTSPSDTTQSSALDVELPGDGLSNISSTGVSQGETSPQSEEIELNVLGATSEQQLSDEVGVYVQDGVQVERSEAVTSPSDTTQPSTLDVELSGDGLSDISSTGVSQGETSPQSEEIELNVLGATSEQQLSSETGVHVQDEVQVDRSEAVTSPSDTTQPSALDVELSGDGLSDISSTGVSQGETSSQSEDLEAIFDQTLISENESYASTSDHDRESVASDENVLLGHENFDSLLDTDPLSHDTQESTDFIDEKSSNEFEESKELVDHKDTIESIPDVDHTSDAFGKELDVPQTSDQELIDMNAEGNSSVNVLSDQYQDTASELSSSESSDGTESRGSESDDQVLEPELQANTYYATDNEVLDVASLELGLPGVAVGNVEPVQEGSETKPEAVEVEGNESEGVVNVTEEHSDSAASSESIDKESSEDSQLDQTSMEEQDKVGEFERDSNAEDTSVDKEVSEKPDIVEPAPEDSGTKPEAVEVEGNESEGVVNVTEEHSDSAASSESIDKESSEDSQLDQTSMEEQDKVEEFERDSNAEDTSVDKEVSEKPDIVEPAPEDSGTKPEAVEVEGNESEGVVNVTEEHSDSAASSESIDKESSEDSQLDQTSMEEQDKVGESERDSNAEDASIDGKEVSGKPDIVEPAQEGSETKPEAVEVESNESEGVVSVTEEHSDSAASSGNIDKESSEDSQLDQTSMEEQDKVGESERDSNAEDASVDKEVSGKPDIVEPAQEGSETKPEAVEVESNESEGVVDVTEEHSDSAASSESIDKESSEDSQLDQTSMEEQDKVGESERDSNAEDTSVDKEVSEKPDIVEPAQEGSTEEESTSVLDEDSKRDVEESEEEGHDTSSDEGTEVDEVDSDGDSADVEKGSNDTLENDLEAEESKVELTEELAVKDMPEESVTEGHGMKKASVVTDDMSEGLAAVHQVDSGKEFKLQEKMGLEGAQSIHIPKSLKSEEKDAVSKKSSTAKKTESTDSKDNAKEKKGTSTSNKTKKTSLPKIMSGVKILVNQYAKQISTGLSESFDKFFEDTESKKRGKRKLSKEDIESMVRDLEQLLVSLKDKKSKLTDPSEIANIEDDIRKLESTIKSILDNQ

SEQ ID NO: 74045 - protein, 425 aa, Bacillus israeli
MIVAEGQKITMTNGTLNVPNDPIIPFIEGDGTGPDIWRAASKVLEAAVEKAYNGEKKIVWKEVLAGEKAFKETGEWLPQETLDVIREYMIAIKGPLTTPVGGGIRSLNVALRQELDLFVCLRPVRYFNGVPSPVKRPQDTDMVIFRENTEDIYAGIEYAKGTEEVKKVIEFLQKELGVNKIRFPETSGIGIKPISEEGTKRLVRAAINYAIEHGRKSVTLVHKGNIMKFTEGAFKNWGYELAEQEFGDKVFTWAEYDRIVEKEGKEAANKAQEEAEKAGKIIIKDAIADIFLQQILTRPREFDVVATMNLNGDYISDALAAQVGGIGIAPGANINYETGHAIFEATHGTAPKYAGLDKVNPSSVILSGVLMLEHLGWKEAADLIIQAMEKTIASKVVTYDFARLMDGATEVKCSEFGNELIKNMG

SEQ ID NO: 74046 - protein, 1529 aa, Ehrlichia ruminantium str. Welgevonden
MKNSIILLMLCFITGCGINCIEGSKGVSSTSVSVDVPPVAKVSIITKKVKEKNGKETTIDYRKVHPNWIDTGIRVSENQKINLTINGSVNLCPKDSFNPREIIVPAISCQYGVPDDEYQNESTYFHIRKVCGEAFKNQVKDNAKQKLIDSVIFKRGVTGNQEQSKKQQPTKQQVDQMIFAPDVHTVSTFRLNKGDVFRVNLVPRTVKVKGCSSAELKGLGIIYYSDNEIFEDDQCSKPVKAEYICKNGIQSFSMKIGDEQACINFTEGAGAINRLQGTEVSALVDNRYSPRGNKIFYTNDSKKNWIEAPFIYDARTVKNQKSIDKLKDQCEIIKELNKKNMISHIVNTSTSDADILKYYKEQKERNIIKSEVTQDTIDVLNSFTTYDINCVCGTVCKSDQSLSQQSRISSILTLNEGSSECSVANNSDQEFKNATKEDLEKKDWTKQEWKKDVKTEIIVGLTAYFRLFDNRVDRKSREPLHRCFPSESNSQGFRCISAIFGKSVEENSIKSNVNYTYGFDEPVVLKFGIIGGYNQYAGYSGGYNIHVERMCNFVDGKKLYMYIGNTPPTMLPGSNNTVELFVPKKGKDGKQSTSGTATYTINDDNSQKKSGTIYLGVDVQGYEDQFDYRSMPSVESDNKYTVDFAINRWNPNFSKAFVMIRDFLLKVLYGLPDNQKVSSISQAMDVVRTTKSKGAVQHIYTNQTTSGKLWRGVQALCTLYIIFTVLGYVIGVVKCTKYDLGVRIAKIAVVVGLLSQDSWELFSSHFFSLFVQGVSDLISTFNGELDGDNSFAFLDPTIGVLLTGEVWIRFLTLIITGPIGWLVFAMIIWAVFVFFVCIIEAVIAYLFTIVAIAFLATLAPIFITFLLFQLTKTLFDSWIKMLVNFSLQPIILFAALAFLNQVMLTVLHDVTGFTVCNQCFIGLSLPASVTEKGAPPDVCVMPVLLPVGYASELSIDDAVRESDSRDGRIGFLGLPFGITSVLILLITANAMKAFRGMSEAISQSISGSVAGIGASLHAATQSLASIVGLDQETQSIIKNAMANRRSTGQSDVNISSRANPNPVNEGESLNKDGDDSSNRPVTGDHDKLGSSSVSSGENFDSDEKHQVSSGSRYGPVDDTLINSTKGQVLDTDSSHYKDNGDGVKDTSGNVMDDGSTKTRDNVPDEGSTTNRNDSTQDNIDGKTVEESVATGDGDMQGSNDSDIGDRDGSSSAEDKVPTDNENQNDNDNAQQDGSNVEEESHAADRHDTIDSEDSTDDTSDSSVSEGESDVSESDVESSGDNTTEVGSNTDDKTPGDDDNKDESVQQNESDLGEESNTTDRTDTMDSTDDTSDSSVSEGESDVSESDVESSGDNTTEVGSNTDDKTPGDDDNKDESVQQNESDLGEESNTTDRTDTMDSTDGTSDSPVSEGETNGSGSDVESNTSENDSDDKNLNTNTTVDENNNTNDMQDAESKASSAVDDSSSESEGVGKKRGKRDINFLDGPQKRRLYMDEYSSVKEKIAGHQSAIDVETESHERSQVKRRGKKKDE

SEQ ID NO: 74047 - protein, 213 aa, Hordeum vulgare subsp. spontaneum
MANKDLSLSLFLVLLGLSASLASGQVLFQGFNWESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGGTPDARLDWGPHMICRDDRPYADGTGNPDTGADFGAAPDIDHLNLRVQKELVEWLNWLKADIGFDGWRFDFAKGYSADVA

SEQ ID NO: 74048 - protein, 213 aa, Vitis vinifera
MAKGRKLTTSRSERLLGSFAYGHGQGAGADSSELGEEDVWSMVDDMVERDDHVNGGGGGGGQSDWSPRAGGEPAMRNHHHRRRIPRDDRHQVGGLSLAFDDSGKTTSSRIVHQYRPQDGVTPSPRGHHMATSAPVNVPDWHKILRVDSVESLHDSDDDRELEMVPPHEYLAREYAASRKMAATSVLEGVGRTLKGRDMSRVRDAVWSQTGFDG

SEQ ID NO: 74049 - protein, 68 aa, Zea mays
  misc_feature (56)..(56): Xaa can be any naturally occurring amino acid
FFLLPFSHFARPFTSQYEAKLLPGLIYRMKQPKIALLIFVSGKIVLTRAKMRDETXAFEIIYPVLIKS

SEQ ID NO: 74050 - protein, 204 aa, Fagus sylvatica
GTRIAFALDIARGMEYIHSQGVIHRDLKSENVLIDQEFHLKIADFGIAYEEDYCDSLADDPGTYRWMAPEMIKHKSYGRKVDVYSFGLILWEMVAGTIPYQDMNPVQAAFAVVNKNLRPVIPRDCPPAMRALIEQCWSLQSEKRPEFWQVVKVLEQFESSLARDGTLNLVQSLTCQDHKKGLLHWIHKLGPVHPNGSMPKPKLT

SEQ ID NO: 74051 - protein, 196 aa, Actinobacillus pleuropneumoniae serovar 1 str. 4074
MALVPIVVEQTSKGERSYDIYSRLLKERIIFLTGQVEDHMANLIVAQMLFLEAEDPEKDIYLYINSPGGVVTAGLAIYDTMNFIKPDVATLCTGQACSMGAFLLSGGAKGKRFALPNARVMIHQPLGGARGQATDIQIQAQEILKLKEMLTRKMAEHSGQPFEKVAADTERDNFMSAVEAMEYGLIDKVLTHRDMK

SEQ ID NO: 74052 - protein, 307 aa, Zea mays
  misc_feature (50)..(50): Xaa can be any naturally occurring amino acid
MAMQAARRLASLKLQRRLLLPSQAESPSISIPTAAAAAAFLHSHARASFXGYKQVREEDKSKLVGNVFSSVASSYDLMNDLMSVGLHRLWKDRLISKLNPFPAMKHLDVAGGTGDVAFRVLERIKSVSHRAMQGTLTETEEDTHIYVCDINPNMLNVGKKRAAERGYSEEHCLSWIQGDAEALSFEDGSMDGYTIAFGIRNVTHIEKALSEAYRVLKRGGRFLCLELSHVDVPVFKEIYDVYSFSVIPTIGELVAGDRQSYQYLVESIRRFPNQEKFAQMIQEAGFQRVEYENLVGGVVAIHSGLKL

SEQ ID NO: 74053 - protein, 314 aa, Azoarcus sp. EbN1
MPLSSQAKALLDMVYRVGAPRFHELSVDQARHSFRKLQWAFGLPSPAVAATVEVAMTRVDGSTLNARLYRPLESSRDDELPLLIYFHGGGWCVGDLESYDVLCRQLANGSGCAVLSIDYRLAPENPFPAAVEDAIFSIEWAAEQAQRLGIDRGCIALGGDSAGGNLSIVGALLAHERASVAIRFMFLVYPSTEIASDRPSRQLFGQGYLLDGESLEWFYGHYLPAGNDEDWRASPMRAPSLAGLPPILLVTAECDPLADDCMAFAERVRAEGGEIEHVAVDGVVHGFITLGQFFPEATHAVDRITAGLRRAVRP

SEQ ID NO: 74054 - protein, 360 aa, Rhodococcus sp. RHA1
MTGTRNPVHTPWPGLIEAYRDRLAIGPNWKTVTLREGGTPLLPAGHLSELTGCDVYLKVEGLNPTGSFKDRGMTMAVTDALARGQQAVLCASTGNTSASAAAYAAKAKMTCAVLVPQGKIAMGKLAQAVMHGARIIQVQGNFDDCLELARKTTAEFPTIGLVNSVNPVRIEGQKTAAFEICDALGKAPDVHALPVGNAGNITAYWRGYSEYYADGLTSVKPRMLGVQAAGAAPLVHGAPVKDPETIATAIRIGSPASWNGAVTAKEESHGAFRAATDDEILEAYRLIARTEGVFVEPASAASVAGLLAARKEGWLDSGLTVVCTVTGNGLKDPDTALAGMPDVQPIPVDPVAVASALELA

SEQ ID NO: 74055 - protein, 494 aa, Bacillus anthracis str. Sterne
MESMTFVLFGATGDLAKRKIYPALYNLYRDQKLPKQISVIGLGRREVSHVDFQKRIKESIETFSRHREEGTPELEGFLDNFRYCPLDVSKPEDYERLLQVVREREEELHIKGNRMFYLSGAPEFFETIALNIKESGLDKTDGWKRLMIEKPFGHDLTSARELNDKLSRTFEEDEIYRIDHYLGKPMIQNLEALEFANPVLQSIWNKEHIANVQITASETVGVEERAGYYDQAGAIRDMVQNHMLQILMMTAMNLPEKVNACEIREEKRKVMEALRKVKKEDVQNHIIRGQYGAGEINGGQVVAYKEEPGVNPSSNIDTFIAARLWIDNPFWTGVPFYIRTGKRMKEKSTRIVIEFKNTLKQQYQDSNPNAAPNLLIIEISPGENVSLQLNSKNPLKNGEIEPIRINFTCEQADVGVPEAYERLIHDAVSGDATFFAHWREVELSWEWVQPILEAFEENLLPLHEYESGSYGPEASNELLQESGFKWWLDQETKK

SEQ ID NO: 74056 - protein, 807 aa, Cryptococcus neoformans var. neoformans B-3501A
MTSPSAQPMIPRSQPPRPSHTQSSPAINSTGIKPNGSPSVIRRAPSVPVNPSTAAASGSLSSLLKSENTAQAVSRSSPPTEPNDLPRPIEPTPMLPITGLPNSSSSSSNARHGSSSSISRGPSVTGTLTPATTALGAPIEPTPPQTGASKMAAAAKRGLDGSAGNNVKVYEEGHPLNEETLKQRGYQTLNILNHPFHLPDRWKLLRPLGQGAYGLVIQVQDAETEIPIAVKCVTRVFDKVILARRALREITLLRHFGEHDNLTGLVDMDNVWDGYNEIYLYMEPMEADLHQIIRSGQPLGNAHIQFFIYQLLRGMKYIHSANVIHRDLKPGNLLVNSGCELKICDFGLARGFNPVRGEEPQGEEGKLTEYVATRWYRAPEIMLSNRRYTTAIDVWSIGCILAELLGLKPVFKGKDYIEQMTLILETLGTPDEETMARVASEKALTFLKTLPTYEKKDLGSIFPDADPLAVDLTDKLLEFDPTRRIDVPSALTHAYVERYHDPEDEPSCDKIFDKWEEVESLSTIEELKEAITREIQGFREEVRMAAEEDDEDEEWAEGEYLDDENVFHDSPGPALASTLEKFTYPDHIAPSSSILPSAARLAPIIHQSPKGSKSPHVKSAHLPSVPSSANSSKPSSTAGSAPRTREHSPTTTFITPAEDYFTAQHGFGGPNGRASRRSSSHSTSGRRPASFLFSPFGAGMTQIVPTPNAYPRSHAQASPELTTAEKTPRDRRSSGLWRTRSRAQSQSGNLVLERLSSLEINDHKDGEKNRIDALHAVVGLGGDGEVPPMTVSPSDAPPSEVPKSFGY

SEQ ID NO: 74057 - protein, 323 aa, Vitis vinifera
MSKTSIDIQKRNRSEWPKLIDASFFVQLPQKIQTCLKSHLKRSKNGNEGTNLKASVEKGPSTALGLNLEKQLQHWKENPVWTEQPPEIKVSVPKGSLCKLSVEVDVGLPPDAVYNIVIDPDNKRVFKNIKEVISRRVLLDEGLRQVVEVEQAALWRFLWWSGTISVHVIVDQNREDHSMKFTQVKTGFMKRFEGCWRVKPVFVDEKSCFPFKPKTWDEYYSCTGGKGRIGSKVSLEQLIQPAIVPPPPISWYLRGITSRTTEMLINDLLAEAARIRGISEPKKSVGEPSEQTSYEHQVDEVCDIKERWALRRRNGKQYHKKFP

SEQ ID NO: 74058 - protein, 650 aa, Listeria monocytogenes str. 4b H7858
MILLQVQQISKFFGAEVILDNIKLEVKTGDRIALVGRNGAGKSTLLKIIAGKMSYDGGTISKPKSVEIGYLAQNTGLESSKTIWDEMLSVFDSLRKMEADLRKMELRLGEPELYNDPEKYQALMTDYDTLQHTFKESGGYTYEAEIRSVLNGLRFYPEDYEVEIASLSGGQKTRLALAKLLLAKQDILVLDEPTNHLDIETLAWLETYLQNYHGSLLIVSHDRYFLDKVVNQVYEISRTKIDHYKGNYSSFVNQKQAKLEQMWKEFDKQQKQIAKLEDFVARNIVRASTTKRAQSRRKQLEKMDVLGRPQGDEKAAHFGFQFEKQTGKDVLMVDQLSIGYAKDKRIASNLTFEMKRQDSLALVGPNGIGKSTLLKTLIRDIPALSGEFHFGAGVKIGYYDQEQAKLTSNKTVLMELWDDYPELNEVNVRTTLGNFLFSDDDVLKNVQSLSGGEKARLALAKLTLLEANVLILDEPTNHLDIESKEVLEAALIDFEGTILFVSHDRYFINRIASKIVELAPEKATVFLGDYDYYQEKLAEEKELARLDAEDRRKKGEQVEATSSVRKLNYQEEKEQQKLLRQRKRKLEEVEKSMEATDKKIAELELQLTNPEVFQDHEKALEITQELDAVKADGEKLMEEWEQISEELESM

SEQ ID NO: 74059 - protein, 149 aa, Triticum aestivum
MEQTFIMIKPDGVQRGLIGDIISRFEKKGYYLKAMKFMNVEKSFAQQHYADLSAQPFFAKLVDYIISGPVVAMVWEGKDVVLTGRRIIGATRPWEAAPGTIRGDHAVEVSRNVIHGSDSVENGKKEIALWFPGGLAEWKSNLHPWIYEN

SEQ ID NO: 74060 - protein, 597 aa, Debaryomyces hansenii CBS767
MEGPSNSRRSTVYSAKGMVSSTQPLANSAGIKVMSNGGNCVDACIAISACLCVLEPSSTGIGGDCFALFYKNRDRKVYGLNGTGRSASGLNIDWLKTNQPDHILPSMRFKDDSVFKVQVPGHIAGWYDLHEAWGSGKVTMEEILQPAIDLAENGFVVSQISASLWKEAEEKLKNQNNCDDLSIFLPNEDLTAPVRGQFMKNTHLADTLKIIVRFGKKGFYEGEVAESMINELSKRGSLISMKDLANHTSTFVEPISLSILDHKLWEIPPSGSGIIALLTLGLIDQLDKKGTLKMREMKHNSVEYLHMIIECLKLSFKDSDEYVNDYEFFTKEYNLDQSVSLENLLQPEYLTRRIELFSVDKIISNHEVGHGIPNPMFKSDTVYMTASDSEGNACSFISSLYENFGSGILVPNRGFALQNRGGNFNLNPKSKNCLEGNKRSYHTIIPGMITTPSKLSPLKEDLFASYGIMGGYNQPQAHVQVYLNMLLFNMDPQEALDAPRISLFPHPDFEHTDLGLGSDGPTSRAVTCVGIEDGIATDVIEGLIKLGHETKIFQGNERKLFGRGQIIRKESGPETKGELVYSGGSDMRGDGASVPLI

SEQ ID NO: 74061 - protein, 93 aa, Arabidopsis thaliana
SCATIGACTAQATMGAPFGGRKSYGGFPATRKANNDITSITSNGGRVNCMQVWPPIGKKKFETLSYLPDLTDSELAKEGDYLIRNKWIPCVEF

SEQ ID NO: 74062 - protein, 426 aa, Debaryomyces hansenii CBS767
MSNQGTIYSIPNSKKPTNNKLPNLLIPSPVSINKSDQTYKQPRRKPPPIDFLRIHGAYSNTPDTISPNPSSGTHSGIQSATSDILENLRAHNIGNNTKQNNEQCKNNEQSKNNNDEIQKRVEDLSPDDWNRLANDNQIIELNKLGEGNGGSVSKCTLVNGSQIFALKLINADPNPNIQKQIIRELQYNRVCDSPNIVKYYGTFMVEKQLMIGISMEYMGGRSLDAIYKRVIELDPTNRINEKVLGKVAESILTGLNYLHQQRIIHRDIKPSNILLDSEGNIKLCDFGVSGEVVNSLATTFVGTQYYMAPERIMGKPYTVSCDIWSLGLTLLEVAICKFPFITDDTMVGPIELLSLILEYEPKLNDIPEQGIFWSDSFKNFIGYCLKKNSEERPSPRQMLSHPWCVSQLKIKVRMDKFVKKLWGQLD

SEQ ID NO: 74063 - protein, 589 aa, Physcomitrella patens subsp. patens
MAALKQAASLRGVQGRSWLDSLTLTSGKAENMASVSMGATRRSYRMVAVHAGVSGGKAVKPAQESPHDGTIKSVERVITDDESPKPGFLNGREGSAEATVSITVVGASGDLAKKKIFPALFALYYEGCLPKHFTIYGFARSKMTDEQLRELISGTLTCRIDQKENCGDKQEEFLKRCFYHSGQYSSEESFSELSRKLHEHEGGRVANRLFYLSIPPDIFVDVARSSSSAASSKNGWTRVIVEKPFGRDSESSAELTKGLKQYLNEDQIYRIDHYLGKELVENLSVLRFSNLVFEPLWSRQYIRNVQFIFSEDFGTEGRGGYFDNYGIIRDIMQNHLLQILALFAMEPPVSLDAEDIRNEKVKVLRSMRKLDMANVVIGQYKGHVRGGVKYPAYIDDKTVPNNSNTPTFAAAALFIDNARWDGVPFLMKAGKALHKRGAEIRVQFRHVPGNLYKRSFGTDLDKATNELVIRVQPDEAIYLKINNKVPGLGMRLDRSNLNLHYAARYDKEIPDAYERLILDAIEGERRLFIRSDELDAAWSLFTPLLKELEIRKVSPELYPYGSRGPVGAHYLAAKYNVRWGDNSFEPTED

SEQ ID NO: 74064 - protein, 89 aa, Physcomitrella patens subsp. patens
DTTYTKVFVGGLAWETQRDTMRRHFEQFGDILEAVVITDKNTGRSKGYGFVTFRDAESARKACVDATPIIDGRRANCNLASLGAHRHRP

SEQ ID NO: 74065 - protein, 148 aa, Zea mays
  misc_feature (45)..(45): Xaa can be any naturally occurring amino acid
  misc_feature (92)..(92): Xaa can be any naturally occurring amino acid
MSVCVTGGRQGQVVLAMVFDDARLGGIASSIRVIPDFSKSGIMFXDITTLLLDPKAVRDIIDLFDERHQEQGITVGAGVQARGFSFGHPIGXANDAKFVVLLKSKNLPSVAIFEEYALEYGREQIEVHASVVRATQRALVLDELIATA

SEQ ID NO: 74066 - protein, 178 aa, Aquifex aeolicus VF5
MGYDQLPPGKNPPEDIYVVIEIPQGSAVKYELDKDTGVIFVDRFLFTAMYYPFNYGFVPQTLADDGDPVDVLVISREPVVPGAVMRCRPIGMLEMRDEAGIDTKVIAVPHEKLDPSYSNIKTVDNLPEIVREKIKHFFEHYKELEPGKWVKVENWKGLQDAIEEIKKGIENYKKNKEG

SEQ ID NO: 74067 - protein, 557 aa, Saccharomyces pastorianus
MSEVGDMSTIRQDKVKSKVYETNIDERDVGSVEETVKQGVLHNDRTKLKQGLKERHIKMLTLVGVFGTGLFLSSGGTLKKTGPVGLLIAYLFVGIVVGCNQIAIAEVASFMPATGATIRHAEQFIDESVGFTFGWISTYSSLMPGELSATAVIMTYWTDVSPAIFITVFGVLFVATNIYTIRFYGEIEYIFGWLKVLLIVILIVSGLVIDLGGTKGQERLGFHYWRDPGPFANYLVGGHIGKFVGFWAAISSVVYSYSGIQNIAILAGETKNSRHAIFHGAKNVFLRIIVLYLVTVFILTLIVPYNDKLIATGTGTARSSPFVIAMNRAGIKVLPHIVNALILTSAWSAGNLAIIEGSRNLFCLATKNQAPKIFLRTSKRGIPYVGVIFISSFLPLAYMSCSKSSATVFGWFQELVSSNTLLRWILISANHIHMDRALKAQGYSRSDLPYSTRIGPFAAWFSGIMSFIFLLTGGFYNFIHGHFDIESFFTRYFIIPLAIGLFTFWKLFKKTRYLRPHEVDLESIFEDIKENPEHIEESKPIWAKFSLKKGLKNEEKV

SEQ ID NO: 74068 - protein, 201 aa, Listeria monocytogenes EGD-e
MILLIDNYDSFTFNLEQYLAEFSEVVVKRNDAADLIKIAALADGIVLSPGPGKPSDAGLLEEVVAKFAKEKPLLGICLGHQAIGEVFGGEVKRAAKIRHGKVSTMRQTAGAIFANLPEEMPVMRYHSLIVDKNTLPDVLEVLAIATDDSEVMAMKVKDYPVYGLQFHPESIGTNDGKQMMENFIHIVEGARENGNLTTKSI

SEQ ID NO: 74069 - protein, 556 aa, Campylobacter jejuni
  misc_feature (113)..(113): Xaa can be any naturally occurring amino acid
MRYLAIFAISITLSFGAANPPIQDRTGTGLVLSSHELANKIGKEVLDKGGNAIDAAVAVGYALAVVHPAAGNIGGGGFAVIHLANGENTTLDFREMAPLKASRNMYLDSKGEXIKDASTIGYLAAGVPGTVKGMSAMLDRYGTMKLKDLMAPAIKLAEKGYLINDPQEQTMLEAKDMFKEFPSSSKYFLKKDGSTYKSGDLFVQKDLAKTLKLIAKEGPDAFYKGKIADLIAADMAKNKGIITKEDLAQYQAIWRKPVEGTYRGYDIISMSPPSSGGAHIIEILNIMENANIENLGFASSKTLHIMAEAMRQAYADRSEYMGDPDFVKIPLDKLTSKEYAKEIYAKIPKDKALPSSKVKPGLGQIHEGHNTTHYSVLDSKGNAVSITYTINASYGSGATVEGAGFLLNDEMDDFSIKPGVPNLYGLVGGEANAIEPKKRPLSSMSPTIILKDGKVFMVVGSPGGSRIITTVLQVISNVIDHKMDISTAVESPRFHMQWLPDEIRTEPFGIIKDVQNNLEKMGYKITKEPYMGDVNAIMVDPKTGKIIGSMDTRKEF

SEQ ID NO: 74070 - protein, 172 aa, Zea mays
  misc_feature (57)..(57): Xaa can be any naturally occurring amino acid
  misc_feature (88)..(88): Xaa can be any naturally occurring amino acid
  misc_feature (112)..(112): Xaa can be any naturally occurring amino acid
  misc_feature (156)..(156): Xaa can be any naturally occurring amino acid
DRHLPMLQGELGSGRVRLLLRRDTPCFRGCGMRSGERRRKFVGGCSVRQHRSAIDLXIRKNGENDVPGFTDTEKHNMTGPERAYTIRXIFNLGKVDDELSIWKTYRMTFLNXREGKVTKAPNIQSFVTPLTLSRKRARISNYNSRIARKKAEGSGXQKLLAQRSKGPNGPPR

SEQ ID NO: 74071 - protein, 199 aa, Rhodospirillum rubrum ATCC 11170
MARTPNTDRRQRGGDDQRNRSPRSDERDEEFLDKLVHINRVAKVVKGGRRFAFAALVVVGDGKGRVGFGTGKAREVPEAIRKATDQAKRTMIKVPLREGRTLHHDTNGHFGAGWVTLRSAPAGTGIISGGPMRAVFETMGVQDVVGKCTGTTNPYNMIKATFDALVNSQAPRQVAARRGKKVGDIVARRDGAAAAGATE

SEQ ID NO: 74072 - protein, 280 aa, Leptospira interrogans serovar Copenhageni str. Fiocruz L1-130
MIHLESCASLFYQPTNQKYWKPDTFGFQYKEEIFKTFDGESIRYWRIFPKDSKPKGVVLQFHGNGENRTSHFMSLVWMVNYGYELVTLDYRGYLDSTGVPERETIHKDSVDFISRELEYSNKRNIPMIIYGQSLGGAIALRATSELKNKSGILLVVADGTFASYRKVFRQIVRKILFFPIDWIAGIFMSDSLSPHETISALSAIPLLVIHGTEDEIVPYQNGIELFGLAGEPKWFWEVRGGGHVNWMNLGASKDSKNFLSFLDNLIEKSKLNPDFFRQIF

SEQ ID NO: 74073 - protein, 103 aa, Eremothecium gossypii
MSGKGGKAGSAAKASQSRSAKAGLTFPVGRVHRLLRKGNYAQRIGSGAPVYLTAVLEYLAAEILELAGNAARDNKKTRIIPRHLQLAIRNDDELNKLLGNVTI

SEQ ID NO: 74074 - protein, 151 aa, Triticum aestivum
MAEGVVRRNYTTWDDEMDGALLEVLVDHHNNGDHSQNGWKPHVYCAAIRNVKEKCNKNITKDNILGRLRTFDRYYEVITKILSQSGFGWDWVNHKLSMDSDDVWIKYVEANKKEKGLASYKTKVVKHWESISIIFPKITQWEGGKREYWLF

SEQ ID NO: 74075 - protein, 162 aa, Vitis vinifera
MAPIAVGDVIPDGTLAYFDEQDQLQQASVHSLAAGKKVIIFGVPGAFTPTCSVKHVPGFIEKAGELKSKGIDEILLVSVNDPFVMKAWAKTYPDNKDVKFLADGSATYTHALGLELDLSEKGLGTRSRRFALLVDDLKVKVANVEAGGEFTVSSADDILKAI

SEQ ID NO: 74076 - protein, 155 aa, Vitis vinifera
MLRSGCSRILGLGQQGKQAQSQALLRFYHERVVDHYNNPRNVGSFDKNDPDVGTGLVGAPACGDVMKLQIKVDDQTGKIVDACFKTFGCGSAIASSSVATEWVKGKQTEEVLSIKNTEIAKHLSLPPVKLHCSMLAEDAIKAAVKDYEAKRAKTE

SEQ ID NO: 74077 - protein, 1593 aa, Oryza sativa Japonica Group
MGAAGDNAAKAPAAAAGSNGKGTAASMDVVSSSSSSSPAPAPSVLKSVLLSYAYVSVWITLSFSVIVYNKYILDPKMYNWPFPISLTMIHMAFCASLAVVLVRVLRVVAVPASPPMTPSLYAASVVPIGALYALSLWFSNSAYIYLSVSFIQMLKALMPVAVYSLAVAFRTDSFRRASMLNMLGISAGRRRRGLRRGSATRLVLIQILLTSKGMSLNPITSLYYIAPCCLVFLTLPWYFVELPRLRAAAGAAARPDVFVFGTNSLCAFALNLAVFLLVGKTSALTMNVAGVVKDWLLIAFSWTVIKDTVTPVNLVGYGIAFLGVAYYNHAKLQGLKAREAERRAASMATAKDGDAEAGARLLPEKDAAKSLYYPCNDQGMTNYMLPRNFELFKMPRTDNAASANSVEPDKSEECLEFDDEEEEVEEEEIEYEEIEEEIEEEEEVEEDEDVVEEVEEVDEEEDEEEDEESDETEGVSKTKGVHQKDVTEKGKHAELLALPPHGSEVYVGGISSDVSSEDLKRLCEPVGEVVEVRMMRGKDDSRGYAFVNFRTKGLALKVVKELNNAKLKGKRIRVSSSQAKNKLFIGNVPHSWTDDDFRKAVEEVGPGVLKADLMKVSSANRNRGYGFVEYYNHACAEYARQEMSSPTFKLDSNAPTVSWADPKNNDSVSTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGSRYGGGGGSSGSSRPEEFVSETRLYMRIYQYFPISQIAESEEALYRQFTSVSHMEYEISGQESEVDSEVWLGWVAQRRVCSRLETRLPLPKLNTSCCLVTLSRGGRGGAGPPLQIPVDRESTKHRTHGDDTAIRRSWVLAAGESSDDDSCGGDKAKPKKGRKPLGNREAVRKYRQKKKAHTAHLEEEVEEASLPLTSSCDERSSSCGAALLEFMGPAAPPSEAAAAADDVVLPYISRILMEEDIDDDMFFCLYPDHPALLEAQQPFAQILSSSSSIAGEVNSAPMEDSAALMMQGSGNGRGRKGSKHGGDELEAEVGRASKLMATPEEEEDDDDGVGEMLEKMMLNGDEDEAFHGETNAPRVPAEKKCGKAARRRRRQAKGEVVDLRELLMSCAQAVASGNRRSAGELLEQIKRHSSPTGDATERLAHYFADGLEARLAGAASLERRLVASAEERASAMELLEAYQVFMAACCFKWVAFTFANMAILRAAEGRNRLHIVDYGGQYHGLQWPSLLQRLAEREGGPPEFRAVAAARWETVTAEDVVGVDPDDEAAVVVNDVLSLGTLMDESGVFDDPSPRDTVLGSIRDMRPAVFVQAVVNGAHGAPFFPTRFREALFFFSALFDMLGATTPEEGSHLRVVLERDVLRRAAVGVIAGEGAERVERPETYRRWQARNRRAGLRQAAVEGDVVEAVRRRVRRRHHEEFVIEEDAGWLLQGWKGRILYAHSAWVVAEDGAH

SEQ ID NO: 74078 - protein, 152 aa, Brassica napus
MRLRLRRHETRETLKLELPDSITLHDLRQRINEPSPSSVHLSLNRKDELLAPSPDHTLRSLGVTSGDLIYYSLVPSAFAASLEEIALASSSEVKSQNEMGIGFAASDVDLNIQDPEEVSTGEASGHAPDPMDLEELDVELAAAGSKRLTEPF

SEQ ID NO: 74079 - protein, 347 aa, Listeria monocytogenes str. 4b H7858
MKNTIKWIAIGFAGIILLPLLIVFFIYKKAVGKKEYNPEVLENLDEASQKFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 74080 - protein, 183 aa, Pyrococcus abyssi GE5
MGKAQSVRFKVSKLMAYILRHDPWSFNLQPDEEGFVDLEEFVNAIRRVYPWVTKEFILDIVERDEKERYEVKEGKIRARYGHSYPVILDHKEDKESKTLYHGTIRENLEGIMREGIKPMKRQFVHLSLNYEDAYNTGRRHGSNVVVLMIDADCLRKKGFKILKAGKKVRIVKYVPVDCIVGEL

SEQ ID NO: 74081 - protein, 400 aa, Triticum aestivum
MVKAKLLAVLALVAVAAPFLRAAGQEEGEGGARPSELLPFAVGAAPAGCDVGQGEWVYDEAAAPAYDEEACPYIPAELTCQAHGRPDKSYQHWRWQPRGCSLPSFNATVMLEMLRGKRMLFVGDSLNRAQYVSLLCLLHRAMPEGSTSFETVDALSIFRAKAYDATIEFYWAPLLAESNADDGVEHQLNDRVIRGAPMDRHSRFWKGADVLVFNSYLWWMTGDKIQILRGADNDMSKDIVEMGAEEAYRLVLHQVVRWLDGNVDPKRSRVFFVTASPTHATGQLWGDEAEGSNCHGQTKPIADASYWGSTSRAMLRVTGEVLAASARVPVGVVNVTQMSEYRRDAHTQVYREQWAPPTKEQLADPKSYADCTHWCLPGVPDAWNELLYWKLFFPANDQPL

SEQ ID NO: 74082 - protein, 110 aa, Glycine max
LISCPAATTVNRAEAGMVAPFTVLKTMAGFPTRKTNNDITSIASNGGREQCMQVWPPGGKTKSETLCYLPDLDDAQLATVVEHLLRQGRIPCLEFESEHGFAHREHSRSP

SEQ ID NO: 74083 - protein, 460 aa, marine gamma proteobacterium HTCC2080
MSVTVIVPDIGGAEGAEVVEIFVAVGDVIEVEQSLIVVESDKASMEIPSTVAGKVLELRVALGDALSEGDAVLVVEAEAAEAKTQDDVNSAGESPPAAAEVNAASEPSKRLAEKSSEKAAETPTASLNVAAESADASASQIKPSPALVSKEQGSLQTQTRTEADVYAGPAVRKLAREFGIDLLSVTGSGRRGRVLKEDLQAFTRKNLKKADPSASTGVPAVPEIDFSQFGEVAVEERSRLEQITATNMSRSWLNVPHVTQFEGADITDLEAFRQSMKKEAEQLGNKLTPMPFVLKACAVALGAHPKMKSSLAAGGKELVYKQYCHIGMAVDTPAGLMVPVIRDVDTKGIWQLAEEIRDMATRAREKKLTPAQMQGGVFTISSLGSIGGEGFTPIVNTPEVAILGLSRAEIKPVWDGESFLPRQILPLSLSYDHRVVNGGDAGRFLTDLAALLSDVRRIIL

SEQ ID NO: 74084 - protein, 327 aa, Aquifex aeolicus VF5
MSLKSCLMWVLGEHDEPYRKARETILKLVGNTPLVRVKKCLPEDIPEDVEIWAKLESFNPGGSVKDRPALSMFLDALKRGLIKEGKVVIDATSGNTGIALAMVGAALGVPVELAMPANVSEERKKIIKAFGAKLYLTDPLEGTDGAILFVRELVQKYPEKYVYLDQYNNPANWKAHFYSTGIEIWNQTKGRITHFVAGIGTGGTIMGTGRRLKIYNPNIQVIGVQPAYPFHGIEGLKHIESSIKPGIFDETFLDRTIFVETEDAYYWARELAKKDAIFVGQSSGAALWACIQLARELAKKGEKGVIVTVFPDGGEKYLTTALFSDKD

SEQ ID NO: 74085 - protein, 292 aa, Zea mays
MLRSTHPPSPSSGSSDATMVGGGAPSGAKLLQILNVRVVGSGDRVVVLSHGFGTDQSAWSRVLPYLTRDHRVVLYDLVCAGSVNPEHFDFRRYDTLDSYVDDLLAILDALRVSRCAFVGHSVSAMIGILASIRRPELFAKLVLIGASPRFLNDHDYHGGFELPEIQQVFDAMAANYSAWATGYAPLAVGADVPAAVQEFSRTLFNMRPDISLHVCRTVFNTDLRGVLGMVRAPCVVVQTTRDVSVPASVAAYLKAHLGGRTAVEFLQTEGHLPHLSAPGLLAQVLRRALARY

SEQ ID NO: 74086 - protein, 350 aa, Pichia jadinii
MTEQIPKTQKAVVFDTNGGQLVYKDYPVPTPKPNELLINVKYSGVCHTDLHAWKGDRPSATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGEFVKSLGAEAYADFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSDLPEVFKLMEEGKILGRYVLDTSK

SEQ ID NO: 74087 - protein, 136 aa, Corynebacterium glutamicum ATCC 13032
MTERTLILIKPDGVTNGHVGEIIARIERKGLKLAALDLRVADRETAEKHYEEHADKPFFGELVEFITSAPLIAGIVEGERAIDAWRQLAGGTDPVAKATPGTIRGDFALTVGENVVHGSDSPESAEREISIWFPNL

SEQ ID NO: 74088 - protein, 473 aa, Triticum aestivum
MGRLAGLRWLLVLAWVTAQALAAAGAEDSKAAVGEPGPRRHAYAAMMYMGTPRDYEFYVATRVMMRSLRGFGADADRVVIASLDVPPRWVQALKDDGVKVVSVDNLKNPYEKQDNFNSRFKLTLNKLYAWSLVSYDRVVMLDSDNMFLQNTDELFQCGHFCAVFINPCIFHTGLFVLKPSMDVFKNMLHELAVGRENPDGADQGFLASYFPDLLDQPMFHPPANGTKLDGNYRLPLGYQMDASYYYLKLRWSIPCGPNSVVTFPSAPWMKPWYWWSWPVLPLGLSWHEQRRENLGYSSEIPMALFQALLYIGVIAVNRLARPSLSKLCYNRRMEKSTMFLLTTLRVVAAWSILAAYTIPFFLVPRTVHPLLGWPLYLLGSFSLSLIVINFFLLHPLAVLTTWFGIIGTLFVMACPWYMNGVVRALAVFAYAFFCAPVVWASLVKIMSSLQVLIERDAFRLGEPNQTAEFTKLY

SEQ ID NO: 74089 - protein, 384 aa, Gloeobacter violaceus PCC 7421
MVITEIKIPQLGEGLQEVLIDRLLKRSGEHIKRDEAIYVIETDKALMDVESPYEGVIQEWLVEENDVVLVGSPVARIQTIIEHSAAPHLEPRKAEFPETKPKSQIAPSSSAVIPPRTRAYCKQLGIPEDEMLQISALTEKLMPRDVDKYVAAKSNPEILPSLEQVRCDYLERSISGKQKTLLYRLKRSTELVVPGTISRPVAWFRLQEGIQILTNRGDSPLPSEFQMFAYCVAQASKKHPKFRSVLTGENSVREYRLLNLGIAIARPNDELITAVIPEADCLSPAAFANTARRQMRKAIKEGDQASESTQITLSYLGEYGIVDATPALVAPAVAVMFIGSTYGQAGKQVANIALTFDHRLINGAGAALFLNDIAQQVESFSSEL

SEQ ID NO: 74090 - protein, 770 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIATSASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 74091 - protein, 244 aa, Vitis vinifera
MSSTAGQVIRCKAAVAWEAGKPLVIEEVEVAPPQVMEVRLKILFTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPIYHFVGTSTFSEYTVVHVGCVAKINPAAPLDKVCVLSCGISTGLGATLNVAKPWKGSSVAIFGLGAVGLAAAEGARIAGASRIIGIDLNPKRFNDGEYSKCPQD

SEQ ID NO: 74092 - protein, 195 aa, Fulvimarina pelagi HTCC2506
MAPRDNRRDREEQDDGFVDKLVHINRVAKVVKGGRRFGFAALVVVGDLKGRVGFGHGKAREVPEAIRKATEAAKRDLIFVPLRDGRTLHHDVHGRHGAGKVLLRAAEAGTGIIAGGPMRAVFEAVGMHDVVAKSLGSSNPYNMVRATFEGLKQATHPKDIAAKRGIKYSELQARRQAATGHHPQAEPSEEAADAA

SEQ ID NO: 74093 - protein, 267 aa, Triticum aestivum
  misc_feature (241)..(241): Xaa can be any naturally occurring amino acid
FDHAAAAREVFERFHGCYDALRASGLPEAGLGALDIAGLPLYSVGHSNGALLQLLVGSYFSEKIPKANAIVSFNNRPASEAVPYFEQIGPLISQLTPMMETSPVYSAARDASGNAWKALFDLAGGLIREYDREAMVSVSKFVDQLPSVMNQVTEGVSEFKPTPPENREFCKNSYSVANTLLVKFSVDAIDDTDIIEDILRPRVDSIGGQIKKVVLSGTHLTPCIQDVKWQVGSEYTPADAXAQGLKSLALNETRVLSRTIADYFRSL

SEQ ID NO: 74094 - protein, 724 aa, Vitis vinifera
MSKAEVTMEVGNDGVAVITMSNPPVNALALAIIAGLKEKYAEAMRRNDVKAIVVTGKGGRFSGGFDINVFQKVHKTADISHLPDASIDLLVNTVEDAKKPSVAAVEGLALGGGLEVAMACHARIAAPKTQLGLPELSLGVMPGFGGTQRLPRLVGLSKAIEMMRLSKSISSEEGYKLGLVDAIVSSEELLKVSRRWALDIVDKRKPWVRSLHQTEKLGSVSEALDILKISRQQARKTVPHLPQHQACLDVIEEGIVHGGYSGLLKETKVFNKLVLSDTAKGLIHVFFAQRATSKVPNVTDIGLKPRNVKKVAVIGGGLMGSGIATALITSNIYVVLKEVNSEYLLKGIKTIEANVRGLVTKGKLTQDKARKALSMLKGVLDYSEFKDIDMVIEAVIENISLKQKIFSEIEKICSPHCILATNTSTIDLNLVGEKTSSQDRIIGAHFFSPAHVMPLLEVVRTEKTSAQVILDLMTVGKAIKKIPVVVGSCTGFAVNRTFFPYAQGAHFLVNLGVDPFRIDWVISNFGLPMGPFQLQDLSGYGVAVAVGKEFATAFQGRTFESPLVNLLLKNGRNGKQNGKGYYIYEKGSKPRPDPSVLPIIEESRRLANIMPGGKPISVANQEILEMILFPVVNEACRVLDEGVVVRASDLDITSVLGMSFPSYRGGIVFWADEVGPYYIYTCLKKWSAMYGTFFKPSSYLEQRATKGIPLSAPASASPASNSRL

SEQ ID NO: 74095 - protein, 230 aa, Prochlorococcus marinus subsp. pastoris str. CCMP1986
MHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 74096 - protein, 189 aa, Triticum aestivum
MAGTVEDSGKTAPSSPAGLRGADLALRVLLFAVSLSGLVVLVTAKQTEMVPLVLTPPFRFGPVPAQFKDSPALIYLLVALCMTSLYSLLTAATSVKSMSSSASCAKGIFVLILLDVVYAGIMASATGTAGAVAWVGLKGNSHTRWNKICNIYGKFCRHIGSATCLGLIASIILVLLVVLNAYSLYRRSR

SEQ ID NO: 74097 - protein, 411 aa, Vitis vinifera
MNSQHPDGSVFSNIVRAPEDPILGVTVAYNKDTSPIKLNLGVGAYRTEEGKPLVLNVVRRAEQLLVNDPSRVKEYLPIVGLAEFNKLSAKLIFGADSPAIQENRVATVQGLSGTGSLRIGAEFLARHYYQHTIYIPVPTWGNHPKIFTIAGLSVKTYRYYDPETRGLDFKGLLEDLGAAPTGAIVLLHACAHNPTGVDPTLEQWEQIRQLMRSKGLLPFFDSAYQGFASGSLDADAQSVRMFVADGGECLAAQSYAKNMGLYGERVGALSIVCKAADVASRVESQLKLVIRPMYSNPPIHGASIVATILKDSDMYNEWTLELKAMADRIISMRQLLFDTLRDRGTPGDWSHIIKQIGMFTFTGLNTEQVAFMTKEYHIYMTSDGRISMAGLSSRTVPHLADAIHAAVTRIP

SEQ ID NO: 74098 - protein, 584 aa, Bradyrhizobium sp. ORS278
MTEQPHDGSHHWAMLRSLQGWRISTLPADLTAGLTLAAIAIPEQMATAKLGGFAPETGFFAFLAGSLGFALFGANRFLSCGADSTITPIFAGGLALLAASGTPEYGSIAAALALLVGVMLVLAGGFRLGGIANLLSVPVTVGFLSGIAVHIIVSQLPGVLGLPAPSGSTLARIAAMAGELGKTNIYTLIIGFGVLATVAVCERISACIPGALIALAAATIFVIGAGLEARGVPVIGAISGGVPMPSVPLIAPEQWVKLVPLAFLIAVVVMMQTAATTRSFPSEPDRPADVDRDFLGAGAGSVLAGLFGTFPVNASPPRTGIVVETGGRSQVAGLSAAVIVLLLVLFGARLLAHVPEAALGGVLLFVALRIIRVTQIVQIYHASKGEFLLIVATAAAIVVLPIEQGVALGISLSLLHGIWSTTRAHLMIFERVPDTTIWWPAHPHIRGEELSDIAVVGFQAPLSFLNAATFRADLQHLLQQRQPRLLVLEASAMVEIDFTAAQAMREVIRQCNEDGIVFAVARLESLRAQAAFERFGLYDVLPRDHVFHSVDLALRSLRVEPLSGARETNGATPHSRHPRESGDP

SEQ ID NO: 74099 - protein, 399 aa, Oryza sativa Indica Group
MELFARAQVVRLKSHHDKFLYADEDEVHVTQDRNGAATNARWTVERVPHSPGVVRLRSRYGRYLSASNEPFLLGMTGRKVLQAPPPGGRATDSSLEWEPVKDGFQAKLKTRYGHYLRANGGLPPWRNSVTHDVPHRTATQDWVLWDVEIVQVLTPGHDRAPTSAAPPSPAHALELKKPPPPPEAHHRPTKSYTGHPPPPPLEKDAPPQPPRPQEVHHRPTKSYTGNPPQPLEKDASPQPPPPKPASSRLEEINTETSLCCQSSLSFSAPLHKVEGRAIYYHIADDKGDVDEDDETRSFTFNGSNLEELTHKLQEETGLHDIIICTRSPITGKLAPLRLQLPPNNAAMHIVLVQESSKDGAYTKSSATSLLIESYRTEDGGIILLAANIVQFRSWVFLKQ

SEQ ID NO: 74100 - protein, 404 aa, Zea mays
  misc_feature (41)..(41): Xaa can be any naturally occurring amino acid
IHRSRLAARWGYLEAGRDGQNIIFQNKSERTEGEEEEEEEXADAARGLGSSSLPVANVQALAESCNDNGADAPVPGRYLIKDPSAEEVVAAGDSACAIPVIDFRKLLDPGSSEEECARLGAACHHWGFFQLINHGVPAEVTGNLMKDVAGFFRQPLEAKKECAQQAGSIEGYGQAFVVSEDQKLDWADMLFLIVRPREARDMRFWPTRPESFRDSVDAYSLEASKLAYRLLEFMARGVGADPASLQSMFQGQVQGMRVNYYPPCQQAADQVLGLSPHSDPNGLTLLLQMSHDVHGLQVSKDGRWFPVQALPGAFVVNVGDALEIVSNGAFRSVEHRAVIHPTKERISAALFHFPDQDRMLGPLPELVKEGDTVRYATTTYQEFMKRFFAAKLDGKKLIERFKLQ

SEQ ID NO: 74101 - protein, 78 aa, Vitis vinifera
MIIPVRCFTCGKVIGNKWDTYLDLLQADYTEGDALDALGLVRYCCRRMLMTHVDLIEKLLNYNSNLSLTHSLSSCLYA

SEQ ID NO: 74102 - protein, 195 aa, Burkholderia sp. 383
MPFNFPIFLTWVRIVLIPLVVGVFYLPDTVMGGAHRNLAAAAIFILAALTDWFDGYLARKWNQTSSFGAFLDPVADKLMVTAALLILVQISRVDAAIALVIVGREIAISALREWMAQIGASKSVAVNQLGKFKTACQMVAIPMLLFYGPLPLGVATIDTRVWGEWLMYLAAVLTIWSMLYYMKLAWPQIRERGGA

SEQ ID NO: 74103 - protein, 233 aa, Vitis vinifera
MDELEQWRIQLQQWSRQGAEWFHQMPETQLYAAIAVVFVTTFFLLSIRLFKRTKSNTVVLTGLSGSGKTTLFYQLQDGSSHLGTVTSMDPNEGTFVLHSEIAKKGKIKPVHVVDVPGHSPASDHSIWYLYDILTKSSVVKKKIPVLILCNKTDKVTAHTKEFIRKQLEKEIEKFRASRSAISAADVVNEFTLGVPGEAFGFSQCHNKVTVADASGLTGEISQLEEFIREYVKP

SEQ ID NO: 74104 - protein, 481 aa, Bordetella bronchiseptica RB50
MRAIADTGYTAPTPIQAQAIPLVLQGGDLLAAAQTGTGKTAGFTLPILHRLMQTKPAARKPGRPRCLILTPTRELTAQVAESVQTYGKYASLSSMVMFGGVNINPQISALKKPLDILVATPGRLLDHAGQKTVDLSGVEILVLDEADRMLDMGFIRDIRKVLALLPKQRQNLLFSATFSDEIRSLARGVLNDPGEVSVTPRNTATELVTQTVHLVEQHHKRDLVSHLIRESGWHQVLVFTRTKHGANRLAEKLVKDGLSAAAIHGNKSQSARTRALSGFKDGSVAVLVATDIAARGLDIDQLPQVVNFELPNVPEDYVHRIGRTGRAGATGAAVSLVDDSEIKLLKAIERLIKKPIERRAVDGWTPPAGGPTAEDRADREREMRDDDRGRGRRGGRGGDRGQRAGGDNRAPQARDGQRRATGAHPQGSAPRNAAGPRADAKRNDAGRPQGRAPGETGAARAPAPARNRPAGNGTRGVLLGK

SEQ ID NO: 74105 - protein, 503 aa, Nitrosomonas europaea ATCC 19718
MVNDYLERILTAHVYDVASETPLDFAPSLSARIHNRVLLKREDMQRVFSFKLRGAYNKMARLSPDVLQQGVVAASAGNHAQGVALAAQKLGCSATIVMPATTPQIKINAVMAMGAAVLLQGDSYNDAYEYARNLAEEKEAEFVHPYDDPDVIAGQGTIAMEILRQHPGRIHAIFVPIGGGGLISGIAAYVKRLRPDIKVIGVEPVDSNAMYRSLQAGYRVELSQVGLFADGVAVRLVGEETFRLCRELVDDIILVDSDAICAAIKDIFEDTRSIVEPSGALSIAGLKAYVKQKNLLHEVLVAIASGANMNFDRLRHVSERAELGEQREAILAVTIPEKPGSFKKFCNLLGARNITEFNYRYADPEMAHVFVGVSVRNREESLHLIEILQENGLKTEDMTDNEMAKLHIRHMVGGRSREVMHEILYRFEFPDRPGALMNFLNHMSDHWNISLFHYRNHGADFGRVLIGIQVPPEEKQEFREFLDKLGYSFWDENDNPAYQLFLA

SEQ ID NO: 74106 - protein, 875 aa, Arabidopsis thaliana
MMQRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 74107 - protein, 174 aa, Zea mays
MEHKEAGCQQPEGPILCVNNCGFFGSAATINMCSKCHKEMVMKEEQAKLAASSFDSIVNGGDGGKAPVVAAVAASAEVAVAQVDVKALVVQPAADVAGTSEAVAVSPRRKEGPNRCSTCRKRVGLTGFDCRCGNMYCSLHRYSDKHDCQFDYRTAARDAIAKANPVVKAEKLDK

SEQ ID NO: 74108 - protein, 484 aa, Glycine max
ASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGGVLLLENVRFYKEEEKNDPEHAKKLASLADLYVNDAFGTAHRAHASTEGVTKYLKPSVAGFLLQKELDYLVGAVSNPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 74109 - protein, 109 aa, Arabidopsis thaliana
  misc_feature (10)..(10): Xaa can be any naturally occurring amino acid
  misc_feature (22)..(22): Xaa can be any naturally occurring amino acid
  misc_feature (43)..(43): Xaa can be any naturally occurring amino acid
  misc_feature (49)..(49): Xaa can be any naturally occurring amino acid
MASSMLSSAXVGTAPAQATMVXPFTGLKSSAAFPVTRKTNKGXSSIASXWGRVSYIKVWPPIGKKKFETLSYLPDLSDVQFAKEVDLPFPHQGDSLVLLLLSHKHRIWN

SEQ ID NO: 74110 - protein, 353 aa, Leptospira interrogans serovar Copenhageni str. Fiocruz L1-130
MNQDKPVVLIMAGGKGERFWPRSRISTPKQLQKVYSNKTLLRETLERALTITTIDRIYIGTNASLKKSILIQEKNFPEKNFIIEPEGKNTAPIIALASLYFQERYGDPLQVVLSADAWIHPVKEFTKTISKALEYTKEHLVLLGIKPNRPEIGYGYIEAGKSTDACFAVKSFYEKPDVKTALKYIKKKNFYWNPGIFLWRTSIILEEFKTYSPKILDPLKERFPFKKAGELAAAFKIIPSEPVDITIMEKSSRIKMVEASFGWDDVGSWTSLERVMPGDELGNRHMGKTILFHKSSGNITQTRKEFTAVLGVNDLIVVEEEDVLFISTKSGIGDIKNLVSELRKNKTLQKYTE

SEQ ID NO: 74111 - protein, 400 aa, Picea sitchensis
MMTTIQAGIPRQCPWRSSFGIVGTPLVGIVKDGKKLQAQRRRWNTKASRCQLNVETPPVTEWRTVVEHGDDKLDICRVINGMWQTSGGWGKIDRNNAVEAMLGYADNGFTTFDMADHYGPAEDLYGIFINRVRRERPEMVDTVRGLTKWVPPPGKMTGAYVRDNIEISRKRMDVKSLDMLQFHWWEYSNPAYLDALKFLTDLKEEGKIKTLALTNFDTKRLQIILENGIPIVSNQVQHSVVDMRPQKQMAELCQLSGVKLITYGTVMGGLLSEKFLDANISIPFAGPPLNTPSLQKYKRMVDAWGGWSLFQELLKTLKNVALKHGVSLPTVAVRYILDQPSVAGSMIGVRLGLSEHIGDSKVIFSLALDDEDRESIMEVTKKGKDLVTVIGDCGDEYRRV

SEQ ID NO: 74112 - protein, 346 aa, Oryza sativa Indica Group
MGQQSLIYAFVARGTVILAEYTEFTGNFTTIASQCLMKLPASNNKFTYNCDGHTFNYLVEDGFTYCVVAVESVGRQIPIAFLDRVKDDFTKRYAGGKAATAAANSLNRDFGSKLKEHMQYCVDHPEEISKLAKVKAQVSEVKGVMMENIEKVLDRGEKIELLVDKTENLRSQAQDFRQAGTQGTRRQTLGEILMDPDGSVAARANPHALPSPTLVLANPDECSALILPSSYRKLFSSAANLRPPAYAASQLPALICGLSAQLPALCCQVINGVSCGASRRGVRPSFIRSHCATATCTTSSTDGWTNGVRETVIHVKAHHFATSLGLAPPPTSPSSGGVRARGVEWP

SEQ ID NO: 74113 - protein, 378 aa, Fulvimarina pelagi HTCC2506
MLKTVETETGETPSFLDPSDAARRDCEVAAAELRFGRPVVLHADETYVAIALDTATARDFERFAVATRGSHALFITTERADALELSAPNGALVPLKDLSYERACELGYQLESPVPETWFDAPASLSALNELSRLALLLPALVVAQIDQSDPAFAGVAEIAVEDIEAAGDAETRYEIVARTVVPLRDVEKAEFVVFRGGLSQRDQVAIVVGEPDFERPVPIRIHSSCLTGDLFGSLKCDCGDQLREGLRLIEARGGGVLLYLDQEGRGTGIGAKMRAYGYQSHGLDTIDADAALGFGADTRRYGAAVAMLSALGVTSVELLTNNPNKAAFLQKAGITVSRRTAVLGEVTNENRYYLTTKAERAGHSLDIALIASALVNK

SEQ ID NO: 74114 - protein, 268 aa, Burkholderia sp. 383
MAKREIPIRGAAEIAKSREAAKLASQVLTMITEHVKPGVTTDELDVLCRNYIVDVLGAIPANIGYHGYPKTLCTSVNHVVCHGIPTSRPLRDGDIVNLDIAVIKDGWFGDTSRMYFVGEPNELARRLVATTYEAMHAGIRAVRPGATLGDVGYAIQQVAHREGFSVVREYCGHGIGDVYHDEPQVLHYGRPGTGVPLRPGMIFTIEPMLNAGKRDTRMLADGWTVVTKDHSLSAQWEHMVVVTETGFEVLSEDVKPQAFPVLSGTHAA

SEQ ID NO: 74115 - protein, 125 aa, Picea mariana
MAEGNVFACHSTEGWRSKLQEAIDTKRLVAVDFTATWCGPCRVIGPVFVELSKKFPEIFFLKVDVDELRDVAQEWDVEAMPTFIFIKDGKAVDKVVGAKKDDLERKVAALAAAATTTEATLPAQA

SEQ ID NO: 74116 - protein, 476 aa, Ralstonia solanacearum GMI1000
MPATFPAAAQANAAARLERLPFSGYHKRIFIIIAIAFFFDSVDLATMTFVLGSIKKEFGLSTATAGLVASSSFFGMVIGAAVAGLLADRFGRRPVFQWSMVLWGVASYLCSTAQSVEALIAWRILLGIGMGMEFPVAQTLLSEFVPTANRGRLIALMDGFWPLGFITAGIVSYFVLPQFGWRAVFALLAVPAIFVLIVRRAVPESPRWLEHAGRNAQADTVMRGIEAKVMRSLNTTTLPPIVQHSAPQPVRRHSALREIWSAAYRRRTTMVWLLWFFALLGFYGLTSWLGALLQQAGFAVTQSVYYTVLISLGGVPGFLCAAWLVERWGRKPTCIASLLGGGAMAYLYGQSALYGGSVTLLICTGLAMQFFLFGMWAVLYTYTPEQYGTGARATGSGFASAIGRVGSLIGPYVVGVVLPVFGQGGVFTLGAISFAVAALAVWALGIETRGLALEALASEDAAAETAPYSTTADNIS

SEQ ID NO: 74117 - protein, 398 aa, Ralstonia solanacearum GMI1000
MSNNRGVVYLGPGKVEVQKIDYPKMVDPSGRAIGHGVILKVVSTNICGSDQHMVRGRTTAPAGLVLGHEITGEVVEIGRDVETLKIGDLVSVPFNVACGRCAMCKEQHTGVCLSVNPARAGGAYGYVDMGGWIGGQAEYVLVPYADFNLLKFPDRDQAMAKIRDLTCLSDILPTGYHGAVTAGVKPGSTVYIAGAGPVGMAAAASARLLGAACTIVGDMNPARLAHAKAMGFEVVDLSKDATLGEQIAEILGTPEVDCAVDCVGFEAHGHGSGHTEEAPATVLNSLMEITRPAGAIGIPGLYVTDDPGAKDVAAKHGGLSIRFGLGWAKSHSFHTGQTPVLKYNRNLMQAILHNRLPIAEIVNVSVISLDQAPEGYKQFDGGAPRKFVIDPHGLLAAA

SEQ ID NO: 74118 - protein, 121 aa, Brassica napus
  misc_feature (91)..(91): Xaa can be any naturally occurring amino acid
  misc_feature (110)..(110): Xaa can be any naturally occurring amino acid
MASHLDFRYLDEGLGGERGKRKRREEEADAADSMDLDADAPRSSKLRAVASQSDPSKPAAFGSPTYDGVIAGRVSGRTWKEPRTRRSSALXVSRKPVPLEQRVRDKSLKXAYQARVAELKD

SEQ ID NO: 74119 - protein, 416 aa, Zea mays
KPHKSNDSKWEAIQVVRTKEGSVGLGHFRLLKRLGCGDIGSVYLSELSGTKCYFAMKIMDKASLASRKKLLRAQTEREILQCLDHPFLPTLYTHFETDKFSCLVMEFCPGGDLHTLRQKQPGKYFPEQAAKFYVAEVLLALEYLHMLGIIYRDLKPENVLVREDGHIMLSDFDLSLRCAVSPTLLRSSNPSGDNQKGNPAYCVQPVCIEPACMQPSCVTTTTCFSPRFFSSKSKEKKDKKAKADWANQVRPLPELVAEPTDAKSMSFVGTHEYLAPEIIKGEGHGSAVDWWTFGIFLYELLFGKTPFKGSGNRATLFNVVGQPLRFPESPVVSFAARDLIRGLLIKEPQHRLAYKRGATEIKQHPFFEGVNWALIRCATPPDIPKPVEIPRSVASSSQKATSAAEKGSDYLELEFF

SEQ ID NO: 74120 - protein, 318 aa, Debaryomyces hansenii CBS767
MSEFDIRRDMPYDIKQFLKQESNASLMAGGIAGAVSRTVVSPFERAKILLQLQGPGFKSYNGMFPTIFKMYAEEGWRGLFRGNLLNCIRIVPYSAVQYAVFEKCKAIMMANKDGSSELQVHERLIAGSIGGIASVAATYPLDLVRARITVQTASLAKLAKGRLVKPPSVVETLVEVYKHEGGLRALYKGIVPTTMGVAPYVAINFTLYEKMRDYMDNSPADYSNPLWKLSAGAFSSFVGGVLIYPLDLLRKRYQVASMAGGELGFQYSSVARALISIFTTEGFFGAYKGLTANLYKIVPSMAVSWLCYDNIKEEIAKW

SEQ ID NO: 74121 - protein, 353 aa, Streptomyces griseus
MDTMTGVVGPALTASLPPHVRLLLLTDGKRISRVLHVLAELAVADELADGPLTVAELAVRTDAHPDSLGRVLRVAAAFGVFEEREDGRYALTELSEVLRSDVPGSQRDMVLYNGTEMLWRSYGSLLHTVRTGRPAFEAVYQQDFFTHLEENPQAGALFDRAMTGMSRATARMLLDSYDFGRFLRLADVGGGRGLFLAEVLTRHPGSRGTLIDRPAVTGEAAGLLREAGVADRVEVVPGDFFEELPKGHDAYVLKAVLHDWDDRRAAAILGRVRDALAGRPDGRLLICEFLVGPANQWDRGKLLDLDMLVRFGGRERDADQWRALLAATGFELVNDPVPGRWAVLECRPVPADG

SEQ ID NO: 74122 - protein, 385 aa, Zea mays
MKDAFSPPSPPPAPAPAPAPDSAEDLADARLAPWTFSPWPAPRRDHASGGGSGSGRPNPLFTILPVSALAIGLVLLVAVAVILLAVTRRARPPKADGASGSCNGDSGKPGAPTSSCGSHVTSRCGGYAAAGTGCIYAGRLGFSAQPRSRGAQVFTYRELERATDWFSECNVVGRGASGAVFRGRLADGTTAAIKRLRLDQRRQGEREFRIEVDLLSRMDSPYLVGLLGYCADQSHRLLVFEYMANGSLKSRLHHPAPAAAAAAGPPPPPPLDWQTRLGIALDCARALEFLHEHSSPAVIHRDFNCSNVLLDHNYRARVSDFGMAKVGSNRTDGQVVTRVLGTTGYLAPEYASTGKLTTKSDVYSYGVVLLELLTGRVPVDTQRPL

SEQ ID NO: 74123 - protein, 124 aa, Zea mays
MATSTAAATALLRPRPAVPAKLAQRRCLHAVAGWTTMRRRGAAGVVRAFFNPLGDERILREAIKEPVAFMGGVFAGLLRLDLNEDPLKEWISRTVEASGIAEENSSEESSEADQNDAPQQIEIE

SEQ ID NO: 74124 - protein, 127 aa, Brassica napus
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIAC

SEQ ID NO: 74125 - protein, 220 aa, Physcomitrella patens subsp. patens
MGDQVHPGSPSIPPPATYAKPRHRGRRGGIASCCCCLLSTFCSLLFVLLLLAGITILVLWLVLKPIHLPKYSLDNVDFRSFSVGQNSTLNADILYTITANNPNKKIGIKYDNIDIQSSYDGQVFGRSTIPGFYQGHQNITTITSEVLVNDYALTSTSATTLASQIQSNSVPLHFRANAKVHVKIGSYTSPGFKVRVDCDVTMGVNPVLLKSKSCKLKRRS

SEQ ID NO: 74126 - protein, 427 aa, Zea mays
MPNTTPAHAQDQPAGAPEGWHAEAANPTRTRIQTSTRGTAPCPRGCDPRPAASPPAARTPSQDPQRPEVPNERCAHCHQEAAEAEPRRRRVAVPLTPLPPPGNPTRSGQTRPNQRKIAPPPPSLGPRGHPAAPSGDGEGKIKVEENAPGAATGVILSLRESIHELAMIRPPLHPWQQNQALLVELEAAKSEIEKWHSAFQSIPAVPSGTIPDPVSVVSYLSTLKSSEESLKEQLEKAKKREAAFIVTFAKREQEIAELKSAVRDLKTQLRPPSMQNLVEEKEKKIKELQDNVAAVNFTPSSKLGKMLMAKCRTLQEENEEIGTMASEGKIHELGMKIAVLKSQNNELRNQFDVLYKHMDGVTNDVERSNELVSILQEELEAKDLELTRLKEVLAQKGATQDAPVETSDDAGNGQEADSDTLQVKAES

SEQ ID NO: 74127 - protein, 84 aa, Zea mays
FITSLYKKAGSCRTMVNAIKGLFISCDVPMAQFIVNLNASMPPSERFIVHMLDPTNMFVQPHVAHMIRSKIGEFRDQNSYEKPQ

SEQ ID NO: 74128 - protein, 193 aa, Bacillus thuringiensis
MNAIPYVVEQTKLGERSYDIYSRLLKDRIIIIGSEINDQVASSVVAQLLFLEAEDAEKDIFLYINSPGGSTTAGFAILDTMNLIKPDVQTLCMGFAASFGALLLLSGAKGKRFALPNSEIMIHQPLGGAQGQATEIEITAKRILKLKHDINKMIAEKTGQPIERVAHDTERDYFMTAEEAKEYGIVDDVVTKK

SEQ ID NO: 74129 - protein, 490 aa, Neisseria meningitidis Z2491
MNQTSRDLTRISHNTKIVATLGPGSNNVELLEDMIRVGGLNVVRFNFSHGTPEFHQENARIVREAAKRTGQEIAIIADLQGPKIRVGKIAGGGIELNKGETLGLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 74130 - protein, 483 aa, Gloeobacter violaceus PCC 7421
METSALQSGAQATHEKPSIGLIGLAVMGENLALNIANHGFPISVYNRTAAKTQELAEGRARGKALYPTFTMEEFVASMERPRKIIILVKAGAPVDAVIDQLKPLLEKDDVIIDGGNSLFTDTEKRSGEIEALGLRFVGMGVSGGEEGALKGPSLMPGGPKTAYDDLAPILTQIAAQVDDGPCVTYIGPRGAGHYVKMVHNGIEYGDMQLIAEAYDLLRQTLGLGAAELHDIFAEWNAGELKSFLIEITADIFTKIDPETGKPLVDLILDKAGQKGTGKWTSQNAYDLGIPIPTINAAVESRILSAYKSERVAASKILSGPERPPFTGEKKQFIDAVRDALYCAKICSYAQGMALLKAASHEYDYHLNLSELARIWKGGCIIRAIFLDKIKNAFLRDPALTNLLIDSEFSGDIQARQANWRYAVQTAAQLGIPAYATGASLAYYDAYRTAQLPLNLTQAQRDYFGAHTYERIDKEGVFHTEWFS

SEQ ID NO: 74131 - protein, 354 aa, Yarrowia lipolytica
MSHSHPVRRILSPKDLEIFGASDTKKQVFGFVKVLNYYVVGKGNSYETLKHPIIGKLVAILDKVIDLVAKYPPEDATSSRFGKPEFRDFHQALEENAKDWISDLGELEDWQLVELCTYFAASFGDRTRIDFGSGHELNFICFLFCLRQLGLLDTDSSAAVLTVFVQYLKTMRAVQASYWLEPAGSHGVWGLDDYHFLPFMFGSAQLACHKYLRPLSIHDMEMLDMWKHEYLYMGCIHFINSVKTTASLRWHSPMLDDISGVKTWAKVNQGMVKMYDAEVLSKLPILQHFMFGQLIKAPEGVSPPPDPNAEVQHIHNHWADCCGIKVPSAIAASEMSQKPGDLRKLRGSGVLPFD

SEQ ID NO: 74132 - protein, 620 aa, Nicotiana tabacum
MVKSAKKSATKVDAAVVAPTKPLKKGKREAGEEIEKIMSAKKQKKDMAVAQAVEKKKSDTKTQKKKKQESSSSDDSSESEDEKPTKAVAPPKKVAPAKYGKLASSSDDSDSSDEDDAPPPKKVVAASAKNGVAAMKKDESSDDSSSEDDSSSEEDVPAAKKPAANGSAAVSKKDESSDQSSSEDDSSSEDDAVAKKTAPKKGLAAAASKKEESSEDSSDDSSSDDDEPASKVAAAQPAKAAKKTGDGSEETDSDEDDSDSDVDKGKAAAVSKKKVESSSDSSDEESEESDEEGSQKKKIKPSSTPATVSKKESSSEESSEEDESEEEEDQKPSKTPKKDADVEMVDADSSKAQKTPITPKAQTPGSKTLFVGNLSYSVEQADVENFFKDAGEVQEVRFSTHEDGSFKGYGHVEFVTAEAAHKALELNGQDLLGRAVRLDLARERGEYTPRTGREENSFQRQGRSEGTTIFVRGFDKNEAEDQIRSSLEEHFASCGKIFKTRIPTDPEGYIKGMAYIEFANGDSDALNKALELDGSEVGGYNLTVQEAKPRGDSSGGGRGFGGRSGGRGGGRDGGGRLGGRGGGGRFGGGGRGGGGGGRGRGTPNRPSFTPSGKKTTFNDE

SEQ ID NO: 74133 - protein, 552 aa, Vitis vinifera
MVLGMPALSPTMTQGNIAKWRKKEGDKIEPGDVLCEIETDKATLEFESLEEGFLAKILVAEGSKDVPVGQPIAITVEDEEDIQKVPASVAGGSGVEEKKSKHENAGNEDKQQEMSSTINTAELPPHIVLGMPALSPTMNQGNIAKWRKKEGDKIEVGDVICEIETDKATLEFESLEEGYLAKIVAPEGSKDVAVGQPIAITVEDPDDIEIVKASVSSGSDIKKEKPQQQESRNEVRAEKSSFTRISPSAKLLITEFGLDASTLKASGPRGTLLKGDVLAAIKAGIGSSSSSSKDKMPPPPVHSQASPSASPERSHLQQSESFEDMPNSQIRKVIATRLLESKQNTPHLYLSSDVILDPLLSFRKELKEKHDVKVSVNDIVIKAVAMALKNVPEANAYWNAEKGEVILSDSVDISIAVATEKGLMTPIVRNADQKTISSISIEVKELAEKARAGKLKPNEFQGGTFSISNLGMFPVDHFCAIINPPQSGILAVGRGNKVVEPVVGGDGLEKPAVVTKMNLTLSADHRVFDGKVGGAFLSALRSNFSDIRRLLL

SEQ ID NO: 74134 - protein, 452 aa, Fulvimarina pelagi HTCC2506
MSGVIEADRRHVWHHLTQHKPYETIDPRVMIEGIGMRVWDATGKEHLDAVSGGVWTVNIGYGRETMADVIRDQLLKLNYFAGASGSVPGALFAQRLIEKMPGMSRVYYSNSGSEANEKVWKMVRQISHRHHGGKKSKILYRERDYHGTTFGALSAGGQAQRNAQYGPFMPGFVEVPHCLEYRSQWGPVDDYGERAANAIEDVILREGPDTVGCLCLEPITAGGGIITPPEGYWERVQDICRKYDILLHIDEVVCGMGRTGTWFGYQHYDVEPDFVTLAKGVASGYAAISCTVTTEAVFDYFRDDADDPLSFFRDISTFGGCTSGPAAALENMRILEEEKLVDNSARMGERLIGNLQALMEKHAVIGEARGQGLFAGAELVSDRESREPAPEALVKAVVADCMSNGVIIGAQNRSLSAGLNNTLLFAPALIATENDIDEITETVDAALMRIFG

SEQ ID NO: 74135 - protein, 556 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 74136 - protein, 476 aa, Chromobacterium violaceum ATCC 12472
MGENKMSDVFQFMKLSRNPGEKVEASVRKVEFKEIYQPLHAVDAADQAGRCLSCGNPYCEWECPVHNYIPNWLKLVEEGRLFEAAELSHQTNSLPEICGRVCPQDRLCEGACTLNQGGFGAVSIGSIEKYITDEAFKAGWRPDMSKVVWTDKTVGIIGAGPAGLACADVLVRNGVKAVVYDRYEEIGGLLTFGIPEFKLEKSIVHRRREILEGMGVEFVLNTEVGKDISFDKLMIKHDAVFMGMGAYKAMRGGFPGEDSKGVLQALPYLINNVRQSMGTLPVDEAAISMKGKRVLVLGGGDTAMDCNRTAIRQGAKRVICAYRRDEANMPGSRREVSNAREEGVEFLWNRQPLAIEPMIGGTLAVKLGETRLSEAGAKGRSAVELVPGGGEVLECDHVIIAFGFQAEAAAWFDACGVRTENGSGRTKVSRGGKYPYQTSNPKVFAGGDQVRGADLVVRAVFEGRQAAESLCAYLFD

SEQ ID NO: 74137 - protein, 387 aa, Symbiobacterium thermophilum IAM 14863
MMRMEKSLLMIPGPTPIPPQVAAAMTQPMLNHRGEAFSALFAEVSTKLQKVFRTAQPVYIFPGAGSGGWEAALVNTLNPGDAVLSVSIGDFGERWHKVAVQLGFAVERLRFEPGRAADPERIAERLAEDRERRIKAVLIQHNETSTGVTNDVRAIARAVREHGALLMVDSVSGLGALPLEMDEWGLDVVLTGAQKALMCPPGLSIIAFSERARAAAEKSAMPKFYWDLKAAHSSLQKWQTPYTPAISLLHALKAALELLETETLEGSWARHRLMGEMCRAGVKAMGLRLLAVDERTASNSVTAVVAPVDPKRLRKVAREQFGVELAGGQGDLADQIFRIGHLGYVVPGDVLQALAATEMALAQLGVDVQIGRAVAAAQEVWMNHVRG

SEQ ID NO: 74138 - protein, 124 aa, Aggregatibacter actinomycetemcomitans
MSSSVPSLGAFLAKVEQRDGNQPEFLQAVREVFTSIWPFLEQNPKYCSEALLEALVEPERAIQFRVAWTDDKGQVQVNRAFRIQFKSAIGPFKGGMRFHPSVNQSILKFLGFEQIFKNALTTFA

SEQ ID NO: 74139 - protein, 730 aa, Cryptococcus neoformans var. neoformans B-3501A
MAAPRRSAGVTSSSGYADVAELEKYKLISNIGKGSFGVISKVQRVSDGKEFALKQLDYSKMTEKDRKQILAEVAILDSLKHRNIVQLIQKIKDPKNERIYIVMEYCTSGDLGTLIRRAQRNNSSLPEDKIWNIFLQIVLALHHCHWPAERPANTGGRQSVVAPSTDGGVARYQVLHRDLKPENVFLSDEFVKLGDFGLSKDMGTASFTSTYVGTPLYMPPEILAENRYDTKSDIWSLGCLVYEMCALHSPFSAAQTQAELITMVKSGKIPPLPARYSPALRSVIKAMLTLHPAKRPSTKDLLEMPEMKLHRKLFTVQNQTSLLFAKRDELKQFEDQIRARAVALDEREKELAGREASLQAREDLCDSREEEAKETQRKLNQAAESLRGQWERFREEKEQWERYRELEEEAKETAFGVTDVPDEKCQPHTGVVGIARPPLEERNTAPASPSVSRFTRCLDTPSKIPLATAAVSPAPLAPLEARFSTSHFQPRPATPLRRAATKSMGNLAGVVRAQTAQEWAGATQSTPAKQFSFPIRQQRISIGSPSELQSVCCEDVSMISAIPSPWVPRPRKSSVAPSIVVAQQECPASGESFSTGNNRLASVAPTQIPAPTFIYREAATPAKWSFDDPDLPSPFIRRPNSMPTQPQAASFPPSSNMVGMRQPLGSINPQATITAPSALGSPVAKKIPSRSGNLHQHVLKVNAARVSGEGVAPSVAPVGVVRGRTGNRIG

SEQ ID NO: 74140 - protein, 382 aa, Ralstonia solanacearum GMI1000
MMRDAGQLDLMDSRVTQLAFWSALPERWTSDAEETLVCCHVRQETHDVKSFFFRSPAGRTFLFEPGQFITLELDIEGETINRCYTLSSSPARPHTISITVKRVPGGKVSNWLHDNLQPGAAIRVLGPAGEFTCARHPARKYLFLSAGSGVTPLMSMSRAHHDLAEDRDIVFVHSARTPDDIIFARELELIASNHTNFRTSFVVERLGARTNWPGITGFLSLPLLKLIAPDFMEREIFTCGPAPYMKAVRGLLEEAGFDPARYHEESFSFESLTTGAAAEAIAPDAAPTANPDAAAPQFSISFAKTGREIACGAAQHVLDAARQAGVRLPASCTQGMCGTCKVKLVSGQVDMKHNGGIRQREIDQGMVLLCCSKPLSDLVIDK

SEQ ID NO: 74141 - protein, 410 aa, Rickettsiella grylli
MKMLALGINHQTVDFALREKLSFSKDYLAHSLRAMLRDTLTEEAIILSTCHRTEFYCINGDVQKTMNWLYRYKKLSHDHLKSHWYVYQQENVLRHLLRLATGLDSKILGEPQILGQIKTAYAFAHSLGSVGVHFNRLFQYVFSASKYVRGVTDITAHPVSLAFAVVTCAKRIFACLADKKILLIGAGDTISLVGKYLFSQNVRQFWIANRTLQQAEKLGKTIGGQAICLNAIPYFLAKADIIIAATASDVPHIKRYNLKQALKTRKRRPLFIADLGMPRDVESAVQELEDVYLYTLADLHTLIQKNQQGRKAAAVKAESLIEEKVQRYLEQLKIKAAAPLICSYRKHAEQLRDAEVEKALSLLKKGRRQEAVIKQLAYRLTNKLIHAPSIALTQTEKYNEDVLFKTFIDK

SEQ ID NO: 74142 - protein, 133 aa, Streptomyces virginiae
MEGSPIMAKLSQDDLLAQFEEMTLIELSEFVKAFEEKFDVTAAAAVAVAGPAGVGAAPEAAEEQDEFDVILTGAGDKKIQVIKVVRELTSLGLKEAKDLVDGAPKPVLEKVAKEAADKAAESLKAAGAAVEVK

SEQ ID NO: 74143 - protein, 358 aa, Glycine max
MTNDNIAVTDLTSALNEENRADLVNALKSKIQSLAGAHSDVLETLSPNVRKRVESLREIQGKHDELEADFLKEREALEAKYQKLYQPLYTKRYEIVNGVTEVEGAANESTDESEENKEKGVPSFWLNAMENNDVLAEEISERDEGALKFLKDIKWSRIENPKGFKLDFFFDTNPYFSNTVLTKTYHMIDEDEPILEKAIGTEIEWYPGKCLTQKVLKKKPKKGSKNAKPITKTESCESFFNFFKPPEVPEDDADIDEDLAEELQNQMEQDYDIGSTLRDKIIPHAVSWFTGEAAQGDEFEDLEDDEDEEEDEDEDEDEEDDEDEDDEEEDDTKTKKKKSGKAQAGDGDGERPPECKQQ

SEQ ID NO: 74144 - protein, 276 aa, Ehrlichia ruminantium str. Welgevonden
MFYNISHLMENYSRLFTKELYNILPKADHDDILLASMKYSLFTPGKYIRPFLVNASAQIFNVNIDRTLPVSVAIELIHVYSLIHDDLPGMDNEDTRRGQLSSHKKFTEAIAILTGDALLTLAFEVLSTINESPYIRCRIIQVLTQAIGYQGMIKGQVLDTETIAKDINDIKTMHTLKTACLFSAACEVGGILGGASDTELNSLKNYGLNLGFAFQIKDDIADICKDISKNNILNILSKEDTENYIRSIVDKSIEYLAIFSNKANILNNLAEFIRNL

SEQ ID NO: 74145 - protein, 378 aa, Zea mays
  misc_feature (252)..(252): Xaa can be any naturally occurring amino acid
  misc_feature (256)..(256): Xaa can be any naturally occurring amino acid
  misc_feature (357)..(357): Xaa can be any naturally occurring amino acid
MMANGRFQKQALLPPRSPFPVAAPHAELGPIARPRETPHRHGHQRTSSESFLADEQPSWLDDLLDEPETPARAHGRPGHRRSSSDSFALFEGGSAAGGMYEFDNVLDGMRGGGQVASLAGAPEFFPEPASFGRPWESRQMYRQGGGMPMPGREKNGGRHGPSSSFGEHELGHVPNGVNRKAHGDAAYDQRIVIERKEGLRHSQSETDTKRAKQLKDEHIAIPHAAQQYAQRSRVRKLQYIAELERRVQSLQXIFFXLNELYQSFLARTEGIEVTAEMDFLGQQNIMLDLENKALKQRLESLSQEHLIKRYQQEMFEREIGRLRTLFQQQQQQQHVPQQQAPTHSRSNSRDLDSQFAXNLSLKHSDPSSGRDAISGLRI

SEQ ID NO: 74146 - protein, 150 aa, Zea mays
MATVLGSPRAPAFFFSSSSLRAAPAPTAVALPAAKVGIMGRSASSRRRLRAQATYNVKLITPEGEVELQVPDDVYILDQAEEDGIDLPYSCRAGSCSSCAGKVVSGSVDQSDQSYLDDGQIADGWVLTCHAYPTSDVVIETHKEEELTGA

SEQ ID NO: 74147 - protein, 375 aa, Vitis vinifera
MQSTHLLLEEPIRMASILEPSKRSFFPAMTKIVGTLGPRSRSVGVISGCITAGMCVARFDFSWGDAEFHQETVENLKVAVKSTKKLCAVMLDTVGPELQVLNRSEHPISLQVDSLVVLTPNQDKEATSNLLPLNFGGLSKAVKKGDTIFIGQYLFTGSETTSVWLEVTEVDGEDVVCLIKNSATLAGSLYTLHVSQIRIDLPTLTDKDKEVISTWGVQNKIDFLSLSYTRHAEDVRHAREFLSKLGDLNQTQIFAKIENIEGLNHFDEILQEADGIILSRGNLGIDLPPEKVFLFQKAAVYKCNMAGKPAVITRVVDSMTDNLRPTRAEATDVANAVLDGSDAILLGAETLRGLYPVETISTVNKICAEYKISGK

SEQ ID NO: 74148 - protein, 205 aa, Neisseria meningitidis Z2491
MPYTEDMRPGDTANPYGASKAMVERMLTDIQKADPRWSVILLRYFNPIGAHESGLIGEQPNGIPNNLLPYICQVASGRLPQLSVFGGDYPTPDGTGMRDYIHVMDLAEGHVAAMQAKSNVAGTHLLNLGSGRASSVLEIIRAFEAASGLTIPYEVKPRRAGDLACFYADPSYTKAQIGWQTQRDLAQMMEDSWRWVSNNPNGYDD

SEQ ID NO: 74149 - protein, 129 aa, Glycine max
SIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFKYI

SEQ ID NO: 74150 - protein, 87 aa, Glycine max
  misc_feature (31)..(31): Xaa can be any naturally occurring amino acid
LKKPNVFLKNGVKVAPKKKRLEILSPYQGPXTFNWEEKTIPFGKFVRGTYLARTKFLAADPKSNLEVNYSFEIQKNSPTPQKDLFLT

SEQ ID NO: 74151 - protein, 444 aa, Vibrio fischeri ES114
MESNTKKIGLIACTGVVAGNMMGSGIALLPSSLAAVGSVSIFSWIICLVGALSLAFVFARLATKNPQEGGPIAYAGEVSPVFGFQTGVLYYHANWIGNLAIAITGVSYLSVFFPALNDPIPAAAATIASVWLFTLVNLLGGSWVSRLCTLGLGLILIPVVGTAIVGWGHFDSTLYSQNWNVSSGTSTHAIISAVLICLWSFVGVESAAVSSGMVKNPKRTVPLATMLGTAIAGVIYILSTQVISGMFPAAEVAASGAPFALATTEIFGSWSAPFVAAFTALACFTSLGSWMMLVGEAGKRAAHDGNFPKIYGETDKNGVAKKGLILASLKMTALMVALTVFSSQSAHTADLFNQLTTDAVLLTMLPYFYSSINLIRFEGMTTRSGFTMFFSGIACVFCMIALAGAEGATLTATFIVSLVILMFYAKKMGLKQSEQHVTAEAVAH

SEQ ID NO: 74152 - protein, 513 aa, Glycine max
MLPRSRTLPSRIHQGIIEERHNVRHYLQVEVRPNNTQTETEAMNIQSNYSKCFDDDGRLKRTGTFWMATAHIITAVIGSGVLSLAWAVAQLGWVAGPIVMFLFAVVNLYTSNLLTQCYRTGDSVSGHRNYTYMEAVNSILGGKKVKLCGLTQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKSFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSARKWPKSNFVTAEYDIPIPCFGVYQLNFFRLVWRTIFVLLTTLIAMLMPFFNDVVGILGAFGFWPLTVYFPIDMYISQKKIGRWTSRWLGLQLLSASCLIISLLAAVGSMAGVVLDLKTYKPFKTSY

SEQ ID NO: 74153 - protein, 368 aa, Ralstonia solanacearum GMI1000
MKTKAAIAWKAGAPLTVEEVDLQGPRAGEVLVEIKATGICHTDYYTLSGADPEGIFPAILGHEGAGVVLEVGAGVTSLKAGDHVIPIYTPECRQCKFCLSRKTNLCQAIRATQGKGLMPDGTSRFSLDGKPLFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFINPKDVGNVVDHIIQLTDGGADYSFECIGNTQVMRQALECTHKGWGQSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 74154 - protein, 484 aa, Symbiobacterium thermophilum IAM 14863
MKERNVAGFFSRMTEHWRGDLFGGVTAAVVALPLALAFGVLSGAGPMAGLYGAVFTGILAAIFGGSPAQVSGPTAGMTVVLVPIYQEFGLTGLYMAMFLGSALLLLLSFLKVGRYVHLISQPVLSGFTNGIALLIFLQQIDSLRGASGAIVPAEAGLAGAVVAIMLVWPRITRKVPGSLVALVLSTAAVRLFWPEVFTTIGPIPGGWPTPQLAFFGELANLGALLRPALTIALLGAVESLLSAVVVDEMAGTRHDPDRELFGQGLGNMVATLFGGIVGTGAIVRSAARIQAGGRTRLAAVTHGLVILLVAVALGDLAGLIPRATLAGILMGTAINMVDRRSLADVRRVPVGDAAIMLTTAAITVVFDLVTAVAVGVLLSMIRFAVTVTDAPLTVKRMGKVTAIRLTGPLYFGAAKPFLDAVDAVPEGSTLVLDLRGVTSLDATGAQALERGYARATARGCEVSGPGCSPRFTGCCPAGTGCRCS

SEQ ID NO: 74155 - protein, 191 aa, Mesembryanthemum crystallinum
MAMQLSLSHQSWAKSLASPITSFDPARSPPKRVELGPNCLNGGATAGKLMREKVGERMRMSGRSCCVKASLETAVGAESETLVGKVTEVDKDTFWPIANGAGDKPVVLDMYTQWCGPCKVMAPKYQELAEKLLDVVFLKLDCNQENKPLAKELGIRVVPTFKILKGGKIVDEVTGAKFDKLVAAIEAARSS

SEQ ID NO: 74156 - protein, 174 aa, Paracoccidioides brasiliensis
MATLKGLGVSEIHDGSTLRIAIVHARWNDTIIAALVEGAKKALLAAGVRGSNIVVQSVPGSWELPIAMERIYAGSQSEQPFDAMIAIGTLIKGETMHFEYIADAVSHGLMRIQLDKDVPVIFGVLTVLNEEQALVRAGLAKGEGSAGHNHGEDWGRAAVELGVKRKQWAMGKFS

SEQ ID NO: 74157 - protein, 120 aa, Glycine max
  misc_feature (58)..(58): Xaa can be any naturally occurring amino acid
  misc_feature (88)..(88): Xaa can be any naturally occurring amino acid
  misc_feature (92)..(92): Xaa can be any naturally occurring amino acid
AASMISSPAVTTVNRAGAGMVAPFTGLKSMAGFPTKKTNNNITSITSNSGRVQFIQVXPPIGKNKFKTLSYLPDRNNTQLSKKVQYLXKKDXIPYYKFELKHDFLYPEHNRSPRYYNKRY

SEQ ID NO: 74158 - protein, 336 aa, Debaryomyces hansenii CBS767
MATNKEGKPLEILKFADDSGSYKRQSSKFRNFISNAENSKFKPELNRYHLYVSMACPWAHRTLITRVLKGLTQIISVSVVHWHMDNNGWRFMNKEEASKRSSNSDILNGTEDHLHGFDRIKQLYFKADPEYSGRFTVPVLWDKKLETIVNNESSEILRMLNSEFNSLLSSEYAELDLYPKDMREAIDEINSWIYDNINNGVYKTGFSTKQEVYDKEVVNVFNHLDKVELILAKNHEGPNKIEFLLDNKITEADIRLFTTIVRFDAVYVQHFKCNLKMIRYDYPNIHNWLRLLYWKIPGFNETTDFHHIKCHYTKSHVGINPNGITPLGPVPDVLHY

SEQ ID NO: 74159 - protein, 244 aa, Oryza sativa
MSSTNNSSGEPPPAVRVLGGWASPFTNRVVVALKLKGVEHELLQETVGKKSELLLRSNPVHKKFPVLLHHGKPLPESLVIVEYIDEVWPASNGAASAILPRDPHGRAVERFWARYVDDKILPGLRVLRGSVTGDKYKTAGEMSTALQRLEEAFVKCSQGKEYFGGDSIGYLDIALGSFLGWVKAVEKIAGVELLNETKLPILAVWADRFCAHPAVVDVVPDADKLVEFTVQYGAVLNTTNVLPK

SEQ ID NO: 74160 - protein, 232 aa, Yersinia pseudotuberculosis IP 32953
MSTIQQNLQDVRARIATAAHNCGRSPEEVTLLAVSKTKPVAAIEKAIAAGQYAFGENYVQEGVDKIHSFADNKTLEWHFIGPLQSNKSRLVAENFAWCHTVDRLKIAQRLSAQRPAAMPALNVLIQINISDEQSKAGISLSELPALADSISTLPNLCLRGLMAIPAPEHDYQRQLAVFTQMNQAFLTLKARYPQIDTLSMGMTDDMDAAISAGSTLVRIGTAIFGARVYNAD

SEQ ID NO: 74161 - protein, 335 aa, Debaryomyces hansenii CBS767
MATDKRGNLLGNLNFADETGAFKKKASTFRNFISSAENARFRPELNRYHLYVSMACPWAHRTLATRVLKGLTQIISVSVVHWHMDNNGWRFMNKEEASKRSSKSDILNGTEDHLYGFDRFKQLYFKADPEYAGRFTVPVLWDKKLETIVNNESSEILRMFHSEFNSLLPSEYAELDLYPKEKRHEIDEINSWIHDNINSGVYKTGFSTKQEIYDKEVANVFNHLDMVEQILAKNKESFNSFLIGNKLTEADIRLFTTIVRFDAVYVQHFKCNLKMIRYDYPNIHKWLRFLYWKIPGFKETTDFDHIKYHYTKSHPGINPNGITPLGPVPNILNYS

SEQ ID NO: 74162 - protein, 273 aa, Yersinia pseudotuberculosis IP 32953
MQHRNITFIGAGNMVRAIIAGLVAGGYPAKMISVCAPSAKNRDALATEFGVISSDDNIRESQKAEVVVLAVKPQLMADVCQQLQKQVDFSDKLVLSIAAGVQVARFYALLGNKLNLVRIMPNTPSLVGKGMSGLYAPEQVSAADRDFTTELMSAIGKVCWVDNEDGINSIIAAAGSSPAYFFLFMEAMQQETERLGFDSETARQLVQQAASGACALVEANPHVPLSALREQVTSKGGTTAEAIRVFNEQHLPEMVAHAMQAAITRAKEMEKLF

SEQ ID NO: 74163 - protein, 530 aa, Streptomyces coelicolor A3(2)
MDVMPLLLLVAGSAAVAAAGRRVPVPVPLLLVAAGLAVSYVPGVPDYTLDPHIVLPLLLPPLLYTAATDSSYLDLRAQARPVALLSVGYVLFATFVVGCAAYLIVPGLPLTAALVLGAVVAPPDAVAATAVARRVGLPSRITTILQGESLVNDATAITAFKVALAAAVGEGATWAGGIGEFLIAAVGGVGVGLVLMVPLHWLRTHLTEALLQNTLSLLIPFVAYAVAEQVQASGVLAVVVVALYLGHRAWEVDFATRLQEEAVWKMVAFVLESAVFALIGLQLPVVLKGLGEYEGADAAWYALAVFLVVAVARFVWVYPATYLPRLSARVRAREGELSWKGPFVIGWAGMRGVVSLAIAFSIPLTVHGGEPFPERNLILFLTFTTVIGTLVVQGVSLPPLIRLLKFPAHDVQAETLAEANAQAQASRVAELRLDDLLADERNALPAPLADRLRMVLERRRNAVWERLGQVNPVTGETVDDTYRRLSREMISAEREVFVRLRDGRYIDDEMLRTLLRRLDLEEAAAYREAT

SEQ ID NO: 74164 - protein, 393 aa, Zea mays
  misc_feature (266)..(266): Xaa can be any naturally occurring amino acid
TSLYKKAGWYRSGIPGIKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVXEVIVEMTGGGVDYSFECIGVPSVMTDAFRCTKMGKGKTIVLGLGRDSDEVSLPSLELLFGRCVMGSFFGGLKPKTHIPVLPKKCMDKELQLDALVTHELGLQDINKAFALLLQGKSLRCILWMDKDK

SEQ ID NO: 74165 - protein, 302 aa, Streptomyces coelicolor A3(2)
MTGTDTRQLAALRPRLPSPLHEVADGRFERHGVRLLLKRDDLIHPELVGNKWRKLAPNLATADGRTVVTFGGAYSNHLRAAAAAGRLLGLPTVGVVRGQELAGLPLNPSLARCAADGMRLHFVDRSTYRRKSEPETLAALLRAAGAEGAVVVPEGGSNADAVRGCRALGEELGTHADVAAVACGTGGTLAGLAAGLPRGRRALGIPVLKGGFLEGDIRRLQERAFGGPRGDWSLEDRFHHGGYARTTPGLDAFAADFEHRHGLPVERVYVAKMLYALLTLTEEGAFPRGTTLAAVVTGRPFP

SEQ ID NO: 74166 - protein, 438 aa, Sulfolobus tokodaii str. 7
MFRKTKIIATLGPSSENHIDELVKYVDVIRLNFAHGDKEQHEKYFNLVKNRVPILVDLPGPKLRIGDLGKNMILLKPGDTIEFGTQIPVDDILFFKLIRKGSEVLISDGRIRVKIIEAGNNYAKGLVEEGGILTSRKGINIPDSEIPVGLTDRDLELLKYALEMGATFIGLSFVTSPEEIRKAKEIVKDQAWIIAKIEKKSALKKLKEIIREADGVMVARGDLGVEVGLANLPQTQRRIVRLTRLYGKPVILATQVLESMVTSPIPTRAEVIDVANSIIQGVDAIMLSDETAMGQYPIDAVRTLHELILSVERSFKPRPPPPLKNIDDAIAYSAVSASNLASSSGIVVYTRTGASALRISRLRPVVPIIVLTQNQRVYERLKLCYGIYSFISEELNSLDNIVEKSKNIARQVGLKNTIIIIAGGIEEGSTRFLKVEEI

SEQ ID NO: 74167 - protein, 464 aa, Arabidopsis thaliana; identical to SEQ ID NO: 1217

SEQ ID NO: 74168 - protein, 386 aa, Streptomyces coelicolor A3(2)
MTETRRGATATCRPTGAPERHGPIGTQREKEPGEPSDGQGEAVVEGHEAALLLSESRASVDPELRSAIATLPESMRRVALYHFGWQHADGTPAAGNAGKAIRPALVLTAAAALGGPGARAAAVRAAAAVELVHNFTLLHDDVMDRDATRRHRPTAWTVFGDADAILAGDALQALALRLFAADPHPASAAAATRLADCVMELCEGQHADTAMERRPPDEVTLDETLVMAEAKTGALLGCACAVGALYAGAATEDVEALDAFGREAGMAFQLIDDVIGIWGDPRHTGKPAGADLAARKKSLPVVAALTSGTPAAAELAELYTGPYDENKEDLERTALAVERAGGRDWAQAQAADRMARAMQELARAVPEPEAAGGLLALAEFVTRRST

SEQ ID NO: 74169 - protein, 2216 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVAPSFSGVAKASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 74170 - protein, 202 aa, Shewanella sp. MR-4
MHNASDIQSALVPMVIEQTAKGERSFDIYSRLLKERIIFLVGQVEEHMANLIVAQLLFLESESPDKDIFLYINSPGGSVTAGMAIYDTMQFIKPNVSTVCIGQAASMGAFLLAGGEKGKRFCLPNSRVMIHQPLGGFQGQASDIAIHAQEILGIKHKLNLMLSEHTGQPLELIERDTDRDNFMSATQAVEYGLVDAVMTKRG

SEQ ID NO: 74171 - protein, 799 aa, Rhodospirillum rubrum ATCC 11170
MTFADLGLSPETLRAIEEVGYTTPTPIQVQAIPYVQMGRDVLGIAQTGTGKTASFTLPMIDILASGKAKARMPRSLILAPTRELATQVSENFTLYGKYQKLSMALLIGGESMNEQQKVLDRGVDVLIATPGRLIDLFERGSILLRDVKVLVIDEADRMLDMGFIPDVERIVALLPKIRQTLFFSATMDKEIRRLADAFLMNPKEVRIEPTQKVAETVEQALIMVKASEKREALRQLLRRETVTNAFIFCNRKRDVDVLYKSLSGHGFDILALHGDMPQYVRTERLEKFKRAEVQLMVCSDVAARGIDVTEVSHVFNFDVPTHPEDYIHRIGRTGRAGRLGRAYTLATPEDAKYLRAIENLLGKTIPPDPQLELSDVAVEDVALAVAEDDRRPKRGGKGRPERGARRSGRGSADAERPRPLAPERAANDQAPVERPAVEKTLAEQPVAERPPVERGQAERTAERPSSDRTNERASSDRSSERASSERNGDDRGRGGRGRDDRSAARGRRPRRWEDDPQSEVMEMRIGDDVIGFGGFTPAFLLVPSVPFSDPDELDREALAEEALADAGLLVEAEEPENDSDFVPAPGLAAREIETAPKAPVAAEKPEREKAEREKPKRKRGGRRTKGATDGADTAPTAETLAATTEGTDALAATSEGTDALAATTEGTDAVAEPLSDDAAPMVAEAPGAEPVVEAPTVAEAAPEKPKRKRAAPRKKAEAAETVTNEAAASPEAEAPAEKPKRKRAAPRKKAEAVGAEGDETVAVVAEKPKRKRAAPRKKAEAAQADAEAEVAAPTEPRED

SEQ ID NO: 74172 - protein, 553 aa, Rhodospirillum rubrum ATCC 11170
MPTIATALLDALKAHGATRIFGIPGDFALPFFRVAEQSALLPLYTLSHEPGVGFAADACARMGRGLGVAAVTYGAGALNMVNPVAGAWSEKSPLVVISGAPGVAESAGGLLLHHQAKTLDSQWRIFEEITCARTRLDDPLTAPGEIARVLRACLEHSRPVYIEIPRDIVDAPCAAVDRLPPTPVDGEAVEAAAGEIMARLAAASAPALLLGVEVRRHGIEADVAELARRLGLPIATTFMGRGLLSEEGAAGGAPDSLMGTYLGLAGRPEVRAVIEDSDGLLMLGVILSDTNFGVSGKRIDLRRAMLAADRQVALGFHTYNDIPLADLVAALLRQAEGFARQDAKALPKPTALPRDMIADGAPIGPMDIAAAINDLFSAHGVMPIASDMGDCLFTALDTTHAPLVAPGYYATMGFGVPAGLGVQASCGRRPLILVGDGAFQMTGWELGNCARYGWDPIVIVFNNASWEMLRTFQPDTAYNDLADWRFADLAAGLGGVGHRCQTRADLARALDRAAREPGRFHLIEAVLARGAISDTLQRFVTTMKGRHAAAADA

SEQ ID NO: 74173 - protein, 83 aa, Desulfitobacterium hafniense DCB-2
MATLYVGNLPWNTTSEDLNSFFGQYGQVISSRIITDRETGRSRGFGFVEVEDEDAARMAEDLNGKDFGGRPLTVNEARPKQQM

SEQ ID NO: 74174 - protein, 339 aa, Neisseria meningitidis Z2491
MKNILVTGGTGFIGSHTVVSLLKSGHQVVILDNLCNSSINILPRLKTITGQEIPFYQGDIRDREILRRIFAENRIDSVIHFAGLKAVGESVAEPMKYYDNNVSGSLVLAEEMARAGVFSIVFSSSATVYGDPGKVPYTEDMPLGDTTSPYGTSKSMVERILTDIQKADPRWSMILLRYFNPIGAHESGLIGEQPNGIPNNLLPYICQVASGRLPQLSVFGGDYPTPDGTGMRDYIHVMDLAEGHVAAMQAKSNVAGTHLLNLGSGRASSVLEIIRAFEAASGLTIPYEVKPRRAGDLACFYADPSYTKAQIGWQTQRDLAQMMEDSWRWVSNNPNGYDD

SEQ ID NO: 74175 - protein, 484 aa, Fulvimarina pelagi HTCC2506
MADTYDVLVIGGGPGGYVAAIRAAQLGFKTAVVEREHLGGICLNWGCIPTKALLRTAEIFHYAENGKNYGLEIAKPKFDIEAVVKRSRGVSAQLNGGVGYLMKKNKIDVIWGQAKIKKAGKGGPVEVEVGKMQKPIVEPQHPVPKGTLGEGTYKAKHVIVATGARPRVLPGIEPDGDRIWTYFEAMKPKSMPKSLIVMGSGAIGIEFASFYRTMGAEVTVIELLPQILPVEDAEVAKLARKQFEKQGMKIMTDAKVAKVEKGKDGVTVTVETKGGKSETLKAERLISAVGVQGNTEGLGLEEAGVKIERGVVQTDGLGKTDAPGIYAIGDVAGPPMLAHKAEHEGTICVEAIKGMHPHPMKKTEIPGCTYCHPQIASVGLTEAKAKEIGHEVKVGRFNFTGNGKAIALGEPDGMIKTVFDAKTGELLGAHMVGAEVTELIQGFVIAIGLETTEEELFHTCFPHPTLSEMMHESSLDAYGRVIHQ

SEQ ID NO: 74176 - protein, 158 aa, Vibrio fischeri ES114
MRIGHGFDVHKFGGEGPVIIGGVSVPYEQGLIAHSDGDVALHALCDALLGAIAEGDIGRHFPDTDDKWKGADSRALLRDVYRRVKEKGFALGNADVTIIAQAPKMAPYIQAMCNAIAEDLETELDNVNVKATTSERLGFTGRKEGIACEAVVLLVKAS

SEQ ID NO: 74177 - protein, 490 aa, Pseudomonas fluorescens Pf-5
MGCASGRWPFCSNCSVRVRDMSAVTSLMEDSPVGLGAAPQETLYQFDESPLLARQSRQESNARSYPRRIPLALKRASGIHVEDVEGRRFIDCLAGAGTLALGHNHPVVIAAIQQVLADELPLLTLDLTTPVKDQFVQDLFGLLPEALAGEARIQFCGPTGTDAVEAALKLTRTATGRSTVLSFQGGYHGMSQGALSLMGSLGPKRALAGLLNNGVQFLPFPYDYRCPFGLGGAEGVKVNLHYLENLLTDPEAGVALPAAVIVEAVQGEGGVIPADLEWLQGVRRITEKAGVALIVDEIQSGFGRTGKMFAFEHAGIIPDVVVMSKAIGGSLPLAVMVYRDWLDTWQPGAHAGTFRGNQMAMATGSAVMRYLKEHRVPEHAAAMGERLREHLLILQRDFPQLGDIRGRGLMLGVELVDPAGVPDAQGHPPQHARLAPLVQRECLKRGLILELGGRHGAVVRFLPPLVITAAQIDQVAQIFSKAVAAAVASL

SEQ ID NO: 74178 - protein, 308 aa, Yersinia pseudotuberculosis IP 32953
MVTTLDNALLNDILQQVRPLIGQGKVADYIPALAEVPANKLGIAVCTLDGQIFQAGDADERFSIQSISKVLSLTLALSRYSEQDIWQRVGKEPSGQPFNSLVQLELEKGKPRNPFINPGALVVCDMLQSRLSAPKQRLLEVVRQLVKDDSISYDPRVARSEFEHSDRNAAIAYLMKSFGNFDNDVLTVLQTYFHYCAMRMSCVELARCFVYLANQGRSISGSESLITPMQARQINALMITSGMYDGAGEFAFRVGMPGKSGVGGGIIAIVPDEFCIAVWSPELDHAGNSLAGTAALERLAQQIGRSIF

SEQ ID NO: 74179 - protein, 481 aa, Oryza sativa
MLPYFDPEYENFSQRINPPRVCIDNSTCSDCTLVKVDSMNKNGILLEVVQVLSDLDLAISKAYITSDGGWFMDVFHVVDKQGQKVTDEKTIKHIEKALGPDSNLLGGAKGGSSPVRSVGMHSIGDHTAIELKGPDRTGLLSEVFAVLAELGCNVLAAEVWTHRARVACVVYVNDVASGQAVGDPCRLSRIEHRLRLVLRGHAGGDDGDGDDGPAHANFFSSGGAGSNTHVDRRLHQLMHADVDADDDDGLDSRAIVSGEAGNAAAAEERPVVTVEHCEEKDYSVVNVKCRDRSKLLFDIVCTLTDMHYVVSHASVSSDGIYGIQELYIRRKDGRTLQKDEAGRVIKCLEAAISRRVSEGFTLELCGRDRVGLLSDVTRVLREHGLTVTRADVTTVGGQAINVFYVRDASGEPVDMKTIEGLRVQVGHTVMLNVKKVPSSPSSSSAAAAAAANSKSPGQPASGALSRTSFFSFGNLFAKLRA

SEQ ID NO: 74180 - protein, 105 aa, Vitis vinifera
MILLIKKIRILRERESPENSPTILCFDIFRPPDLTVNMTTSRRLADRKVEKFEKNITKRGSVPETTTKKGSDYPVGPVLLGFFVFVVIGSSLFQIIRTATSGGVA

SEQ ID NO: 74181 - protein, 443 aa, Gibberella zeae PH-1
MMLHPIISNFSLNNIKSQQPGLSPHQSCQTKVSPTHYATATRVKLLTYGQTDGKRKAEEEPSSPTPSKRIKQDDSAEPPEKKPDIKRIPFPEKPAVIEERNGEIEFRVVNNDNEREALIILTGLKCIFQKQLPKMPKDYIARLVYDRTHLSIAIVKKPLEVVGGITYRPFKGRRFAEIVFCAISSDQQVKGYGAHLMSHLKDYVKATSDVMHFLTYADNYAIGYFKKQGFTKEITLDKKVWMGYIKDYEGGTIMQCSMLPRIRYLEMGRMLLKQKECVQAKIRAYSKSHNIHAPPKEWKNGITEINPLDIPAIRASGWSPDMDELARQPRHGPNYNQLLHLLNDLQNHNSAWPFLVPVNRDDVADYYDVIKEPMDLSTMESKLEADQYLTPEDFIRDAKLVFDNCRKYNNESTPYAKSANKLEKFMWQQIKAIPEWSHLEPEK

SEQ ID NO: 74182 - protein, 212 aa, Zea mays
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKAEPVAEATSREVAVEEKKEEAEPAAATEAAPAPAETPSEAAVVEEKKEEEKKEEEDKPAAEEAAPPAAAAAAAAEEK

SEQ ID NO: 74183 - protein, 979 aa, Debaryomyces hansenii CBS767
MSSQVVTNLEETTNQHKAINNPNVVKRIHREVRFGLYILGSTLGEGEFGKVKLGWRKDGKHPSQVAIKLIKRDTIMKDSESEIKIHREINSLKMLNHPNIVNLVEVMKSGKYIGIVLEYASGGELFDYILQHKYLKENVAKKLFAQLVSGVDYMHSKGLIHRDLKLENLLLDKHKNVIISDFGFVNSYNKDKNDLMKTSCGSPCYAAPELVLTQAPYEGRKVDTWSLGVILYAMLAGYLPFDDDPENEDGSDIVRLYHYICKTPLTFPEYISPLARDLLRKIIVPDPKKRITIKNIKNHPWLTPYVNLLSVTQPEWDKVHKDNKTVNPKSAATANNSYTNLIHSNTNKRFSMINEKTNSSSLMMPAGRSYSSTNVVNQLYSNPSAPTTSSSLANAVALSKPKDPASDRSRTPSPTKQLPNGNNYSSTNYQRGHAKSTSISNPYSSASNALKAMVTENDSKRNSLVSLDSTTSSMISLTSSTKPAQHNHLPSPHLPRSTTYTGSAISTIAESPSKPSPATHLAVDNESNVTHHNTASSSNITNLKPNSSSRESAKLPHANKKPRPTSYHPSSMSASLMSSNGSSLQDYIKIPTPLLPIPQLLSTSPTKASPSSETSSPVFTDTNNSSPTMRSNASINSRRNSVVTHVHVNGVLTSESNANHNENKRNSVLSYLEDKMDALELTELHSPLKSNKPGFTDNASDTNITPQINQLPMFDGQTESPIIHTSKAEESQVKDQSEEGNKIETDEHPFVNVANQVDENKVVDLALEKESISEAPEEPNVSHSQDRTNQQENITLEFEEPKYTLEAQPAEPVSQTFKDEPVVSLDEQLIKRDHVNIIDEQEKENLDRKTTNTKKETSREINKSSAKEIKDNKKRNRFSLLSFYSNYNGSSSSNVVLQQAPTSNVSHSGKRILEPSLEQNVPTQPQDQKRNVSNSSGKSSTSKKSNNSGTAHISSNNGKEASAARKVMDFFKRRSVKIG

SEQ ID NO: 74184 - protein, 622 aa, Oryza sativa Japonica Group
MPSRLQRRRTVLTGGGGWFAVQRGGGDSARLRCERGRGEEEDEGRGWSVGLGPIDGGDEATWERGTNRRLGEAESRNWSSCWKSHHAQEPRSDLGHVACVAIGVSRGGNMMLRNRGRCWVPEGRKQLRSNNAVQRARQRQDAPRQSLPPSNRETCILAVRIPAGFRRRSPRNPRQEIAAQMDRQEEDDDAALREAGGGASFPGGWLRRLSRELRWSFVLAVVAVYGACQGVGDAVGGVTAGYYWKDVQRVQPSAAQFYQGFGLLTDVVPVAGYRRRPYFLLPLGIMPAILALTAQSAGAAVADVTVDALVAQNSITHQPLAADMQSLCGFSSSVGALLGFSISGLLVHSIGSQGALGLLSIPSALVFLAGVLLKERRVTDFDYKQEFIGLVYSVGSIGSLLGVLLYQISLKDYPFRGVLFWGQVLSSLAGMLNLIMVTRLNTRIGIPDYVFAVIDNSVSQMVGRLKWLPLLVLCSKLCPPGIEGTFYALLMSIQNAGLLMSGWWGGLMLHLLNVTRTEFSNLWVAVLIRNLSRLLPLMLLFLVPQSDQNSMLLPAEMLQDNESTEARKGGQDTAEFSVLVADDSSCHALNVAVEDERIKVVDAGTGTVELIPLMNELQDRGS

SEQ ID NO: 74185 - protein, 334 aa, Mycobacterium tuberculosis CDC1551
MAGIASTVAVMGAGAWGTALAKVLADAGGEVTLWARRAEVADQINTTRYNPDYLPGALLPPSIHATADAEEALGGASTVLLGVPAQTMRANLERWAPLLPEGATLVSLAKGIELGTLMRMSQVIISVTGAEPAQVAVISGPNLASEIAECQPAATVVACSDSGRAVALQRALNSGYFRPYTNADVVGTEIGGACKNIIALACGMAVGIGLGENTAAAIITRGLAEIIRLGTALGANGATLAGLAGVGDLVATCTSPRSRNRSFGERLGRGETLQSAGKACHVVEGVTSCESVLALASSYDVEMPLTDAVHRVCHKGLSVDEAITLLLGRRTKPE

SEQ ID NO: 74186 - protein, 428 aa, Arabidopsis thaliana
MAGAASALFLLDIKGRVLVWRDYRGDVTAAQAERFFTKLIETEGDSQSNDPVAYDNGVTYMFVQHSNIYLMIASRQNCNAASLLFFLHRVVDVFKHYFEELEEESLRDNFVVVYELLDEMMDFGYPQFTEARILSEFIKTDAYRMEVTQRPPMAVTNSVSWRSEGLKFKKNEVFLDVIESVNILVNSNGQIVRSDVVGALKMRTYLSGMPECKLGLNDRILLEAQGRAIKGKAIDLEDIKFHQCVRLARFENDRTISFIPPDGSFDLMTYRLSTQVKPLIWVEAHIERHSRSRVEMLVKARSQFKDRSYATSVEIELPVPTDAYNPDVRTSLGSAAYAPEKDALVWKIQYFYGNKEHTLKADFHLPSIAAEEATPERKAPIRVKFEIPKFIVSGIQVRYLKIIEKSGYQAHPWVRYITMAGEYELRLM

SEQ ID NO: 74187 - protein, 541 aa, Triticum aestivum
MMGLGLGDPPADYGSIMAVGLFVALMCICIIVGHLLEENRWMNESTTALLLGLGAGTVILFASSGKNSRLMVFSEDLFFIYLLPPIIFNAGFQVKKKQFFRNFMTITLFAVVGTLISFSIISLGAMGLISRLNIGSLELGDYLALGAIFSATDSVCTLQVLNQDETPFLYSLVFGEGVVNDATSVVLFNAIQNFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSIGLSSIIVALVLVARAAFVFPLSYLSNLTKTTPGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLPGNGPETDLENAVSIRRPTSLRMLLASPTRSVHHYWRKFDNAFMRPVFGGRGFVPFVPGSPTESSVPLLAHGSEN

SEQ ID NO: 74188 - protein, 409 aa, Streptomyces coelicolor A3(2)
MAAEIVNPRSDSEAGAEQEAGAEPLDSFDPAFALHRGGKMAVQATVPIRDKEDLSLAYTPGVAKVCSAIAEQPDLVHDYTWKSSVVAVVTDGTAVLGLGDIGPEASLPVMEGKAILFKQFGGVDAVPIALNCTDADEIVETVVRLAPSFGGVNLEDISAPRCFEIERKLQERLDIPVFHDDQHGTAVVTLAALRNAARLSGRTLGELRAVISGAGAAGVAIAKMLVEAGIGDVAVADRKGVVSADREDLTPVKQELASFTNKAGLSGPLEAALAGADVFIGVSGGTVPEPAVASMAEGAFVFAMANPNPEVHPEVAHKYAAVVATGRSDFPNQINNVLAFPGIFAGALQVRASRITEGMKLAAAEALASVVGDDLAADYVIPSPFDERVAPAVTAAVAAAARAEGVARR

SEQ ID NO: 74189 - protein, 371 aa, Nitrosomonas europaea ATCC 19718
MRRIRAAVVYQKGGPFQIEDLRLEAPRTDEVLVRIVATGMCHTDMVARDQLYDVPLPVVLGHEGSGIVEQIGDGVRKVAVGNHVVLTYMWCGHCKPCLRGDLTYCEHFYALNFGGVREDGSTSTCLANDTRRPIHDHFFGQSSFGTFALVHERNVIKVPETAPLELLGPLGCGIQTGAGAVINTLKVSPGSSFVAFGGGAVGLSAVMAAHAAGATTIISVDVVPSRLALAMELGATHTINSRETDPVEAVHKIINGGADFTLESSGRPAVLRQAIDALAIRGTCGIVGAPALGTEASFDVNGVMTTGKRIIGIVEGDSKPDLFIPALVELYQQGKFPFDRLVKFYSLDQINQAAEDSEKGITIKPIIRLQS

SEQ ID NO: 74190 - protein, 2241 aa, Magnaporthe grisea 70-15
MAARVFPPASARIVDSASDNKLICLELEDGSAYQGYSFGAPKSIAGELVFQTGMVGYPESVTDPSYRGQILVITFPLVGNYGVPSRETMDELLGDLPAHFESSQIHIAGLVAASYSGEDYSHYLATSSLGTWLKEQGIPAMYGVDTRGLTKHIRNHGSMLGRMLLQRASATESGNELFVTKFATPDWSQYFETVDWVNPNKKNLVAEVSIKAPKLYKPPQNVALKHPSGRPIRILCLDVGMKYNQLRCFLKRGVEVLVCPWDYDVSKGAGTEYDGLFLSNGPGDPSVVQDTVKRISAAVAANKTPIFGICLGHQLLARASGATTIKMKFGNRGHNIPCTSMVTGKCHITSQNHGFAVDAATLPTGWKELFVNANDGSNEGIMHVDQPHFSVQFHPESTPGPRDTEFLFDVFINTVVKCAADSSLLQKPVSFPGGTLEENERLHPRVHVKKVLVLGSGGLSIGQAGEFDYSGSQAIKALKEEGIYTVLINPNIATIQTSKGLADKVYFLPVNADFVRKVIKYERPDAIYVTFGGQTALSVGIQLKDEFEELGVKVLGTPIETIITTEDRELFARSMESIGEKCAKSASASSVDECMRVVKDIGFPVIVRAAYALGGLGSGFANNEAELLDLCNKALAASPQVLIERSMKGWKEIEYEVVRDAQDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLGIPLKEIKNSVTKVTCACFEPSLDYVVVKMPRWDLKKFTRVSTLLGSSMKSIGEVMSIGRSFEEAIQKAIRAIDFHNLGFNETKALMSIDDELQTPSDQRLFAIANAMASGYTVDKIWEMTKIDKWFLNKLKGLSDFAKTMSGFSKDNISGRPDLLLEAKRLGFSDRQLAKFWSSNELAVRSLRLEAGITPFVKQIDTVAAEFPAFTNYLYLTYNATEHDIALDDHGVMVLGSGVYRIGSSVEFDWCSVRAIRTLRQQGYKTIMVNYNPETVSTDYDEADKLYFENINLETVLDIYEMEAANGILGAMGGQTPNNIALPLHRYGAKILGTSPEMIDTAENRFKFSRMLDRIGVDQPTWKELTSFEEAKKFCQAVSYPVLVRPSYVLSGAAMNTVYSEADLESYLKQAAEVSREHPVVITKYIENAKEIEMDAVAKDGKVVGHFVSEHVENAGVHSGDATLILPPQDLEKTTIERIEEATRKIAGALNVTGPFNIQFIAKDNDIKVIECNVRASRSFPFVSKVMGVDLIEMATKAIMSVPFEAYPEEERTSSAVACKVPQFSFSRLSGADPVLGVEMASTGEVACFGRDKYEAYLKALLSTGFKIPKNNILLSIGSYKDKKEMLPSVANLQRLGYKLFATAGTADFLQEHGIPVQYLEALGSEDDGQKSEFSLTQHLSNNMIDLYINLPSSNKYRRPANYMSKGYQTRRMAVDYQIPLVTNVKNAKILVEAIARHFELEVGLRDYQTSHRTMILPSLINIAAFVPGIVSLGSKDLSTVTRASVAAGFSMIRVMPVGVDGAITDAKSLKVAQQNAKSDTYCDFNLSVSATSSNSDQISQVMAEVGSLFIPFNHLSDNISKVAAVTAHFDSWPAHKPIITDARTTDLASILLLASLHNRRIHVTCVTSKDDIRLIELSKQKGLKVTCDVSVYCLYLSQKDYPDCQQLLPTYEDQQALWEHMSTIDVFSIGSLPYQLAHTLSHDTDAAVGIADVLPLLLTSVSEGKLTMDDIKSRLHDNPMEIFELHEQVGTSVEVELNRSYTLPKSTNWSPFAGRQVRGSVQRVTFEGKVVCLDGQALPVLAMGKDMSTHNALPSLPMSPPLKAAQQIPESPVIRRQSMLSSGPRPLLRPRYIDSAMSALSPTVNKSAVDTEIPSQSIPPAVSTSSLGELLSAPSRFKNQHVLSVHEYKRSDLHHLFTVAQEMRLGVQRDGVLDVLRGRVLCTLFYEPSTRTSASFDAAMQRLGGRTIAIATSHSSVQKGETLQDTLRTVGQYGDAVVLRHPQEQSVDIAQKFSQVPVINGGNGSKEHPTQAFLDLFTIREELGTVQGLTITFVGDLLYGRTVHSLANLLRHYEVRIQLVSPKSLSLPAYVRNQLVERGQLLCESETLTQEIVARSDVLYCTRVQKERFPSAEAYEAVKGAYRIDNAMLRQAKANMIVMHPLPRNDEIAEEIDFDQRAAYFRQMRYGLYCRMALLALVMS

SEQ ID NO: 74191 - protein, 672 aa, Neisseria meningitidis Z2491
MNKSLSGSVEEYRELTLRGMILGALITVIFTASNVYLGLKVGLTFASSIPAAVISMAVLKFFKGSNILENNMVQTQASAAGTLSTIIFVLPGLLMAGYWSGFPFWQTTLLCIAGGILGVIFTIPLRYAMVVKSDLPYPEGVAAAEILKVGGHEEGDNRQGGSGIKELAAGGALAGLMSFCAGGLRVIADSASYWFKSGTAIFQLPMGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPAAERAEQDLSPKAMIFWVLAMMFVLGVSFYHFIGDSHITGGMAWLLVVVCTLLASVIGFLVAAACGYMAGLVGSSSSPISGVGIVSVVVISLVLLLVGESGGLLADEANRKFLLALTLFCGSAVICVASISNDNLQDLKTGYLLKATPWRQQVALIIGCIVGALVISPVLELLYEAYGFTGAMPREGMDAAQALAAPQATLMTTIASGIFAHNLEWVYIFTGIAIGAVLIVVDLVLKKSSGGKLALPVLAVGMGIYLPPSVNMPIVAGAVLAAVLKHIIGKKAENREGRLKNAERIGTLFSAGLIVGESLIGVIMAFIIAFSVTNGGSDAPLALNLQNWDAAASWLGLAFFVTGMFFFAQRVLKAGK

SEQ ID NO: 74192 - protein, 102 aa, Glycine max
AVKISNWGKVVWAYKPVWALGTGKGATPAQGQEVHADLRKWVHANVRAEVPASVKIIYGGSVNGGNCKKLAAQPDVDGFLGGGASPKGGFVGLITPATVKKN

SEQ ID NO: 74193 - protein, 516 aa, Zea mays
MATKRGNARGVPVGVLLVAALLLCSLAPASASSYPARVVSGFLSNAASAVVKRLWSLKSTTKIAASGGKSMVKYEGGYTVETVFDGSKLGIEPYSVEVTQGGELLVMDSMNSNIYRMALPLSRYSRPKLVAGSPEGFPGHVDGKLREARMNHPKGFTVDDRGNIYVADAMNMAIRKISDTGVTTIAGGKSGRGGHVDGPSDEAKFSTDFEVRYIGSSCSLLVIDRGNQAIREIQLHFDDCVYQYEAGFPLGVALLLAAAFFGYMLALLQRRVLGMYSNGDEQEDESPVKAKLSSIPPPYQKPLKSSLRPPLIPNDDEPVKQEEEGLFTSIGKLVGVARSSVAEIVGATFSRKKRVNVHHHQLGRPTSWPVQESYAIPRDETPPPLDTRAPTPRKSYAFMSKEPEKIHHIRHGRPQSHGWTGEAAAAPQQQAASLPPQQQQQQQQVHHQQYHNRQYSAGPQTFYEPSCDAAKEIVFGAVQEGDTGRRRPVEIKPVNHGDVAPFELNGLRFRSSYGMG

SEQ ID NO: 74194 - protein, 398 aa, Fulvimarina pelagi HTCC2506
MSIPKVAAIIVASGRGVRAGEHPEGAKQFRRIGGRPILAWTLERLLRHPKVGSVVLVANPDDAERTAATIAPFDDLGEVRVVDGGATRQASVRNGLLALSEYPVDTVLIHDAVRPFLSADLIDRVAAATGPDVGALPVVPVADTLKKGEDGHVIATVDRSGLYAAQTPQGFPYRAIMDAHEKAANRADVEFTDDASIAEWAGLAVAMVEGEPDNVKLTSARDLELADRRLKGESRMIDVRTGNGYDVHKLVDGDHVILCGVRIPHDQTLSGHSDADVGFHALTDALLATCGAGDIGDHFPPSDPQWKGAASHIFLTAARDIVAKKGGRIMNADISLICEAPKIAPHRGTMRKAIADCLAIDMERVSVKATTNETIGFVGRKEGIAAIATASVVYGETL

SEQ ID NO: 74195 - protein, 571 aa, Schizosaccharomyces pombe 972h-
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 74196 - protein, 263 aa, Neisseria meningitidis Z2491
MNVYFLGGGNMAAAVAGGLVKQGGYRIHIANRGAEKRERLGKELGVETSATLPELHSDDVLILAVKPQDMEAACKNIRTNGALVLSVAAGLSVDTLSRYLGGTRRIVRVMPNTPGKIGLGVSGMFAEAEVSETDRRIADRIMKSVGLTVWLEDEAQMHSITGISGSGPAYVFYLLDALQNAAIRQGFDMAEARALSLATFKGAVALAEQTGEDFEKLQKNVTSKGGTTHEAVEAFRRHRVAEAISEGVCACVRRSQEMERQYQ

SEQ ID NO: 74197 - protein, 432 aa, Vibrio fischeri ES114
MSKIVKVLGREIIDSRGNPTVEAEVHLESGFVGMAAAPSGASTGSREALELRDGDKARFLGKGVLKAVAAVNGPIAEALVGKDAKNQAEIDQIMIDLDGTDNKANFGANAILAVSLANAKAAAAAKSMPLYAHIAELNGTPGVFSMPLPMMNIINGGEHADNNVDIQEFMIQPVGAKTLKEGLRIGAEVFHNLAKVLKSKGYSTAVGDEGGFAPNLKSNAEALEVIAEAVAAAGYELGKDVTLAMDCAASEFFDKEAGIYNMKGEGKTFTSEEFNHYLAELANQFPIVSIEDGLDESDWTGFKHQTELLGDKLQLVGDDLFVTNTKILAEGIEKGVANSILIKFNQIGSLTETLAAIKMAKDAGYTAVISHRSGETEDATIADLAVGTAAGQIKTGSMSRSDRVAKYNQLIRIEEALGEKAPFNGLKEVKGQ

SEQ ID NO: 74198 - protein, 494 aa, Vitis vinifera
  misc_feature (62)..(62): Xaa can be any naturally occurring amino acid
MEASTLSRIGLAGLAVMGQNLALNIAEKGFPISVYNRTTSKVDETLDRAHREGHLPLSGHYXPRDFVLSIQRPRSIVILVKAGAPVDQTIAALSEHMEAGDCIIDGGNEWYENTERRIVEASGKGILYLGMGVSGGEEGARHGPSLMPGGSYQAYQNIEDIVKKVAAQVDDGPCVTYIGEGGSGNFVKMVHNGIEYGDMQLISEAYDVLKNVGGLSNSELSDIFGEWNRGELESFLIEITADIFKVKDEHGDGELVDKILDKTGMKGTGKWTVQQAAELSVAAPTIAASLDCRYLSGLKEEREAAAGVLSEAGLKDEVGFARSGVDKKRLIDDVRQALYASKICSYAQGMNLLRAKSVEKGWNLNFGELARIWKGGCIIRAVFLDRIKKAYQRNPNLASLIVDPEFAREMVQRQAAWRRVVGLAISAGISTPGMCASLAYFDTYRRARLPANLVQAQRDLFGAHTYERIDRPGSFHTEWTKLARKSDAGFATLK

SEQ ID NO: 74199 - protein, 195 aa, Mycobacterium leprae TN
MSLLSIGQQFPAYQLTALIGGDLSKVDAQQPGDYFTTVSSDSHPGKWRVVFFWPKDFTFICPTEIAAFGKLNEEFEGRGAQILGVSIDSEFVHFQWRAQHEDLKRLPFPMLSDIKRELSAASGALNADGVADRVTFIVDPDNDIQFVSVTAGSVGRNVEEVLRVLDALQSDQLCACNWRKGDPTLNATELLKTSA

SEQ ID NO: 74200 - protein, 752 aa, Triticum aestivum
MTVTPQITVSDGRLEVRGRTVLSGVPDNITAAHAAGAGLVDGAFVGATAGEAKSHHVFTFGTLRDCRFMCLFRFKLWWMTQRMGTSGRDVPLETQFILIEVPAAAGNDDGDSEPVYLVMLPLLEGQFRTVLQGNDQDQLHICIESGDKAVQTEQGMNSLYIHAGTNPFDTITQAVKAVEKHMQTFHHREKKKLPSFVDWFGWCTWDAFYTDVTADGVKQGLRSLAEGGVPPRFLIIDDGWQQIGSENKEDPGVAVQEGAQFASRLTGIKENTKFQSEHDQDDTPGLKRLVEETKKGHGVKSVYVWHAMAGYWGGVKPSAAGMEHYESALAYPVQSPGVTGNQPDIVMDSLSVLGLGLVHPRKVYNFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLKKLVLPDGSVLRAQLPGRPTRDCLFSDPARDGASLLKIWNMNKCAGVVGVFNCQGAGWCRIVKKTRIHDEAPGTLTGSVRAEDVEGIAQAAGTDDCTGDAVVYAYRAGELVRLPRGATLPVTLKRLEYELFHVCPIRTVAPDVSFAPIGLLHMFNAGGAVEECTVRPDEDDKAVVSLRVRGCGLFGAYCSRRPVKCSLDSGDVGFGYDADTGLVTVDVPVPEKEMYRWPLEIRV

SEQ ID NO: 74201 - protein, 323 aa, Vitis vinifera
MNGWNWLPYDKAKSGGNSDTSFGCTGTIDTLIEQNRGPRASKPKNRTTANESFVNNSKNGTCTGVHRESYNRLDFVTEYKDAKFFVIKSYSEDNVHKSIKYGVWVSTPNGNKRLNSAFHEAKEKHGNCPIFLLFSVNASAQFCGVAEMVGPVDYDKSVDYWKQDKWTGQFPVKWHIIKDVPNSQFRHIILENNDNKPVTNSRDTQEVELEQGNEMLNIFRNYESDSSILDDFDFYEDRQKAMQEKKTQHKASLLAAPMVVGSQQQIRRSLPTHLIHKMSKTFAQAVLLNENDKERSPAGKAVPGAARLRGSRVEPEKTRATMA

SEQ ID NO: 74202 - protein, 281 aa, Vitis vinifera
MKKRHLLEKPWFLRLALVGLIAGVLFIYHFVQNSDHSLLCSFAAESPRADSSATQIQLSAILHYATSRIVPQQTLAEITVSFDVLQSLASCNFLVFGLGFDSLMWSSFNARGDTLFLEEDPKWVQTVLKDAPTLRAHTVRYRTHLSEADDLLSTYRSVPECMPPKAYLRGNNRCKLALSDLPDEVYDKEWDLIMIDAPRGYFPEAPGRMAAIFSAAVMARARVRPGVTHVFLHDVDRRVEKVYAEELLCRKYQVGSVGRLWHFEIPPAANLSRASDSTGFC

SEQ ID NO: 74203 - protein, 275 aa, Chlamydomonas reinhardtii
MTIPDEEVLTKLRELLKHADLNVTTEKMLRKQLEEHFKQDMTDRKPIIRAEVERYLAEGAGDEEEEEEEEEDDDDAPARGSGMGSWLSEPLQAFLGVESLPRTQVVKRLWEYIKANNLQDPKDKRKILLDDKLKTLFTSPLTMFTMNSQLSKHVKVYDGDDEEPKAKSAKRPASKAGKEKPKKVKTEMDEEKRKKNAFTKPVRLSPELAALTGKESMGRPEVTSFFWAYVKEKGLKDPANGQFIICDAALKKITGEERFKGFGFMKYFAPHMLKD

SEQ ID NO: 74204 - protein, 288 aa, Pseudomonas fluorescens Pf-5
MYDSIFKAQLFAGQTIIVTGGGSGIGRCTAHELAALGAQVLLVGRKAEKLQKVAGEIAEDGGKADWQACDIRDEEAVKALVARLMERFGPIHGLVNNAGGQYPAPLASINQKGFETVLRTNLVGGFLMAREVFNQSMSRHGGSIVNMLADMWGGMPGMGHSGAARSGMDNFTKTAAYEWGHAGVRVNAVAPGWIASSGMDTYEGAFKAVIPTLREHVPLKRIGSESEVSAAIVFLLSPGAAFISGSTLRIDGAASLGSRAWPLGKARNSESYNGFHRAYLPDVLKGKE

SEQ ID NO: 74205 - protein, 538 aa, Pseudomonas fluorescens Pf-5
MPVIQSQLDPHGPQFAQNRAAMLAGLQQLQELQQNLLAKAAEAKAKFDRRGQLLPRERLNLLLDPGAPFLELASLAGYKLHDDKDGTQAGGGLIAGIGYVCGVRMLVVANNCAIKGGTISPSGLKKSLRLQQIAMENKLPVVTLAQSGGANLNYAAEIFVEGARSFANQARMSAMGLPQITVVHGSATAGGAYQPGLSDYVVVVRGEAKLFLAGPPLLKAATGEVATDEELGGAEMHAQVAGTAEYLAENDADGIRIVREIVSLLPWNTRLPVQPARTWNEPLYPIDELLGLIPDDPKKPYDAREIIARLADGSQFLEFKGEFDAQTLCGHLQIQGRPCGFIGNNGPITPQGASKAAQFIQLCDQSQTPLLFFHNTTGFMVGTESEQQGVIKHGAKMIQAVANARVPKLTIVVGGSYGAGNYAMCGRGLDPRFIFAWPNSRTAVMGGAQAGKVLRIVTEAKHAKNGQEADPKMLDMLEQVTAQKLDSQSTALYGSANLWDDGLIDPRDTRTLLGYLLDICHEAQVRELAPNSFGVARF

SEQ ID NO: 74206 - protein, 374 aa, Debaryomyces hansenii CBS767
MSSIIRRTFSTSTAALKSLKIGLIAGDGIGREVMPAGQAVLENLPSKHDLQFEFVNLDAGFEYFQKNGTALPQETVDILQKECDGALFGAVSSPTTKVEGYSSPIVALRKKMGLYANVRPVKSVEGNARSVDMVIVRENTEDLYIKEEKSYTKEDGTRVAEAIKRITETATSRIAKMAYDIALQRQAIRKANPGLKSLHEKPSVTVTHKSNVLSQSDGLFREVCRQVYDENADKYKDIAHKEQIVDSMVYRMFREPEIFDVVVAPNLYGDILSDGAAALVGSLGVVPSANVGDNFAIGEPCHGSAPDIQGKGISNPIATIRSTALMLEFMGYPEPAADIYAAVDANLTEDKIKTPDLGGSSSTQEVIDDIIRRF

SEQ ID NO: 74207 - protein, 331 aa, Zea mays
MLTHPNGVVRPSTKEPLFSFGVIADVQYADIPDGRSFLGVPRYYRHSIAVLRRAVERWNGERSVRFCINFGDIVDGFCPKDRSLAAVQAVVREFDGFRGGPTYHMLGNHCLYNLPRSELVSVLRMPSASPGRAYYDFSPWPGYRFVVLDAYDFSAVGWPRGHPVSAAARRFLEKRNPNHDKNSPSGLEGTDRRFVMFNGGVGEAQLRWLDGVLRRAERRGEKAVVCSHLPMHPGAASPTGLMWNYEEVMDVVRRHGGCVVACLAGHVHKGGYAVDDSGVHHRTLEAALECPPGTDAFGHVEVHPDRLRLVGSDRMASTEMLLSPSNELASA

SEQ ID NO: 74208 - protein, 145 aa, Oryza sativa Japonica Group
MAAARRALLSHLRVPVLARPAAAAGSVPAARLLSSATEEGSKGSFLDKGEVADRIVSVVKNFQKVEPSKSSVADPPWGLWGLETLLPVTPNAHFQKDLGLDSLDTVEIVMAFEEEFGFEIPDNEAEKIDSIKTAVDFVASHPQAK

SEQ ID NO: 74209 - protein, 341 aa, Oryza sativa Japonica Group
MGHVDASAAAAAARDAKKKRGNRSSAKLKQCKLDARREQWLSQDCSNSDPPAFWIGIVKDGKEAKASTSPTGTEPNAGSMTVPSPHPPLPRRRLDVRSKGGDPEEDREERGAARQELGSSYLDSPVHSPSSDNSGSVGGMHRKHYNNGGGLNLSSSSSVWSSSRSVSEAEDDDTGGPEEENGVLDDWEAVADADALTVDDCHSHQSSGHVAPPAAPNVCTAPANQTGRQDPIQRTKAWAPDDIFRPQSLPSISRQVSFPASIGNGWMGAAQQANLSTPLTCPICCEDLDLTDSSFCPCPCKFCLCLFCHNKILEADGRCPGCRKEYVAARLSRSCSMGPRY

SEQ ID NO: 74210 - protein, 135 aa, Physcomitrella patens subsp. patens
MAVGYVYPAYECYKIVERPMPDLEHLRFWCQYWMIIAVVTVIERLADIVVSWVPMYSEAKLAFIIYLWYPKTMGTTYVYSTLLRPFVVQYESEIDHNLNEVRTRAGDIALLWWQKGSMYAQARFYELLQFLASQS

SEQ ID NO: 74211 - protein, 228 aa, Neisseria meningitidis Z2491
MTVLQERYCEVSDRIGKLVLQAGRKPHSVSLIAVGKTFPSDGIREVYAAGQRDFGENYIQEWYDKTEELADLTDIVWHVIGDVQSNKTKFVAERAHWVHTICRLKTAVRLSRQRPSSMPPLQVCIEVNIAGEAVKHGVAPEEAVALAVEVAKLPNIVVRGLMCVAKANSSETELKVQFQTMRKLLADLNTAGVKADVLSMGMSDDMPAAIECGATHVRIGSAIFGKRG

SEQ ID NO: 74212 - protein, 69 aa, Zea mays
  misc_feature (30)..(30): Xaa can be any naturally occurring amino acid
  misc_feature (33)..(33): Xaa can be any naturally occurring amino acid
  misc_feature (42)..(42): Xaa can be any naturally occurring amino acid
RVWMDLLETVRTIKNLRSYSVRIRALEVEXCLXKVGEDALTXKMTTAIAELTTDIGNKVLHGPMQHLRC

SEQ ID NO: 74213 - protein, 406 aa, Streptococcus suis 89/1591
GAFGRGMVPSGASTGEHEAVELRDGDKSRYLGLGTQKAVDNVNNVIADAIIGFDVRDQQAIDRAMIALDGTPNKGKLGANAILGVSIAVARAAADYLEVPLYTYLGGFNTKVLPTPMMNIINGGSHSDAPIAFQEFMILPVGAPSFKEGLRWGAEVFHALKKILKARGLVTAVGDEGGFAPKFEGTEDGVETIIEAIEAAGYEAGENGIMIGFDCASSEFYDKERKVYDYTKFEGEGAAVRTSAEQIDYLEELVNKYPIITIEDGMDENDWDGWKALTERLGKRVQLVGDDFFVTNTDYLARGIKEGAANSILIKVNQIGTLTETFEAIEMAKEAGYTAVVSHRSGETEDSTIADIAVATNAGQIKTGSLSRTDRIAKYNQLLRIEDQLGEVAVYKGLNSFYNLKK

SEQ ID NO: 74214 - protein, 735 aa, Yarrowia lipolytica
MSFRQQFQQGGNPNGQMGFNNMNMSPNMNNAKIGGMDMGAQMGQMGQMGQMPQMAQMGQMGQMGGMPQMGGPMGGQMNGMNMGGMSGAGGMPNVGGMPNMAGMPNMGQGMNMGQGMNPQVGRGGPMGPQGMMGQQGMGGMQQGGQVQMGGGPQMQPPQRQPQPQQQQQQQQQQQQHHHQQQQQQVPMPQSQLIPQQGGIPVMAGGQPQKNFDFPPPGQTMMQPGLTVPPVQSHLGLVSSDDARQQETPLVNPPSAAESLAEMPTLFNGQGITDLTEIMKNKRDPKTAQELNLRRFVSKDLNESSTLPKKLKQEADKLNAKRYEISFYHSFGPIRSQEPQSIFQDGYLGYGNGWTGLNTRFVYPRDRKKHNRNTRDLVLSRQQMNQQAAEPELLVPIRLDFDLGRLRLRDTFMWNLNEKTYPVHFFVENMFEDFHFPHQYIQSVTNSITEQLQDFQPHQYPQDPRHVIGNGDATRNEDMRVVVRLDITVGQHNLIDQFEWDINDSLNSPEEFAATMCAELSLSGEFATAIAHAIHEQTQVFSKSLLLLGHTFDQRPVDDEDIRREICAPIPDGSVMRPKNSVNEYSPALFEISEAELSRLDKDKDRDSRQKRRQGRAGRRGAPSLPDFKKVVRTFRTPVYSAVLPGAVDRKVELAKQALQAEEEEEEEDSDGNVVVRPAKRQRTTGRHVPVRAAAANAAVAVAAQSQELETNYVEELADPTSFWVTLKCPHSSLRG

SEQ ID NO: 74215 - protein, 576 aa, Gossypium hirsutum
MITLTDFYHVMTAMVPLYVAMILAYGSVKWRKIFSPGQCSGINRFVALFAVPLLSFHFIASNDPYAMNFRFIAADTLQKVMVLGILAVWSKVSKRGCLEWTITLFSLSTLPNTLVMGTPLLKGMYGEFSGSLMVQIVVLQCIIWYTLMLFMFEYKGAKMLISEQFPDTAGSIVSIHVDSDIMSLDGRQPLETEAEIKEDGKLHVTVRKSNASRSDIFSRRSQGLSSTTPRPSNLTNAEIYSLQSSRNPTPRGSSFNHTDFYSMMAGGRNSNFGAADVYGLSASRGPTPRPSNYEDDGTGMGKPRFHYHAQGGAGAAHYPAPNPGMFSPNGSKANTKKPNDQAPQKAEDGGRDLHMFVWSSSASPVSDVFGGGGGHEYGANEQKEVRVAVSPGKAEGHRRNNEEYMEREDFSFGNRGLEREMTNNHEGDKVGDGKPKTMPPASVITRLIIIMVWRKLIRNPNTYSSLRGLTWSLISFGLFMALQPRIIACGNSVAAFAMGVRFLAGPAVMAAASIAVGLRGVLLHVAIVQAALPQGIVPFVFAKEYNLHPDILSTAVIFGMLIALPITLVYYIVLGL

SEQ ID NO: 74216 - protein, 112 aa, Zea mays
PRGRGDASQEVHGIWVYNQQDCEAVASVFGSQLQWILNAYAKVPPKPKVPSTKSEFEELEAVPTSAAIDGPLEPPPASAAVVLDTPDESLISYFSVCSTVNYQLFHPILLSF

SEQ ID NO: 74217 - protein, 136 aa, Triticum aestivum
SSAYSLGLWDLQHFMVLLRPDPARTRTQVQEPEPSLVFDFQPRHPEDALAAFSVLSRSKIPGVVRRRTLRRIPDRRSWFVGLSDGGAADAAERFSERWPTDLVVGNHDCRDYTNGLVEVLTGQKRVLDALRSAGRQ

SEQ ID NO: 74218 - protein, 591 aa, Zea mays
KNRQVFAAMASKAMPQILPETPGIPGTKQCSKSAPPFELPQTNNSCASALTVLPGTTTDLSKSSHKPELNEQKPDHRLKEPVDAASVKFPVEPSKKAVAEHGSTNGGSTSFQTCGGTSQAQAKVSASAKAADPPEIGDRGNSGRCRPSTSSDISDESPCSSMSNSTKPHKANDSRWEAIQTVRTRDGVLGLSHFRLLKRLGCGDIGSVYLSELNGTKSYFAMKVMDKASLASRKKLLRAQTEKEILQCLDHPFLPTLYTHFETDKFSCLVMEFCPGGDLHALRQRQPGKHFPEQAVKFYIAEVLLALEYLHMLGIIYRDLKPENVLVREDGHIMLSDFDLSLRCAVSPTLIRSSNPDAEALRKNSHGYCAQPACVEPSCVVQPSCAAPTTCFGPRLFSSKSKKERKPRPEAATPVNPWPELIAEPSDARSMSFVGTHEYLAPEIIKGEGHGSAVDWWTFGVFLYELLFGKTPFKGSSNRATLFNVIGQQLRFPEYPAVSFSARDLIRGLLVKEPQQRLAYKRGATEIKQHPFFEGVNWALIRCASPPEVPKPVEIERPSNHPSSPSGAAADDASVGAPQKGVDGYLEFGFF

SEQ ID NO: 74219 - protein, 253 aa, Rhodospirillum rubrum ATCC 11170
MAASLFDLAGKTALVTGSSRGLGFEMALALARAGAWVAVHGRGGADLERAVAAIRAAGGAAEAVAFDLGEPEAGAAALEELTESWGGIDILVNNAGARDRRPLDDLDLAAVRQLLEIDLLAPFALSRRAAQAMPAGGRIINITSIAGQVARAGDAAYTTAKGGLDALTRALAAELGPRGITVNAIAPGYFATSANAAMVADAENERHLERRTALGRWGQPAEIAGAVVFLASPAASYVTGQVLAVDGGYLAHF

SEQ ID NO: 74220 - protein, 220 aa, Arabidopsis thaliana
MEPRINDLQVESRVHELLDFPVHTNQISSAIYEILLQCPNDHIENPKKKPYNCPHSGAKCDVTGDIQRLLLHLRNDHNVEMSDGRSFSHRYVHHDPKHLHHATWMLTLLDCCGRKFCLYFEAFHLRKTPMYMAFMQFMGDEEEAMSFSYSLQVGGNGRKLTWQGVPRSIRDSHKTVRDSQDGLIITRKLALFFSTDNNTTDKELKLKVSGRVWREQPVSI

SEQ ID NO: 74221 - protein, 722 aa, Glycine max
MDELNGAMTTENSNAEVVRWERFLPRMVLRVLLVEADHSTRQIIAALLRKCSYTVIAVPDGLKAWETLKKKAPELDLILTEVELPAISGFALLSLIMEHDICKNIPVIMMSSHDSVSMALKCMLKGAVDFLIKPIRKNELRNLWQHVWRRHAISTPTQNTTFSPKKLKTASEDNSASNKSSGSVASSKKNNECSERLSEAQSTCTSPIFEAESTYVENMQDVPQYVHCQVMQTLVQSTCTSPIFEAKSTYVENMQDVPPLKSSKLNKIDMVKHEKFAQFERESAEHNDETEDKSVTIVSDAARCDKTSELTELRPEQDCGVAEPETENEDEILKSELDGDNSHVSMMQGCSAERVKPSKGAIDLIATVGNLPKHLDENCSLNGGNTTKFDCETQLELSLRSDFPGSSGNQASEATEESQRLNHSNTSAFSWYSNSKLLQPHFSTPSITFPEVNNLSWDSHESHKLSGITSGNCQYGGSNQNLENMIGTVICQYGQVTPKLSNSQCGLLPVSGVISNLKSEGHGNVFTSLFYAQSGIHPMSSPKPVCQNESSPFPTSTSTQSYPESHNSDQLHDCSNDATCLNQNVKDNTDSDHARHDSPVADQSAGNSLCHDAANHVNSSAYGSMDSGNDGNATSAIVSKNAPDGFSDSGCHNYDGFRVTDPHRSSQREAVLVKFRLKRKERCFEKKVRYQSRKRLAEQRPRVKGQFVRQHDHPVAEAGGDS

SEQ ID NO: 74222 - protein, 264 aa, Rickettsiella grylli
MNFLLNEVISLAKKVGNLVLTLYQSDFSAEYKKDHSPITVADLASHECICQELKRLTPDIPIISEESGSISYQKNQVWDKYWLVDPLDGTKEFLEKNDEFTINIALIEQNKPSLGVIFVPCKNICYFAHKRLGAYKQVGQTQPQVIRSRILNAKEPITAVVSRRHGRERIKKFLTQFARLNLLSCGSALKFCWLAEGLADVYPRFSPTFAWDIAAGHCILTEAGGFIIDDIGKELEYNPFVLQRSGFLAVADKQYAWLNYLKPY

SEQ ID NO: 74223 - protein, 173 aa, Triticum aestivum
  misc_feature (34)..(34): Xaa can be any naturally occurring amino acid
FYKAQGYAVGKSLVEEDKLELATSLIEKAKAKGXSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 74224 - protein, 483 aa, Mycobacterium leprae TN
MSAPESKTAIAQIGVTGLAVMGSNIARNFARHGYTVALHNRSIAKTDTLLKEHGSEGNFVRTETIPEFLAALQTPRRVLIMVKAGDATDAVINELADVMEPSDIIIDGGNSLFTDTIRREKAMRERGLHFVGAGISGGEEGALNGPSIMPGGPAESYTSLGPLLEEISAHVDGVSCCTHIGPGGSGHFVKMVHNGIEYSDMQLIGEAYQLLRDGLGMSAPQIADVFTEWNRGDLNSYLVEITAEVLRQTDIKTGRPLVDVILDKAEQKGTGRWTVQSALDLGVPITGIAEAVFARALSGSVLQRKAAIGLASGKLGNKPTDRETFIEDVRQALYASKIVAYAQGFNHIQTGSTEFGWNITPGDLATIWRGGCIIRAKFLNRIKEAFDAAPDLASLIVAPYFRSAVESAIDSWRRVVSTATQLGIPNPGFSSALSYYDALRTERLPAALTQAQRDFFGAHSYGRVDARGKFHTLWSEDRSEVTV

SEQ ID NO: 74225 - protein, 267 aa, Pseudomonas fluorescens Pf-5
MRLSALYRYPLKSARGETLQQIGLDKLGLQGDRRWMLVDEASGRFLTQRAVARMSQLSALWNDQGGLTLSAPGHSTLEVALPGADAPLRGVTIWQDTLRVPDAGDEAAAWVSEFIGKPSRLVQVPAQRARSTAAGYGRDDDQVAFADGFPLLLIGQASLDDLVARVGRPLEMLRFRPNLVVEGSAAFAEDDWKRVRIGDVEFRVVKPCSRCILTTIDPQTGERSADREPLATLQKYRAQADGAMFGQNLVNDGNGRLQVGMAVTVIE

SEQ ID NO: 74226 - protein, 223 aa, Arabidopsis thaliana
  misc_feature (198)..(198): Xaa can be any naturally occurring amino acid
MVLLSEIPGGSNGDDPNMNPQELPEELIESIVAPIPRCYYPSLSLLSRAFRHVITSQQLFVTRSGLGFKEPVLYAFIGCTPYTTPRWFILRRSNIPLQLRRLNSLPHMFPGAAVVTIGYKIYVMGGYNYQPVSTVIIIDCRFHTWHYLQDMQRARYHATPGVIDGRIYVIGGRKKQDADWVEVFDVTTESWETVPTQXGRILGVFLLTNQDKVYGSHWELYVS

SEQ ID NO: 74227 - protein, 263 aa, marine gamma proteobacterium HTCC2143
MASSIIGGLVTEGFSAEQIIASDPYPASLERLRDIAKVETTDDNQHAIANADVVVLAVKPQVMKPILEDLANSAQLHKPLVISIAAGIKVKSLDQWLGGGMPIVRCMPNTPALVQTGATALYANPVVSEHQKRLADQILGAVGIALWVSEEQALDAVTAVSGSGPAYFFLVMEAMQAAGESMGLSAETAKQLTLQTALGAAKMAMSSDVDTAELRRRVTSPGGTTAEALKVLENRNLKDIFLQALEAGRNRSEELAEILGDGK

SEQ ID NO: 74228 - protein, 1007 aa, Oryza sativa
MVIARGLLRSNASSSSSQAINLLKYVTSTGSLQGHTQNLCDASTRHFSSVPSPQYNSTEENGFKGHGMLAPFTAGWQSTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELRRLNVDIEATTSLELEWRLQTSPQLLRFKGHGMLAPFTAGWQRTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETVQSSFHRNLYCAKRSKIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 74229 - protein, 192 aa, Chlorobium limicola
PPSNVPKTTDALDAVGNTTKAVTKGYAIGSAGLGALVLFADYTEDLRYFIERPATSPDQYQNSKNVTADFPLSNPKACGRLVVRRTVALPVRGDGHDGGRPLVKLHPQVGLLFNSPRSTDIMNGTQKLYPGLLGSHSDQITPISILCINFFSLHVSTPLSHLLLLSLSFKCATISLPLPPPLEPTPLSPLLF

SEQ ID NO: 74230 - protein, 485 aa, Oryza sativa
  misc_feature (215)..(215): Xaa can be any naturally occurring amino acid
  misc_feature (227)..(227): Xaa can be any naturally occurring amino acid
MARFILSLLELGVSATVHLLFGLYVFSTAVAADISQAAAASGCLLLRRPAAPGLVNVAAAGEEEERRGAAPVVLDGSPPPIVLVHGIFGFGKGRLGGLSYFAGAEKKDDRVLVPDLGSLTSIHDRARELFYYLKGGQVDYGEEHSKVFGHTRFGRTYDTGHYPVWDEQNPVHFVGHSAGVQVVRVLHQMLADKAFPGHDTSEDWVLSLTSYVGVXHSWTPLATYYDXGMLAEDGRSMKSICLLQLCRIGVIVYDWLDIPWLKNYYNFGFDHFEMSWRKVGLSGLIDLLLGHTGPFASGDWILPDLTIQGSLTLNSTLRTFPNTFYFSYATKRTRKLFGITVPSSVLGIHPMLFLRVLQMCMWRHPQNAPLPYKGYRDEDWEDNDGALNTISMTHPRIPTEHPNRLVVDDSDCHPLQPGIWYYKIIEADHILFIVNRERAGVQFDLLGGKTHSHGTTWKSTNGGSVKPSSTSLRVTALPVWESFSH

SEQ ID NO: 74231 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 74232 - protein, 190 aa, Triticum aestivum
PGRPWQRGLAARGRPWGSVGWFRAEALPGGAGGPPRREPMAPPYNVLITGSTKGIGYALARKFLKAGDNVVICSRSAERVESVANDLKKEFGEQHVWGTVCDVREGKDVKALVDFARDKLEYIDIWINNAGSNAYSYKPLVETSDEALIEVITTNTLGLMLCCREAINMMWNQPRGGHIFNIDGAGSDGR

SEQ ID NO: 74233 - protein, 324 aa, Gluconobacter oxydans 621H
MTTRPHIAVIGAGAWGTALACATAATGADVTLWMRNPVPPRTRTLPRLPDITLPENVTITGDFPRTANVVLLVTPVQTARDVSTRLQTVLDPAVPVVTCCKGLEQATSLLPLDVLAETMPGRPTGVLSGPNFAIEVAKGLPAAATLACADLALAQKLTALLNTSSFRLYASDDAAGVQLAGAAKNVIAIGAGITIGAGLGENARAALITRAVAEIGRLAEATGGRASTLAGLAGMGDLILTCTGRGSRNYSVGLELGEGRPLADILASRTTVAEGVLTAPAMLALARKHNVRVPIIETVTRLLNDGVSIEEARHLLLDRPPTRE

SEQ ID NO: 74234 - protein, 293 aa, Chlamydomonas reinhardtii
MAAHPAAYAWIEEHLGSKVVKESLVSSSGWSSAYVVDTQDGKRYFVKTALGRDEAMFKGEALGLQAMYDTNTMRIPKVFHYGPLAGAGRGGSFIVMEHLDMARGRLAMRELGRRLALMHLAVPKEEHAAAGQFGFPVDNTIGGTPQANGWMSDWVVFLRDRRLMPQLKMAGDSRLMRMGEKLCSNLSSHFEGIEVKPSILHGDLWSGNIGAVGEEPTIFDPACYYGHHEAEFGMSWCAGFSPDFYAAYHELIPCAPGFEQRAEIYRLYHYLNHLNLFGDSYYSQCASILQRLT

SEQ ID NO: 74235 - protein, 425 aa, Anabaena variabilis
MSFSHLGLSNEIINAVTELGYTKPTPIQMQSIPAVLSGRDLLRGAQTGTGKTASFTLPLLHYYPKIVLKALQCFLTIRALILTPTRELAAQVESSVRDYGKYLKLNSMVMFGGVSINPQKQRLKGRVDILVATPGRLLDHVQQGTVNLSQIEILVLDEADRMLDMGFIRDIRRILSLLPKQRQNLLFFATFSDKIKELAAGLLNRPQMIEVARRNVTADTVTQKVYKIERDRKRDLLAHLIRKDNWYQVLVFTRTKYGADRLVKQLGHERIQALAIHGNKSQSARTHALAKFKNGSLQVLVATDIAARGLDISELPYVVNFDLPYVPEDYVHRIGRTGRAGASGEAVSLVSADEYHLLADIEKLIEKRLPFELVAGIGANSQAKPEPTQDERKQKPKDSQHQPRSAAQGVPKKSGKKRLTNSGKR

SEQ ID NO: 74236 - protein, 409 aa, Shewanella sp. ANA-3
MTYSNAAENASLRNKMPNCIKPMNIVVVGMGYVGLSNAVLLAQQNHVVAIDLMPERIALVNARKPTVADSLIEEYLQHKALNLSATSDKNVVKEADFVIIATPTDYDPQTNYFNTQSVERVAKEVLALNPDTTIVIKSTVPVGFTEGLRSKLNSDNILFSPEFLREGKALYDNLHPSRIIVGERSERAQAFADLLARAAIKQDIPILLTDSTEAEAIKLFANTFLAMRVAYFNELDTYAESRGLNTRQIIEGVCLDPRIGDYYNNPSFGYGGYCLPKDTKQLLANYNDVPNNLISAIVDSNTTRKDFIANAIISKQPKRVGIYRLIMKSDSDNFRASAVQGVMKRIKAKGIEVVVYEPVLKEGEFFNSKVIRDLHEFKAMCDVIISNRMANELEDVAAKVYTRDLFHHD

SEQ ID NO: 74237 - protein, 219 aa, Cenarchaeum symbiosum
MSHPQSRPGGRDGRPRRRREPREEAPWVPKTALGKRVNAGEITSLEEIQEAGARIQESGIIKKLLPDLKTEVVDVGIIQKMTSNGQSTRFKAIVAAGNENGYLGIGQGKAKQMRIAIEKANNQALLNVGPIKLGCGSWECRCDQKHSVPFKVRGKGGSVVIEILPAPRGLGLVAGGKIRRLLELAGLKDAYTTAKGSTPTTNSTSKAVLECLRQTFSQG

SEQ ID NO: 74238 - protein, 455 aa, Burkholderia sp. 383
MKNLQRHLSARHIRFLALGSAIGTGLFYGSASAIQLAGPAVILAYILGGAAVYMVMRALGEMAVRDPVAGSFGHYATENLGPFAGFVTGWTYTLEMVIVAIADITAFGIYMGFWFPDVPQWIWVLGVVAIICGLNLCHVKVFGELEFWLSIIKVGAIVAMIGGGVAILLTGMHFGHSADVPTFANLWNHGGFLPNGVGGLIASLSVVIFAYGGIEVIGMSAGEAKDPERVIPRAINAVPARILLFYVLTMVVLMSISPWTGVGNEGSPFVQIFSALGVKSAATILNLVVISAAISAINSDIFGAGRMMFGMARQGQAPRVLMTTSRHGVPWVTVVVMAAALLVGVLLNYLMPKDVFLMVAAIATFATVWVWLMILLSQVAMRRRLSSTEVAALKFKVPLWPVAPALTIAFMGFVIVMLGWFEDTRVALYVGAAWLALLALVFYARIRPKFAPASR

SEQ ID NO: 74239 - protein, 230 aa, marine gamma proteobacterium HTCC2143
MNLMQQLIALNIAKVRDRIRNAEEKYHRKPNTVALMAVSKTRSADEVRQAIAAGITDIGENYLQEALDKQLHLTDIDVYWHFIGPIQSNKTRAIAEHFDWVHSVDRLKIALRLNDQRPSGMPPLNVCLQVNTSDENSKAGVSLEQLASLAEQVDSLPHIQLRGLMSIPQASDQADEQQAAFAVLHHAFNKLQKTCNDLDTLSMGMSADMEAAIAEGSTVVRIGTDIFGPR

SEQ ID NO: 74240 - protein, 164 aa, Xylella fastidiosa Temecula1
MHLIAHLDTVRGPIKINLFADKTPLTVANFVNLAKRGFYDGLNFHRVIANFMIQGGCPEGSGHGGPGYHFEDETNNGMCHERGSLSMANAGPNTNGSQFFITHVATPWLDGKHTVFGKVLDGQDVVDAIAQGDIINKITIEGDTDGVLALKTDRIIEWNSILAT

SEQ ID NO: 74241 - protein, 324 aa, Triticum aestivum
MSDTGAGGDEVIHDAPGFIRVYKSGRVERFLRIDFAPPCTDAATGVSSKDLTILPGAGVSARIYLPPAPAGGQQGKLPVLVFFHGGAFCLGSAFDAAAYGHANQLAARAGAIVVSVEYRLAPEHPVPALYGDAWAALQWVAAHEGGQGAEPWLTNHADFGRVHVGGESAGANIAHHAAMRAGAEELGHGVKVSSLVLIHPYFLGGDSSESDEMGMALLDELVRLWPVVCPGTSGCDDPWINPMAEGAPSLAGLGCKRALVCVGGKDAMRGRGRLYREKLIGGGWQGEVEIWEADGQGHGFHLFRPTCAQAEAQVRVIAEFLGHR

SEQ ID NO: 74242 - protein, 485 aa, Pseudomonas fluorescens Pf-5
MSTLIPCIIAGGAGTRLWPVSREAMPKPFMRLPDGESLLQKTFVRATALKDVGRLLTVTNREVFFRTLDDYRLLNKARVELDFILEPFGRNTAPAIAAAALHVSRLYGDDAQLLVLPADHLIKDVQAFANAVDSARQLAEQGWLVTFGLVPTHAETGFGYIEKGQGLNKDSFQVSRFVEKPDAATAQRYVDGGLHLWNGGMFCMRADVILQELREFVPEVVSAVEHCLEQSHRKEGKHELQVELDGDSFAQAPDISIDYAVMERSKKVAVVPCQLGWSDIGSWQAVRELTPADEHGNQCNGETVLHDVSNCYIDSRKRLVGGVGLNNLIIIDTPDALLVADGNRSQDVKLIAQELKRLGHDAYKLHRTVTRPWGTYTVLEEGPRFKIKRIMVKPNASLSLQMHHHRSEHWIVVSGMALVTNGEDEFLLNTNESTFIKPGRTHRLVNPGVIDLVMIEVQSGEYLGEDDIVRFNDIYGRAPAEAAKT

SEQ ID NO: 74243 - protein, 126 aa, marine gamma proteobacterium HTCC2143
MEGNFENLKVMVIDDSKTIRRTAETLLKKVGCEVITATDGFDALAKIADTKPNIIFVDIMMPRLDGYQTCALIKNNSEFKQIPVIMLSSKDGLFDKAKGRIVGSDEYLTKPFSKNELIGAIEAHVG

SEQ ID NO: 74244 - protein, 468 aa, Mesorhizobium loti
MRLSNLGTEQLREKDRSFVFHPSTHLAKHSRGETPNRIMAGAEGVYIWDTEGRKSLDGFGGLYCVNMGYGCTEIAEAIARQAHEMPFAHIYASQGTEPVALLAEAVVEYFGQNMRRVFFGLSGSDANETNIKLVWYYNNILGRPEKKKIISRHRGYHGSGLVTGSLTGLAFFHNFFDLPLDLVRHTTTPHHYRQAHDGESEQAFSKRCADELEALIVAEGPETVAAFIGEPVLGTGGIVPPPKGYWTAIQSVLDKYDILLIADEVVCGFGRTGEKFGSHLYGMRPDFVTIAKGLSSAYLPISGSIIGDRVWSILEQGTEKHGALGHGWTYSGHTLCAAAALANIRLLKERNILEHVRDVGPYWHARMNAELAGHPIVGEVRGVGILSAVELMRDPKQRIPFESDLQVGVRAAAALFENGVIGRAMPHGDILGFAPPLIITRKEIDIIVNATAKSVETTYRALKAEGAI

SEQ ID NO: 74245 - protein, 310 aa, Saccharomyces cerevisiae
MLPEKRLLTPDDMKLWEESPTRAHFTKFIIDLAESVKGHENSQYKEPISESINSMMNLLSQIKDITQKHPVIKDADSSRFGKVEFRDFYDEVSRNSRKILRSEFPSLTDEQLEQLSIYLDESWGNKRRIDYGSGHELNFMCLLYGLYSYGIFNLSNDSTNLVLKVFIEYLKIMRILETKYWLEPAGSHGVWGLDDYHFLPFLFGAFQLTTHKHLKPISIHNNELVEMFAHRYLYFGCIAFINKVKSSASLRWHSPMLDDISGVKTWSKVAEGMIKMYKAEVLSKLPIMQHFYFSEFLPCPDGVSHHHHHH

SEQ ID NO: 74246 - protein, 477 aa, Mesorhizobium loti
MSEARSYELFINGKWRAGGSRVTLPVINPATEKVVASVASATVSDLDEALASAERSRKAWCSRPAKERGEILVAAARVLATQIEPAARDLSAEQGKTIAEATGEYARAVETLEWNGTHAEELSATIPLGPNRMIVPEPLGVVAAFTPWNYPAVLITRKLAPALAAGCPVILKGAEETPSVAVHIVESLRQAGVPDGVVNLVFGVPVHISRHLLSSPIVKVLTFTGSTAVGKQLAMLAANNLQRCILELGGHSPVIVCEDADLAKAIPAISEYKFECAGQSCNAPSRILVARTLYEEFLSRMTEAARKIRIGLPDDPATEMGPMANARRIEAMQRLTKDAVDRGAHIETGGTRLDGAGFYWPPTILTGVPKDARVLHEEPFGPILTVAPFDTLDEAIGEANDTEYGLAAYFFTDAADTQRKLTNSLSAGAVSVNYLKGVSADAPYGGVKQSGYGYEGGEQGVRSFQILKMVNGLGSFG

SEQ ID NO: 74247 - protein, 323 aa, Saccharomyces cerevisiae
MSLDRVDWPHATFSTPVKRIFDTQTTLDFQSSLAIHRIKYHLHKYTTLISHCSDPDPHATASSIAMVNGLMGVLDKLAHLIDETPPLPGPRRYGNLACREWHHKLDERLPQWLQEMLPSEYHEVVPELQYYLGNSFGSSTRLDYGTGHELSFMATVAALDMLGMFPHHRGADVFLLFNKYYTIMRRLILTYTLEPAGSHGVWGLDDHFHLVYILGSSQWQLLDAQAPLQPREILDKSLVREYKDTNFYCQGINFINEVKMGPFEEHSPILYDIAVTVPRWSKVCKGLLKMYSVEVEKKFPVVQHFWFGTGFFPWVNIHHHHHH

SEQ ID NO: 74248 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQEHYRADMKTLEVFTNWLHQRSFS

SEQ ID NO: 74249 - protein, 323 aa, Saccharomyces cerevisiae
MSLDRVDWPHATFSTPVKRIFDTQTTLDFQSSLAIHRIKYHLHKYTTLISHCSDPDPHATASSIAMVNGLMGVLDKLAHLIDETPPLPGPRRYGNLACREWHHKLDERLPQWLQEMLPSEYHEVVPELQYYLGNSFGSSTRLDYGTGHELSFMATVAALDMLGMFPHMRGADVFLLFNKYYTIMRRLILTYTLEPAGSHGVWGLDDHFHLVYILGSSQWQLLDAQAPLQPREILDKSLVREYKDTNFYCQGINFINEVKMGPFEEHSPILYDIAVTVPRWSKVCKGLLKMYSVEVLKKFPVVQHFWFGTGFFPWVNIHHHHHH

SEQ ID NO: 74250 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAISTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMITPPHELVDTCNPRIYPDFTWPMLLEFTQKHYRADMKTLEVFTNWLHQRSLS

SEQ ID NO: 74251 - protein, 581 aa, Gibberella zeae PH-1
MPSADPIVAVPANGAVNGTANGTNDDSRPQTPMTGMALTEYSANPSTPSAEKQARLKEIVPEEYLLPTGYPDYLRLIAGATSRVYEACKVTPLTHAINLSNRLECNVLLKREDEQPVFSFKLRGAYNKMAHLDPKKSWKGVVCCSAGNHAQGVAYSARKLKIPATIVMPEATPSIKHLNVARLGGHVVLHGADFDAAKEECARREVQDGLINIPPFDDPYVIAGQGTIGNELFGQVNMAKVEAIFCCVGGGGLIAGIGLYVKRMAPHVKIIGVEAQDANAMAQSLKKGERVLLKEVGLFADGAAVKIPGEETFRICKEVIDDVIEVSTDEICAAIKDMYDDTRSGLEPAGALSIAGLKKYVSQNPSDDSKRNLIAVTSGANMNFDRLRFVAERATMGEGKEALLSVQIPERPGAFSELINNIMPHGVTEFSYRYSTDEVANILIGVSLTAPAHQRSEELRSLIDRIQSNNMTVTDLSNDELAKSHIRYLVGGRSGVPNERLYMFTFPERPGALEKFLVTLRPKFNISLFQYRNYGGDVGKIVTGILCPDEEVTELHNFLRKIGYPYEDCTESPVFKTFLRS

SEQ ID NO: 74252 - protein, 335 aa, Shewanella sp. ANA-3
MKYLVTGAAGFIGAKVSERLCAQGHEVVGIDNLNDYYDVGLKLARLAPLEALSNFRFIKLDLADRDGIATLFAEQGFRRVIHLAAQAGVRYSLDNPLAYADSNLVGHLTILEGCRHHKIEHLVYASSSSVYGLNQKMPFSTEDSVDHPISLYAATKKANELMSHTYSHLYQLPTTGLRFFTVYGPWGRPDMALFKFTKAILAGDIIDVYNHGDLSRDFTYIDDIVEGIIRVQDKPPRPTPDWRVETGTPANSSAPYRVFNIGNGSPVQLLDFITALESALGIEANKQFLPMQPGDVHSTWADTEDLFKAVGYKPQVDINTGVGRFVEWYRAFYAK

SEQ ID NO: 74253 - protein, 294 aa, Arabidopsis thaliana
MALTNNLWAFVFGILGNIISFVVFLAPVPTFVRICKKKSTEGFQSLPYVSALFSAMLWIYYAMQKDGTAFLLITINAFGCVIETIYIVLFVSYANKKTRISTLKVLGLLNFLGFAAIVLVCZLLTKGSTREKVLGGICVGFSVSVFAAPLSIMRVVVRTRSVEFMPFSLSLFLTISAVTWLFYGLAIKDFYVALPNVLGAFLGAVQMILYIIFKYYKTPVAQKTDKSKDVSDHSIDIAKLTTVIPGAVLDSAVHQPPALHNVPETKIQLTEVKSQNMTDPKDQINKDVQKQSQV

SEQ ID NO: 74254 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 74255 - protein, 526 aa, Hypocrea jecorina
MSGPVPTATSLADIYPPSALAAEAPRWNALLAKFQTEFGRPARFVSRSPGRVNIIGEHIDYSLYSVLPMAITADALIAVATKPAAPDAAAFTIRVRNVQGAKFPPADFDVPFGADVDIDSTKFEWTNYFKSGLRGALGLLYKKRGPDFRPCDMDVLMDGNVPVGGGLSSSAAFVTASALAVMAANGESAVDKKELTELAIVSERAVGVNSGGMDQAASVFSEQGSATFVSFTPSLSARPVKFPPTRPELCFVIAQSFVTSNKHVTGPIHYNLRVVEVSFAAAYLHAKLNPPGTELPQDAGPLGISLQGFHDAFFYHNGGSDYAAAKSLTKEEELRRLIDITKDTLTREDGYTREEIASVLQMSVPELEQRFMSRFPVRADRFKLRQRALHVFTEALRVVQFLALLEGPLHTGRTDTTQFNQELGRLMNETQDSCRDLYECSCPELDEICRISRGAGAYSSRLTGAGWGGCSVHLVPADKVQAVKEALEQQYYSKLDLTDEQKEQAVVVSRPGRGSAVFIVEGGQLS

SEQ ID NO: 74256 - protein, 376 aa, Zea mays
  misc_feature (81)..(81): Xaa can be any naturally occurring amino acid
  misc_feature (216)..(216): Xaa can be any naturally occurring amino acid
  misc_feature (248)..(248): Xaa can be any naturally occurring amino acid
MARRSTPLLRRLLAPSPSPSASTPLAGAVSRRTVTYMPRPGDGAPRGVTLIPGDGIGPLVTGAVRQVMEAMHAPVYFETYXVRGDMPTVPAEVIESIRRNKVCLKGGLATPVGGGVSSLNMQLRKELDLYAALVNCFNLPGLPTRHDNVDIVVIGENTEGEYSGLEHEVVPGVVESLKVITKFCSERIAKYAFEYAFLNNRKKVTAVHKANIMKLXADGLFLESCREVAKKYPIIQYNEIIVDNCCLXIVAKPEQFDVMVTPNLYGNLVANVAAGIAGGTGVMPGGNVGQDHAIFEQGASAGNVGNEKIVEKKRANPVALLLSSAMMLRHLQFPSFADRLETAVKRVIAEGKYRTKDLGGTSPTQEVTDAVIAKLG

SEQ ID NO: 74257 - protein, 334 aa, Neisseria meningitidis Z2491
MSIKVAINGFGRIGRLALRQIEKAHGIEVVAVNDLTPAEMLLHLFKYDSTQGRFQGTAELKDDAIVVNGKEIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 74258 - protein, 220 aa, Triticum aestivum
  misc_feature (2)..(2): Xaa can be any naturally occurring amino acid
  misc_feature (15)..(15): Xaa can be any naturally occurring amino acid
  misc_feature (24)..(24): Xaa can be any naturally occurring amino acid
  misc_feature (33)..(33): Xaa can be any naturally occurring amino acid
  misc_feature (60)..(60): Xaa can be any naturally occurring amino acid
  misc_feature (103)..(103): Xaa can be any naturally occurring amino acid
  misc_feature (107)..(107): Xaa can be any naturally occurring amino acid
VXQFVYLMYEGNFKXVWQVVEDFXMEEQFSTLXQYILIHLDEQRLLHFLKTLGKLISPNXQCTKLAFPCCWLEVLLSAHIDQISLDELILLNCVIAKGRQLWXLMNXEEHEEERGRMDELVRTMNDLTDADHFALIKDFMGTKFPDALKWIGIQSWVIFCGLSKLCKSADSCESLFTGNSIEFRKAYDYSLVQNDGCSVSHTSDTDDKDLTRSSHKKKKK

SEQ ID NO: 74259 - protein, 469 aa, Lactococcus lactis subsp. lactis
  misc_feature (357)..(357): Xaa can be any naturally occurring amino acid
MSSGKITQIIGPVVDVEFGSDAKLPEINNALIVYKDVNGLKTKITLEVALELGDGAVRTIAMESTDGLTRGLEVLDTGKAVSVPVGEATLGRVFNVLGDVIDGGEEFAADAERNPIHKKAPTFDELSTANEVLVTGIKVVDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVQGQDVLLFIDNIFRFTQAGSEVSALLGRMPSAVGYQPTLATEMGQLQERITSTKKGSVTSIQAIYVPADDYTDPAPATAFAHLDATTNLERRLTQMGIYPAVDPLASSSRALTPEIXGEEHYEVAMEVQRVLQRYKELQDIIAILGMDELSDDEKILVGRARRIQFFLSQNFHVAEQFTGQPGSYVPIDKTVHDFKEILEGKYDEVPEDAFRGVGPIEDVLEKAKSMGY

SEQ ID NO: 74260 - protein, 453 aa, Actinoplanes sp. SE50/110
MTRDVFRAGSFRHRRRDPAAVPVSRQADLLARESRHLAPGASEEAALGRRVFVEGRGATLRDADGVEYLDFAAGTLTQSLGHCHPEVVARLTEQAGKLWNVHDFATADRAALCELLAELLPDHLTTLAFFSTGAEVVEAALRTVQAVAEPGRNRVGALRHGFHGKTMGARMLVHWDVGDQSFAGNSVLGYAPYCYRCPLELSYPSCEVRCATLVRRHIAEKPNVSALFFEPVLGAAGVIVPPPGYWEQIAAACRDNGVLLVADEVLTGGGRTGTFLASEAIGVAPDLVTLAKGTASGFPFAVLAGRDEVLRHPRAGLAGSTASTYAGNPLGIAAAHATLSVISRDRLIEQVRDLGAVLADRLAEMHDRHPHLGDVRGIGLLHGLEFVHDRQSRRPAPEIARRVYTTALDAGLRTAIGGHIIRLAPPFVIDETELLRGLDLLDRAITEAGRVTA

SEQ ID NO: 74261 - protein, 541 aa, Pichia angusta
MAGDSITGVAGTADVNRVEAPLTVRAYLMCAFGAFGGILFGYDSGYISGVMGMDYFIHEFTGKVKHGDDDSSFVVGSSQKSLITSILSAGTFFGAVCAGDLADMFGRRTIIVTGCSIYSVGVALQVASTTVALLSVGRVIAGVGVGFVSSVVVLYLSEISPKKIRGAIVSGYQFFVTIGLLLASCVDYGTEHRNDSGSYRIPIALQLIWAIILAVGLILLPESPRYYVLKGKFDRAAKVLSRLRGQPIDSDYIQEELAEIVANHEYERSVIPTTSYWQSWAACFTGGLRRPSSNLRKTILGTSMQMMQQWTGVNFIFYFGTTFFQQLGTIHNEFLISMITTIVNVASTPLSFYTIEKFGRRALMIYGAAGMVVCQFIVAIGGTVDGDNQKTVSAMIAFICIYIFFFASTWGPGAWVIIGEIFPLPIRSRGVGLSTASNWLWNCIIAVITPYMVDGDKGNLGAKVFFIWGSLCGCCLLYAIMLIPETKGLTLEQVDKMLEETTPWTSAKWKPHSTFAAEMGLAKDDKGVTHELKEHASVESV

SEQ ID NO: 74262 - protein, 568 aa, Oryza sativa
  misc_feature (287)..(287): Xaa can be any naturally occurring amino acid
  misc_feature (296)..(296): Xaa can be any naturally occurring amino acid
  misc_feature (316)..(316): Xaa can be any naturally occurring amino acid
MASKAVPDVVTDKKCDKTMAASSEMSQSQEVISRGGKLGTASSRETLLGDVATSSGVKEQDKDSCSVDESVKLDGNEDAEKSSLRGSVKDSSASAKGSDRASSLTKVSGSTKVSDHAADIVGSSKSSVYRASAGSDVSDESTCSSICSSASKPHKSNDSRWEAIQMVRTKEGSLGLGHFRLLKRLGCGDIGSVYLSELSGTKCYFAMKIMDKASLASRKKLLRAQTEREILQCLDHPFLPTLYTHFETDKFSCLVMEFCPGGDLHTLRQKQPGKFFPEQAAKFYVAXVLLALEYLXHCLAIIYRDLKPENVLVREXGHIMLSDFDLSLRCAVSPTLLKSSNPGVDPNQKGNPSYCVQPVCIEPACIQPSCVTTTTCFAPRFFSSKSKKEKKAKTDIASQVRPLPELVAEPTDARSMSFVGTHEYLAPEIIKGEGHGSAVDWWTFGIFLYELLFGKTPFKGSGNRATLFNVVGQSLRFPESPVVSFAAKDLIRGLLIKEPQHRLAYKRGATEIKQHPFFEGVNWALIRCATPPDIPKPVEIPRSVASTSQKATTTAEKGSDNYLEFDFF

SEQ ID NO: 74263 - protein, 363 aa, Actinoplanes sp. SE50/110
MSTGVRAVLLAGGEGRRMGALGAGRLKPLVPFGGAARLIDFSLANARDSGLDQVLLLSQYQERQLMDDLRRTWWQPGFRVHFGPYDRAYTDGIPVEYEPPTGPPERGTADALIRKAPYLFGPDVTEVLVQHADHVYRFDYRPMIAEHRASGAALTVSYQRIDRRYVHLFGMVEFDDRNRLVSFVEKPAEPTSDLVFAAFCVFDAAVLHRYLELLDGTDWQHDISRDVIPAMLAAGEHIRGCPVPGYWADIGTVERYHEAHLSLVGTPPSLAVDAMPWTVAPRTARALVTSADGVRHSVVPADLVNHGTVERSVLFPAARIGPGATVRDSVLLPGAVVPAGAEIDGAVVLEDGTVQQVTTGARR

SEQ ID NO: 74264 - protein, 372 aa, Zea mays
MVHRTSIADVHVMCMDLSPKKPNKASASDGGAYYDWSPADLPMLGVASIGAAKLCLTAGGLALPSYSDSAKIAYVLQGKGIFGVVLPEATKEKVISVKEGDALALPFGVVTWWHNNADAAISDLVVLFLGDTSTGHKPGQFTNFQLTGSTGIFTGFSTEFVARAWDLTQDDAAKLVSTQPGSGIVRVKDGHKMPEARDEDRQGLVLNCLEAPLDVDIKNGGRVVVLNTQNLPLVKEVGLGADLVRIDAHSMCSPGFSCDSAYQVTYIVRGSGRVQVVGIDGTRVLETRAEGGCLFIVLRFFVVSKIADETGMEWFSIITTPNPIFSHLAGRTSVWKAISPAVLQSSFNTTPEMEKLFRSKRLDSEIFFAPSN

SEQ ID NO: 74265 - protein, 188 aa, Glycine max
MADNEQPNNEEASPLLHQPHPQPKSEPPTPPETPEFLLGWTADGLPLAHASVVGQPMGRAPWNSSICACLGQNDHFCSSDLEVCLLGSVAPCVLYGSNVERLGSARGTFANHCLPYSGMYIIGNSCFGWNCLAPWFSYPSRTAIRRRFNLEGSCEALNRSCGCCGSILEDEVQREHCESACDLATHVF

SEQ ID NO: 74266 - protein, 426 aa, Mycobacterium leprae TN
MFVNLTCLSEGNGSRGKALAESTQAELKTSWYLLGPAFVAAIAYVDPGNVAANVSSGAQFGYLQLWVVVVANVLAGLVQYLSAKLGLVTGQSLPQAISKQMSHPFRLGFWLQAELVAMATDVAEIVGGAIAFHILFRVSLLLGGVITGTVSLLLLMVKDRRGQLLFERVITGLLFVIVVGFTSSFFVATPSPEDMVNGLLPRFQGTESVLLAAAIIGATVMPHAVYLHSGLALDRHGHPHAGRSRRRLLRVTRLDVILAMTIAGIVNTAMLLVAAINLQHHQVTAYIEGTYTAIQDTLGATIAMLFAIGLLASSLASASVGAYAGALIMQGLLQRSIPMLIRRLITLCPAIAILALGFDPTRALVLSQIVLSFGIPFAVLPLVKLTNNRGLMGNDTNHPATTVLGWAVAILVSLLNVVLIYLTVTS

SEQ ID NO: 74267 - protein, 144 aa, Nicotiana tabacum
MASISGTMVSTSFLPRKPVVTSLKAIPNVGQALFGLKSERGGRITCMASYKVKLITPEGTVEFDCPDDVYILDQAEEEGHELPYSCRAGSCSSCAGKVTGGNIDQSDGNFLDDDQMADGFVLTCVAYPQSDVTIETHKEEELTG

SEQ ID NO: 74268 - protein, 434 aa, Rickettsiella grylli
MTKITEINAYEILDSRGNPTITAEVILDSGLKADASVPSGASVGSKEAFELRDTQRVDRYHGKGVLGAIQNVLGPLRNHLIGKNIDKQSQLDNLMRKLDGTDNKSKLGANAILSVSLCLLKAAALASRQTLYAHIAELMGKTDKKYIMPVPQMNIINGGVHADNALAIQEFMILPLGAPTFSEALRWGVEIFHCLKAYLKKQGLNTNVGDEGGFAPNFQTHQEAIESILEATQQAGYQPGGDIYLGLDAASNEFYVNGKYCLENKTLDTEAWVRYLENLVKQYPIISLEDGMAESDEAGWIHLTQQLGRKIQLVGDDLFVTNSTLLKQGIHKKCANAILIKLNQIGTVSETLAVISLARHADYATIISHRSGETEDTSIADLAVGTGAGQIKTGALCRTDRTAKYNRLLRIEAELSIQNQVEYAGTQFFSRFLI

SEQ ID NO: 74269 - protein, 492 aa, Arabidopsis thaliana
MPEFSSSVKLKYVKLGYQYLVNHFLSFLLIPIMAIVAVELLRMGPEEILNVWNSLQFDLVQVLCSSFFVIFISTVYFMSKPRTIYLVDYSCYKPPVTCRVPFATFMEHSRLILKDKPKSVEFQMRILERSGLGEETCLPPAIHYIPPTPTMDAARSEAQMVIFEAMDDLFKKTGLKPKDVDILIVNCSLFSPTPSLSAMVINKYKLRSNIKSFNLSGMGCSAGLISVDLARDLLQVHPNSNAIIVSTEIITPNYYQGNERAMLLPNCLFRMGAAAIHMSNRRSDRWRAKYKLSHLVRTHRGADDKSFYCVYEQEDKEGHVGINLSKDLMAIAGEALKANITTIGPLVLPASEQLLFLTSLIGRKIFNPKWKPYIPDFKLAFEHFCIHAGGRAVIDELQKNLQLSGEHVEASRMTLHRFGNTSSSSLWYELSYIESKGRMRRGDRVWQIAFGSGFKCNSAVWKCNRTIKTPKDGPWSDCIDRYPVFIPEVVKL

SEQ ID NO: 74270 - protein, 766 aa, Zea mays
  misc_feature (135)..(135): Xaa can be any naturally occurring amino acid
  misc_feature (481)..(481): Xaa can be any naturally occurring amino acid
MAAAAILPELATQVLIPVAAAVGIAFAVVQLVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPXLANAIFSTIAFVLCAVTSLVSGFLGMKIATYANSRTTLEARKGVGKAFITAFRAGAVMGFLLSASGLLVLYIAINLFGIYYGDDWEGLFEAITGYGLGGSSMALFGRLGGGIYTKAADVGADLVGKVERNIPEDDPRNPAVIADNVGDNVGDIAGMGSDLFGSYAESSCAALVVASISSFGINHEFTPMVYPLLLSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYXVAVAALGMLSTIATGLAIDAYGPISDNAGGIAEMAGMSHRIRERTDALDAAGNTTAAIGKGFAIGSAALVSLRLFGAFVSRAAISTVDVLTPEVFIGLIVGAMLPYWFSAMTMKSMGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 74271 - protein, 75 aa, Zea mays
SVHGSATPLTTSRRLADRKISRFEKNITKRGSVPETAKKANDYPVGPILLGFFVFVVVGSSLFQIIKTASNAGLF

SEQ ID NO: 74272 - protein, 503 aa, Nostoc sp. PCC 7120
MFCDYLVQILTARVYDVAQESPLEYAPNLSARLNNKLLLKREDMQSVFSFKLRGAYNKMVNLPPDLLAQGVIAASAGNHAQGVALGAKQLGTRAIIVMPVTTPQVKVDAVKARGGEVVLHGDTYDDAYAYARQLEAEKGLTFIHPFDDPHVIAGQGTIGMEILRQYQQPIHAIFVAIGGGGLISGIAAYVKRLRPEIKIIGVEPVDADAMNQSLQAGKRVRLSQVGLFADGVAVREVGEETFRLCQEYVDEIILVDTDDTCAAIKDVFEDTRSILEPAGALAIAGAKAYVEREQIQGQTLVAVACGANMNFDRLRFVAERAEFGERREAIFAVTIPETPGSLRKFCECIGRRNLTEFNYRIADEKIAHIFIGMQIQNRADKIHMVETFAECGFEILDLTDDELTKLHLRHMVGGHSPLAHNELLYRFEFPERPGALMKFVASMSPNWNISMFHYRNNGSDYGRIVVGMQVPPQEMEEWQAFLDSLGYQYWDESQNPAYKLFLG

SEQ ID NO: 74273 - protein, 158 aa, Buchnera aphidicola str. Sg (Schizaphis graminum)
MRRILSVLLENESGALSRVIGLFSQRGYNIETITVAPTEDPSLSKMTIQTIGNEKSIEQIEKQLHKLIDVLRVIKVGQNSHIEREIMLLKVQTNNCKKDDVKHITEVFRGQIVDITSTTYVLQITGTAKKLDSFLKIIRNTTEIIEMTRSGIVGIARG

SEQ ID NO: 74274 - protein, 193 aa, Zea mays
  misc_feature (41)..(41): Xaa can be any naturally occurring amino acid
  misc_feature (73)..(73): Xaa can be any naturally occurring amino acid
  misc_feature (94)..(94): Xaa can be any naturally occurring amino acid
MATAFDSPTSSPAAAPFHDDPFLHFDGSAPAAADGFPASPXAYAPSPFGMPHSNGDLHDDPFAASADSNGGPXLPPPTEMGREEGFVLREGCRXNAIHLEEKEKRERELRSQILVDAEEFKKAFVEKRKLSAETSRGQNRDGERVGGISSRPGSCIPSVSLFLKMKTCSSFFYISFFCEVISSYFLAFFASFS

SEQ ID NO: 74275 - protein, 261 aa, Buchnera aphidicola str. Sg (Schizaphis graminum)
MNCIIKTESEIKKMKVSGKIAAEVLEMIENYIKPNISTEEINNICHNFIIKKKAVSACLGYHGFPKSICISVNDVVCHGIPNKNQILKSGDIVNIDVTIIKKNYHADTSKMFLVGQTNILSQRLCKIAQESLYKSLNILKPGIPLYKIGEVIQNYVENNNFSVVKEYCGHGIGRAFHEEPYVLHYKNKSHVILEKGMIFTIEPMINAGSHEVKCMKDGWTVKTKDHSLSAQYEHTVLITENGCDILTWQKNEKIPSKFINK

SEQ ID NO: 74276 - protein, 243 aa, Yarrowia lipolytica CLIB122
MSSELPPLEQAKRIAAHQAVEQHYPKDAKVVGIGSGSTVVYVAEKIASLPKELTKDTVFISTGFQSKQLIQNAGLRLGCIDQYSNGDLDVAFDGADETDPQLNCIKGGGACLFQEKIVAECARKFVVVADYRKQSKALGTVWIQGIPIEVVPDAYNKVIADLKKMGAQSAVLRPGSPGKAGPIITDNGNFIVDAYFGEIQPDAVKDLHIKIKLLLGVVETGLFTNADVAYFGNADGTISTITK

SEQ ID NO: 74277 - protein, 397 aa, Nitrosomonas europaea ATCC 19718
MKLSQRVQAIKPSPTLAVTAKAARLKAEGKNIIGLGAGEPDFDTPLHIKDAAITAIRNGFTKYTAVGGTASLKQAIISKFKRENSLEFMPGEILVSSGGKQSFFNLVLATIDPGDEVIIPAPYWVSYPDIVLIAEGKPVFIDTGIEEKFKISPDQLEKAITPRTRMFVVNSPSNPSGSVYSLEELQALGAVLRKYPDILIATDDMYEHILLSGDGFVNILNACPDLKARTVVLNGVSKAYAMTGWRIGYCGGPAAIITAMENIQSQSTSNPNSIAQVAAEAALNGDQSCMVPMIEAFRERNQFLTNALNSIAGIHCLLSEGAFYAFVDVRQAISRLNTQQILQNSSDIAFCNYVLEKAEVAAVPGSAFGCEGYMRLSFATSMDNLQEAVKRIASLLS

SEQ ID NO: 74278 - protein, 419 aa, Thiomicrospira crunogena XCL-2
MDWFERYESEIRAYARSYPAVFVKGENAKQTDENGKEYIDFYAGAGVLNFGHNHPKLKAAIVEYIQNDGVLHSLDMMTGAKREFIKGFVETILKPRNMDYKLQFMGPTGTNAVEAALKLARRVTGRKDVIAFSQGFHGMTLGALACTANEVFRNAAGVPLTMVSHWPFESNQGGGIESLDTLRALYENSSGGVEKPAAFIVEAIQAEGGVNVASAEWLQALQTLARDLGALLIVDDIQAGCGRTGHYFSFENMELDPDIVTLAKGIGGLGTPMAMNLVKPEHDRHWKPGEHTGTFRGQNISFVAGREALRFFENDDLMEQTRSKGQIMQQHLQGLAERYSGHGFSVRGKGMMQALDVKDGALAKAVARDCFDHGMLFGPCGVGGQVIKLIPPLTIPEEELQAGLAILEQALQRQVEMKS

SEQ ID NO: 74279 - protein, 182 aa, Prochlorococcus marinus str. MIT 9515
MMQSGNKESFLNLSQKSILILSFTLIIGSLLLFKNLVFQPNFLLKKFGELTIDPEIAFTNKKPTFLEFYAEWCEVCKEMAPSVADIKEEYEKDINFVFLNVDNPKWEKYIRNFNVNGIPQVNLFDEDANLEVTFIGKQQEKTIKESLDNLYEHSQSNLQILNTEFSKIRDNKNYQTSPRSHG

SEQ ID NO: 74280 - protein, 392 aa, Neisseria meningitidis Z2491
MAFLKLTEQNVQGKTVLIRADMNVPFKDGKISDDTRIRASIASVKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDDMILDIGPKSAAALADLLKAADTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 74281 - protein, 408 aa, Fulvimarina pelagi HTCC2506
MNAPVFPELKIPDTIAAGPGPGNTAQRVLDAYHDQGVADHMNPDVLRGMIESKKMLREVWGTNNIHTFACAGTGWSALDMMFSVVHPGDKIVLFVNGTFSGIDELSVRMKGATPEELAANSLDPKASSVVTIKVPHGESVTGEIVEKALTEHKPKWAAMAHWETGSGRVNDIRGFSDACEKHGVMGLVDAVSSLGIAEFRVDDYPGIHGWASCPQKGVMALPLTYAPVTFTDTYIEELKKVGGRCFVHHPIMEARHWAIIEGQDVEKGTYHRTHSPYAVASFHEALRMVLEDGMLQRAEKYRTAEKALRAALTKMGCNVTSNMTSLLVLDLPDQLKGQEKDFVNKCRAENFCIWPTLSEPTQIRVGILNLLSEAELTEIVSRFGDMLNRFDYKTDVDAAVAELKSHLN

SEQ ID NO: 74282 - protein, 452 aa, Schizosaccharomyces pombe 972h-
MTSYGNGFRMMAKCLLSLRSGYSVTAPVSKSMANVLWARYASTRIKTPPFPESITEGTLAQWLKQPGEYVNKDEEIASVETDKIDAPVTAPDAGVLKEQLVKEGDTITIDQDIAVIDTSAAPPEGGSAGPKKDEVKTADADAAKDLSTPQDSSKPIEEKPMPDLGAEQKESAPSSTKPAPDAKEPEFSSPKPKPAKSEPVKQSKPKATETARPSSFSRNEDRVKMNRMRLRIAERLKESQNRAASLTTFNECDMSAVVALRKKYKDEILKETGVKIGFMSFFSKACTQAMKQIPAINGSIEGEGKGDTLVYRDFCDLSIAVATPKGLVTPVIRNAESMSLLEIESAIATLGSKARAGKLAIEDMASGTFTISNGGIFGSLYGTPIINLPQTAVLGLHAIKERPVVINGQVVPRPMMYLALTYDHRMVDGREAVTFLRLVKEYIEDPAKMLLV

SEQ ID NO: 74283 - protein, 415 aa, Glycine max
MSKLIHRPCTPSPLRSTSMCSQQQRPSHHQPSHHHAQLHPQHLYVIIALWQGSRQGVAVNDDILGAMDVHDDKFHGFDDLLHGLNSQESPHSSWRAWSMVVRHGNDDFRWKRERKGDDVTQDISDKGYSMQLANERMKSRWFVWLLAVLGIIGATLFIVSLIQTSENNFLCSITRTMQQQQQQFTDGPTSMQLKAILHYATSQIVPQQSLSEITITFDVLQSLHRPANFLVFGLGRDSLMWASLNPHGTTLFLEEDPKWFGIVTKEAPYLRAHTVRYRTQLREADSLMSSYRSEPACFPATATLRGNERCKLALHNLPDEVYEKEWDLIMIDAPKGYFAEAPGRMAAIFSAAVMARDRKGSGVTHVFLHDVDRKVEKVYAEEFLCRKHLVKGVGRLWHFEIPPMGNNTRDYARFC

SEQ ID NO: 74284 - protein, 507 aa, Mycobacterium sp. MCS
MTVYARPGAADALMAFESRYGNFIGGEWVAPAGGEYFENLTPVTGQTFCEIPRSTEADIDKALDAAHGAATAWGKTSPGERAQILIKIADRLEANLESLALAESWDNGKPIRETLNADIPLAIDHFRYFAGAIRAQEGALSQIDEDTVAYHFHEPLGVVGQIIPWNFPILMATWKLAPALAAGNAVVLKPAEQTPASILYLMSLIADLLPAGVVNVVNGFGVEAGKPLASSNRIAKIAFTGETTTGRLIMQYASQNLIPVTLELGGKSPNIFFSDVMAANDDYQDKALEGFTMFALNQGEVCTCPSRSLVQADIYDEFLELAAIRTKAVRQGDPLDTETMIGSQASNDQLEKVLSYIEIGKDEGARVVTGGERAELGGDLNGGFYVQPTIFEGKNSMRVFQEEIFGPVVAVTSFKDYDDAISMANDTLYGLGAGVWSRDGNTAYRAGRDIKAGRVWTNCYHMYPAHAAFGGYKQSGIGRENHKMMLDHYQQTKNLLVSYSNKAQGFF

SEQ ID NO: 74285 - protein, 655 aa, Arabidopsis thaliana
MRVFFFPNSSMAILSVFLSLLLLSLPLPSTQDLNADRTALLSLRSAVGGRTFRWNIKQTSPCNWAGVKCESNRVTALRLPGVALSGDIPEGIFGNLTQLRTLSLRLNALSGSLPKDLSTSSNLRHLYLQGNRFSGEIPEVLFSLSHLVRLNLASNSFTGEISSGFTNLTKLKTLFLENNQLSGSIPDLDLPLVQFNVSNNSLNGSIPKNLQRFESDSFLQTSLCGKPLKLCPDEETVPSQPTSGGNRTPPSVEGSEEKKKKNKLSGGAIAGIVIGCVVGFALIVLILMVLCRKKSNKRSRAVDISTIKQQEPEIPGDKEAVDNGNVYSVSAAAAAAMTGNGKASEGNGPATKKLVFFGNATKVFDLEDLLRASAEVLGKGTFGTAYKAVLDAVTVVAVKRLKDVMMADKEFKEKIELVGAMDHENLVPLRAYYFSRDEKLLVYDFMPMGSLSALLHGNRGAGRSPLNWDVRSRIAIGAARGLDYLHSQGTSTSHGNIKSSNILLTKSHDAKVSDFGLAQLVGSSATNPNRATGYRAPEVTDPKRVSQKGDVYSFGVVLLELITGKAPSNSVMNEEGVDLPRWVKSVARDEWRREVFDSELLSLATDEEEMMAEMVQLGLECTSQHPDQRPEMSEVVRKMENLRPYSGSDQVNEAD

SEQ ID NO: 74286 - protein, 357 aa, marine gamma proteobacterium HTCC2143
MAVAVDMIRLAINGYGRIGRCLLRALYESGHRQQMKVVAINEPAELATIAHLTKYDSTHGRFPAEVAHDVGRLLVNGDSIAVTHHQSLSDLDWAEHEVDLVLECSGLYDSLDQLEGHLDQGVKKVLLSQPGLAPIKPIVWGINQRNIVAEDTIISAASCTSNCITPVIDVVHQAFNIECGVITTIHSAMNDQPVIDAYHHTDLRKTRASGQSIIPVETGLAAGIGRVIPDMTGKLEARALRVPTLNVSAMELSVVVTKSPSIDAVNNVLREVSDGALHGVLGYSEEPLASCDYNHDPRSGIVDAAQTRVSGTLVNVLVWFDNEWAYANRMLEIVDYWTGGMSTKNRADKSVVQVNEE

SEQ ID NO: 74287 - protein, 382 aa, marine gamma proteobacterium HTCC2143
MTDLDLAGKRVLIREDLNVPIKDGHVSSDARIRAALPTIEHALQCGAKVMLMSHLGRPTEGDYESQFSLQPVADQLGRLLGRSIPLISDWGNGIEMSDGDLILLENVRFNVGEKKDNENLSKAYAALCDVFVMDAFGTAHRAQASTHGVAKFAPVACAGPLLTKELDALSKVLAKPARPMVAVVGGSKVSTKLAVLETLADIVDQLIVGGGIANTFLAASGKPVGKSLCEHDLLGQAKSLMAKTEIPIPQDVITAKEFAETAAAELKSANDVADDDMIFDIGPQASEDIAKILEEAKTILWNGPVGVFEFDQFGNGTKSLSEAIANSDAFSVAGGGDTLAAIDKYGIADKVSYISTGGGAFLEYVEGKVLPAVAILELRAKG

SEQ ID NO: 74288 - protein, 343 aa, Vibrio vulnificus YJ016
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMVELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 74289 - protein, 588 aa, Arabidopsis thaliana
MDYLSSMGSQTARFCLILLFLFYYLPCALSQDDLWGCGTPFRCGNITAGFPFLGGIRGEVCGHHSLKLNCNKHSNTTSLIFSGHNYTVLYIDNNNNSVTLGLSRQDFSGPFCSASFSSTLLSSGLFQNLPSYKSLTVFYACDPRRHFLGNFTCPVKGLGSIIQNSTYGILCDGSFSVPVPTSFVSEEEVLDLTHLESVLRKGFEVKLNIDEIPCPLECFSSRANCLFLAGSCCKYHDRTTTCGGDTGDLLRESMILLFAMFFISPLIVAEIIPNTRSILITIGQEVVGRGGFGTVYKGNLRDGRKVAVKILKDSNGNCEDFINEVASISQTSHVNIVSLLGFCFEKSKRAIVYEFLENGSLDQSSNLDVSTLYGIALGVARGIEYLHFGCKKRIVHFDIKPQNVLLDENLKPKVADFGLAKLCEKQESILSLLDTRGTIGYIAPELFSRVYGNVSHKSDVYSYGMLVLEMTGARNKERVQNADSNNSSAYFPDWIFKDLENGDYVKLLADGLTREEEDIAKKMILVGLWCIQFRPSDRPSMNKVVGMMEGNLDSLDPPPKPLLHMPMQNNNAESSQPSEEDSSIYSEV

SEQ ID NO: 74290 - protein, 426 aa, Brassica oleracea
MESSCKLFIGGISWETTEDRLREYFQSFGEVLEAVIMKDRATGRARGFGFLVFADPTVAERVVLIRHVIDGKIVEAKKAVPRDDHVVLNRSSSSLQGSPGPATSKKIFVGGLASSVTEAEFKKYFAQFGTITDVVVMYDHRTQRPRGFGFISFESEEAVDRVLQRTFHELNGKMVEVKLAVPKEMALNPIRNQMNVNSFGSSRISALLMNEYTQGFSQSPISGYGVQPEVRYSPGVGGNRGGFSPFGHGFGIELNFEPGHYGSGSNAGFGRPFSPGYAASQGRYGSQIESGVRNNLWGNGGGLGGYMSNSPISRSSFNGNSGMSSLGSIGDNWGGAARARSGYRSEGGGLGLDAMRGVHVGGYSSGSSSLETESLYSDSAWLSPPAKAEERLGMGAFDFVSKGPAAGYINRQPNGGMNNMIMNAHF

SEQ ID NO: 74291 - protein, 651 aa, Pseudomonas fluorescens Pf-5
MFANLLIILASSLVVIALFRRLSLPPVLGYLSVGLMVGPTALDWVNDSEDLPDLAELGVVFLLFSLGLEFSLSKMLALRHVVFGLGSLQVLCTGLILGVLLALFGMPLTAALMLGTGLALSSTAIVSKELTSLGEIFSSHGQNAIGVLLFQDVVAVLLLTLVPVFAGSSEHAWYWALPATLGKTVVLFVGLLLASRWLLPRLFHEVAASHSAELFVLLALVIVLLTAWLTHLLGLSPALGAFLAGMLLGESHYRHQIEADIRPFRDILLGLFFVSIGMLIDLQLFIDHALLITGLTLALLLIKGSVVATLLKLRGSDGETAWRSGLALAQGGEFCFALMAQMQLSQMIPPDISSLLLAATFCSMLVTPLLLRAAPVITARLHRKPNQTAQLEEISAQNAELQGHVLICGYGRVGQSIGRFLRHEQLRYIALDDDPVRVQEASAGESCVHYGDCRRGDLLAAVGLERARLLVIAVDKSDIALTVLKAARRLDRTVPILVRTRDDSQLAELKAAGANEVVPELLESSLMLASHALIMLGLPEQRVQRTVDEVRHSRYQLLHGFYHGTQNSAQDNREPPAVQMHAVSLDADAYACNRPLQELGLEALGVDIRGVQRNGNDLPLNPSPRLQAGDRVLVSGPQAAIEACEARLQAG

SEQ ID NO: 74292 - protein, 325 aa, Zea mays
MERAASVISSLLGGGGGGSGAQAATVKSVLVYPIKSCRGISVPQAPITATGFRWDRQWMLVNSKGRACTQRVEPKLALVEVQMPPEAFAEDWHPTPDDHMVIRAPGMEPLKVPLSVECATISDVSVWEWTGAAYDEGAEAAEWFSTFLGCPTRLVRFNEDSETRLTDPDYARGYKTMFSDGFPYLIVSQGSLDALNEILKEPIPINRFRPNILVEGCHPYAEDMWKSVKINKLTFQGVKLCGRCKVPTINQDTGIPSPTEPTETLQTYRSGEVLLRSHKNKRQVYFGQNAVCKESLSANVEGRIVKVGDPVYVTQSFSSSVEVPA

SEQ ID NO: 74293 - protein, 224 aa, marine gamma proteobacterium HTCC2143
MTQDDLKKAVARAALDYIKPKIENDSVIGIGTGSTANYFIDYLAEIKSHINATVASSEASADRLRKHGIPVFELTSVNEITVYVDGADESDPNLALIKGGGAALTREKIVAASAREFVCIADESKCVAQLGNFPLPVEVIPMARSFVARELVKMGGDPVYREGVVTDNGNIIIDVFNFMIPNPIETEQHINNITGVVTNGIFAQRPADILLVATSEGIKTLHKA

SEQ ID NO: 74294 - protein, 629 aa, Cryptococcus neoformans var. neoformans JEC21
MYPGSSTSALTRAAIARIALRRSTVACRRSVTSRTISADDKNLIPIRTNLRGSALLNTPRLNKGAGFTREERQIFGLEGFLPYDVHSLEKQCLRAYNQLCKQPSVILKHAFLASLRDQNQVLFYRLMQDRLKELLGVLYTPGAAEAVAGYSSLFRRPVGCYISFPNQDGMRAQLEGHLTDVNRTADVAYDSNKPDDAIDLVVVTDAEAILGIGDQGVGGITISTSKAALYTLGAGINPNRILPVVLDCGTDNHALFSDPLYMGWKRTRIRGKNYDQFIDRFITNCRELFPNAIIHFEDFGMANAYRLMEKYKNIPMFNDDIQGTGAVALAALLSAIKVAGSRLSDQRIVIYGAGSAGMGIADQIKDGLMILEGLNKDEAARRFWCVDRNGLLVESMGNGLRHSQMPYARPDAEVEHWNKEDEDRNGIWLMDVIKNVKPTVLIGTSTHSRAFSEELVREMGKHVERPIIFPMSNPTALCEVDPADALAWTENRALVATGSPFPPVQLGNGQEYIVAQTNNALIYPALGLGAILARSKTISNSMLMAGVNSLASLSPALSNSEASLLPDLADVRKVSVDVAAAVVRQAVEDGNAYDENTIKYVKGKGDVSLEEYIRSRMWDAVYRPLELVD

SEQ ID NO: 74295 - protein, 126 aa, Brassica oleracea
MAGRLSGVASRIMGGNGVVARSGASSLRQRAGMGLPVGKHIVPDKRLSVNDELMWDNGTAFPEPCIDRIADTVGKYEALGWLCGGLGFFATLGLLAVVNDKASKVPFVSDLYFNHCCIHHPFLLFD

SEQ ID NO: 74296 - protein, 510 aa, marine gamma proteobacterium HTCC2143
MPHRYIKKILSAQVYDVAIESPVDPAPLLSKRFDNNILLKREDLQPVFSFKLRGAYNKMMHLSDAERAKGVIAASAGNHAQGLALAALKLGVKATIIMPKTTPQIKVDAVRRRGAKVVLHGDTYDEASIHAQKLVNEKDLVYIHPYDDPDIIAGQGTIGMEIIRQVTGPLDAVFVPVGGGGLLAGVAAYIKYVRPDIKVIGVEPEDAACLKAAMDAGRRVKLAQVGLFADGVAVGQIGKETFRVIRKTVDDVITISTDEMCAAIKDIFDDTRSIAEPAGALALAGLKKYIESSGARGQTLLAIDSGANTNFDRLRYISERTEVGEKREAIISVTIPERPGSFKKFCGLLGRRSITEFNYRYGNSRDAQIFVGVQISPDGNDRAELVQGLEQKGYPVLDLTDNEMAKLHIRHMVGGHAPDDIKEELLYRFQFPERPGALLNFLTQLGQQWNISMFHYRNHGAAYGRVLLGLQASKGDRKAVETFLGQVQYPFTEETDNPAYVSFLSGRTTS

SEQ ID NO: 74297 - protein, 462 aa, Glycine max
NLEELLPVVYTPTVGEACQKYGSIFMHPQGLYISLKEKGKIREVLRNWPEKNIQVIVVTDGERILGLGDLGCQGMGIPVGKLSLYTALGGVRPSACLPITIDVGTNNEKLLNDELYIGLKQRRATGQEYAELMHEFMTAVKQTYGEKVLIQFEDFANHNAFNLLEKYRSTHLVFNDDIQGTASVVLAGLVASLKLVGGNLADHRFLFLGAGEAGTGIAELIALETSKQTNAPLEEVRKNIWLVDSKGLIVSSRKDSLQHFKKPWAHEHEPVKNLLDAVNKIKPTVLIGTSGQGRTFTKEVIEAMASINKRPIILSLSNPTSQSECTAEEAYKWSQGRAIFASGSPFPPVEYEGKVFVPGQANNAYIFPGFGLGLIMSGTIRVHDDLLLAASEALAAQVSQENFDKGLIYPPFTNIRKISAHIAANVAAKAYELGLATRLPQPKDLVKFAESCMYTPAYRSYR

SEQ ID NO: 74298 - protein, 206 aa, Picea sitchensis
MTAQTNAELLAAHLEEQKIESDEPIVEDDKDDDDEEDDEEDDDDKDDDDGQEQGVDANGKSKQSRSEKKSRKAMLKLGMKPVPGVTRVAIKKSKNILFVISKPDVFKSPASDTYIVFGEAKIEDLSSQLQTQAAEQFKAPDLSHVMAKPESSTTAQEEEEDIDDTGVEPKDIELVMTQAGVSRAKAVKALKAADGDIVTAIMDLTT

SEQ ID NO: 74299 - protein, 725 aa, Aspergillus oryzae
MSGYARPAGSQPIEMTDMREVHRSGENETRQRASSISTDEDEEENDALPTDPFEPFGDVEPATGNILTFRALIVGCLCGTLVNASNLYLGLKAGWTDSANIFGSIIGFAILQPLTSYLTSLGYQSQLFGPQENNIVQTAATAAGGLSNVFVSAIPALYQLGLLTTPSKDFARLVAITAAGGYFGLLSAAPLRKFFIFQVARELRLIFPSSAATAITIRGMHLAASGAYEARQKMRTLAYSFIFAMLLRVVSQYAIGILWDWHIFTWIASTGFMADTAMAIESWGWFIEWTPAFIGSGMLVGMNVAASFVLGSILAWGVIGPYLVSHGLAFGKEAASADGLVSYFSLSAEYADAQHPSPRYWLLWPGVVCMIAAAFTELFCQWRVIWIAARGFWQTLKTRRQKEYTYTTIGGEKNLANEDDIRLWMWLPGLVVIIVVTCFITSVQFEMSVAETLLALTLAFLLSLLAIHASGATDTVPLSSLSKVSQVVLGGITQGSASIASAQRLNLLGGALTNIGANQACDLMGDFRVGFLLGTSPRLQYAAQMIGTLVAALVAPTMFLIFASAYPCILSAEDTAGDGGDYQCEFPAPSVAAWRAIVLAVTRPESPIPRSSWVFSIAMAVLASVMVLVKNLFNSTWNRIQPYYPNMMIMAMAFTLPSTQYGTAMFIGAVIASVWKRKWPDGFEKYAYAVAAGAMAGEGIGGVINAILSGIGLDGGNFGTTVGTP

SEQ ID NO: 74300 - protein, 153 aa, Triticum aestivum
  misc_feature (72)..(72): Xaa can be any naturally occurring amino acid
  misc_feature (99)..(99): Xaa can be any naturally occurring amino acid
  misc_feature (120)..(120): Xaa can be any naturally occurring amino acid
MAEQTFIMIKPDGVQRGLIGEVISRFEKKGFYLKGLKLQNVEKSFAEQHYADLSSKPFFAGLVEYIVSGPVXVAMVWEGKSVVSTGRKIIGATNPLGLXGPGTIRGDFAVDIGRNVIHGXSDSVESARKEIALWFPEGIAEWRSSQHNWIYEA

SEQ ID NO: 74301 - protein, 125 aa, Arabidopsis thaliana
EQVQIVGDDFLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 74302 - protein, 337 aa, Yarrowia lipolytica CLIB122
MFRSVYKRGRILSKIPIKQHIQITHKHTMTSLDFTLNNGKTIPAIGLGTWKSTTEEVAGAVECALTEGGYRHIDTAFNYRNEDAVGLGIKRAMEKGVKREDIFVTTKIWVTYHDRVEENLDMSLERLGLDYVDMLLIHWPVPLNPNGNDPVYPLRPDGSRDIDESGSQPKTWKQMEAVLKTGKTKSIGVSNFSIPYLEELLKEAEVVPAVNQVELHPLLPQLELMEFCKKNNIVMTAFSPFGSVGGPLLKNELVVSLADKYNTSPGGILTSYHIGNGTVVIPKSVTNSRIVENGKSAVTLSQEDLKALNDLHKTEGIHRTSKPKWGVDLGFPDFDFC

SEQ ID NO: 74303 - protein, 305 aa, Yarrowia lipolytica CLIB122
MAPPTQRRYTNNRKRRGPREVGGAKTGDGLTRIMKRIRDLERVLKRPVPMDEQKRIELERAVAAYKVQAEDIIGDRKNKKNVEKYRMIRFFERQKASRKVKQARKLVEQADSDAKKKDAEALVVKYMADLAYTIHFPNDIKYISLYPNGAVDETAESSKQREKMRAEFAEQIKNGELDVDLERAEQVATTKKSKKKREAGADEEVKGDDEDDEFLEKAPKKAKVEEEESDDDEEDEEDDDDDDDSDDDDSDDSGEPQMEIKRTADEKQTKEEESDSEEFVDESEAESEGKPESEENSEDQDDESE

SEQ ID NO: 74304 - protein, 541 aa, Anabaena variabilis ATCC 29413
MPQLAPHIFDILYQKGVEHAFGIPGDFALTLFDALADSKIAPIVMTHEPCVGFAADAYSRMRGLGLAVVTYSVGGLNMVNAVAGAYAEKSPLVILSGGPGVREQKEHDLLHHKVKTFDTQRRVYEEVTLYATKLTDPKTADAKIHHALDYATTFKRPVYLEIPRDLVYAEITESEHLPPPIKRTDPDTLTEAIAETLEMLKRSHSPVILACVEVHRFGLQEQLLALAEKLGVPVCSTMLGKSVFPERHPQYIGIYNGEAGDLNVQKIVEESDCVLMLGVFMTDINLGMFTAHLNPGFTVYATSERLAIKHHEYPNVRFEDYITTLLDSPDLPHWDSSGIYTMKPRVTPSVGKISMSGLLYELNQFIDSNTLLVTDVGDALFAADDIQTQQGTSFLCPAFYASMGFGVPGVIGAQLADPSRRAIALVGDGAFHMTGMELLTAQRLRLNPIVIVINNGSFASLQAMGHQEAAFVQIPTMDYAQLANVLGGHGFVIHTSTQLQQALQTAQNSKTFSILDVHLSPDDVSPALQRLSALFTKSLKG

SEQ ID NO: 74305 - protein, 482 aa, Neisseria meningitidis Z2491
MKGDIGVIGLAVMGQNLILNMNDCGFKVVAYNRTIGKVDEFLNGAAKGTGIIGAYSLQDLVDKLAKPRKIMMMVRAGSVVDDFIEQLLPLLEEGDIIIDGGNANYSDTTRRTHYLAGKGILFVGAGVSGGEEGARRGPSIMPGGDKRAWEAVKPIFQAIAAKTPQGEPCCDWVGRDGAGHFVKMVHNGIEYGDMQLICEAYQFMKDGLGLSYDEMHRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQTLLASKIISYAQGFMLIREAGESYGWDLDYGNTALLWREGCIIRSAFLSNIRDAYENNPDLVFLGTDPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 74306 - protein, 365 aa, Anabaena variabilis ATCC 29413
MDNIFRFADELGPAKIIHIYEREADLKAIVVVDNIDCGPAIGGVRMATDVTTEEVFRLARAMTLKNAAADLPHGGGKSAILADPKQPLADKERLVRTFARAIRDVTEYIPGPDMGTDEQCMAWIKEEIGRAVGLPKAIGGIPLDEIGATGFGLSICAEIASKFCHLNLEGARIVIQGFGSVGKNAARFLTAKGALLIGAADSQGTLFNPLGIDVKQLIKLKNSGKSVISYPQGDKLDRDAVIDIECDIWIPAARPDIIHADNVDRLKTQLVISGANIPFTEAAERICHERNIIVVPDFIANAGGVICAAVEYDGGNQTTAFETIAKKIRYNTTLVLEQVAKTGKLPRQAAVELAQRRICLARQDI

SEQ ID NO: 74307 - protein, 287 aa, Synechococcus sp. RS9916
MDLTIVGCGYVGLALAERLQPRRPQLRLTLTSTSSERLEQLSPLADHVQICDATEPTQLLEALRQSNSAVFCLGPKGDRQVDANGYRHTFVDSFRCLKLLLPQLPELRQIVYTGSCSVYGDAQGEWVDEQTPPEPSRGHGDVLLESERLLSGIGDRQVCILRLGALYGPGRDLDRRLRGLAGLERPGSGAAFSNWLHVADAAGALEAALDAEWTGVVNVVNDEPIRLRDLVGRSLQRQGLAPVRWLGQDESGSEGRRIRNTRLKQLGYQLQHPSVDQSDVCAASQVN

SEQ ID NO: 74308 - protein, 445 aa, delta proteobacterium MLMS-1
MPKAKPDVMAVVLAGGRVDELSVLTAHRPKSAVPFGGFARVIDFALSNLMQSGLELVAVLSQYRSFSLINHIGIGASWDMIGRHRGVFVLPPYQGFGQSSWYRGTADAVRQNLDFIQFHAPETILVISGDHVYHMDYREIIAYHRQKGADCTFACVEVPAPLAHRFGVAEIDDEDGRIGGRVLQYQEKPAEPCSRWASMTVYCFKPRVLYELLAANAREDESFEFGRDILPRAMATHRKVYGYKFRGYWGYTRTIEEYWQTSMDLLGYQPRLPLEQWGIRTNLEQRDIRDCPPLKVGEGAVISNSLVYNGCQVEGRVENSVLFPGVQVKPGAVVRDSVLFFDNVVGRDCHLEKVVSDVNVTVGDGVVIGVPGPPAAGGATGAGRASGAENLAGGESGGATTTVTVLGWNNQIPAGMVIGAGCTLYPSLGPEKMARQRVADGEVLR

SEQ ID NO: 74309 - protein, 466 aa, Mycobacterium sp. MCS
MTHYDVVVLGAGPGGYVAAIRAAQLGLNTAIVEPKYWGGVCLNVGCIPSKALLRNAELAHIFTKEAKTFGISGEATFDYGAAFDRSRKVAEGRVAGVHFLMKKNKITEVHGYGKFTDDHTIEVDLNEGGTETLTFDNAIISTGASTKLVPNTSLSENVVTYEEQIMERELPGSIVIAGAGAIGMEFGYVMKNYGVDVTIVEFLPRALPNEDAEVSKEIEKQFKKLGVKIMTGTKVESIKDEGGDGSVTVTVSKDGKSQELKTDKVLQAIGFAPNVEGYGLDKAGVELTDRKAIGIDDYMRTNKPHIYAIGDVTGKLQLAHVAEAMGVVAAETIAGAETLPLGDYRMMPRATFCQPQVASFGLTEEQAREEGYDVKVAKFPFTANGKAHGMGAPGGFVKLIADAKYGELIGGHLIGHDVSELLPELTLAQKWDLTANELARNVHTHPTLSEALQEAFHGLAGHMINF

SEQ ID NO: 74310 - protein, 421 aa, delta proteobacterium MLMS-1
MSRKQDDPLVLLLAGGVGSRLNNLVQSRAKPAVPFGGIYRIIDFSLSNVMNAGFSQVGVLTQYKPLSLMRHIGDGAAWDFAGRTRGAKILPPRTGSRDSDWYKGTADAVRQNIDFIRSYPSPEVVILSGDHIYSMDLADLVGSHRRKKADLTVATMVVPKEQIHQFGAAITDAQGRIVEWEEKPAVPRTDLASMGIYVLSTDYLLNYLEKYRDDLDFGMDLIPRAIATDRVFAYPFRGYWRDVGTIQAYWEANMDLLAADSPLNPAAWGTRPNPEAEGLPYDRCPARFMGDGTVRQSLIPAGCIIEGTVLNSVLAPGVRVGPGAVVRDSILFHDCRVAAGATVDLAILDKRVQVGEKAVVGQGEDKTVANRANPKHLYSGISLIGKQARIPAGAVIGRNCIIAPHSRSQQVPAQLPTGESV

SEQ ID NO: 74311 - protein, 483 aa, delta proteobacterium MLMS-1
MSEQKESGTGPLVPTILCGGVGSRLWPVSRAHYPKPFIRLADGQSLLQKALLRGAGLPGVAEIQTVTNRELFFNTVDEYTAVAAGADLPATSFILEPCGRNTAAAVAVAALRAARVYGEAAILLVLAADHLIADQDAFAEAVARARALAAQGRLVTFGIAPDRPETGYGYIEAAGDRVLRFIEKPSREQAESYLAAGRFYWNSGMFAFAAGVVLEEMARCSPAILAACRQTLEHSAAEVIEGDRHRLVLDAESFAAVPADSIDYAVMERSDRLAVVPCSIGWSDIGSWTALAELDQPDAAGNRCRGEVVARESRDCVIHGQDRLIGTLGIDNLIVVDTPDALLVANRQRAQEVKALYGELVARRHPAAHFHSTVHRPWGTYTVLEQGEGFKIKRIEVKPGATLSLQMHHHRSEHWVVVSGMARVINGEREYFVNTNESTYIPAGCRHRLENPGMLKLVMIEVQSGAYLGEDDIVRFEDDYGRL

SEQ ID NO: 74312 - protein, 328 aa, Synechococcus sp. PCC 7002
MTRQKNELMKTRQLGQSAVQITPIILGTWQAGKRNWADIDDQEIVAGIRAAVDAGITTIDTAEIYGDGDSERRVAEAIAPQRDQVTLLTKVFANHLHHDQVITACENSLNRLQTDYIDLYQIHWPAGTWNSDLVPIAETMAALNQLKEQGKIRAIGVSNFSLAQLQEAMEHGQIDSIQPPYSLFWRAIEREIQPFCAAQQISILAYSSLAQGLLTGKFGPDHQFAAGDHRSHNRLYADPENYQRVQTALGLLKPIATTKNCTLAQLAIAWLIRQPQTNAIVGARNAQQAIANAQAIDVELTAKDLEAIDHIGRTVTDPLDENPLLWNW

SEQ ID NO: 74313 - protein, 288 aa, Zea mays
VADDAVSTTRTGLMVVGAGRGPLVRASLQAAEETGRKLKVYAVEKNPNAVITLHSLIKLEGWESLVTVISSDMRCWDAPEKADILVSELLGSFGDNELSPECLDGAQRFLKPDGISIPSSYTSFIQPITASKLHDDIKAHKDIAHFETAYVVKLHRIATLAPPQQVFTFTHPNFSPNASNQRYTKLQFEMLPDMGSCLVHGFAGYFDSVLYKDVHLGIEPNTATPNMFSWFPIFFPLRKPIYVPEGSPIEVHFWRCCAPTKVWYEWAVTTPTPSPIHNSNGRSYWVGL

SEQ ID NO: 74314 - protein, 362 aa, Bacillus halodurans C-125
MKRQLILEDGSVFVGKGFGSDREMSGEVVFNTGMTGYQEMLSDPSYCGQIVTLTYPLIGNYGINRDDFESMNPAIHGLIVKEACDIPSNWRSEESLDSLLKAKQIPGLSGIDTRKLTRLIRMHGTLKGQLCPLDVDVEQIVQELKATPTPTDQVSRVSTRDPYHVPGPGKRVVLVDYGMKHNILQELIRRNCEVFVVPYHTSAEEVLRLGPDGVLLSNGPGNPEDVSEGVEMIRNLLGKVPLFGICLGHQLFALACGAKTEKLRFGHRGSNHPVRERSTGLIEITAQNHGYTVTEGSLVNTDLIVTHEAVNDGTIEGLAHKVHPAFSVQYHPEASPGPEDSNVLFDRFIKLMESNKHRALTV

SEQ ID NO: 74315 - protein, 587 aa, Arabidopsis thaliana
  misc_feature (54)..(54): Xaa can be any naturally occurring amino acid
  misc_feature (76)..(76): Xaa can be any naturally occurring amino acid
  misc_feature (117)..(117): Xaa can be any naturally occurring amino acid
  misc_feature (129)..(129): Xaa can be any naturally occurring amino acid
MEVQSSSNNGGHSSFSSLRVYLNSLSATPSRLSRRAISVSTSSDEMSRVRAVSXGEQMRRTLRWYDLIGLGIRGNXVGAGVFVTTGRASRLDAGPSIVVSYAIAGLCALLSAFCYTXEFAVHLPVAGGXAFSYIRITFGEFPAFFTGANLVMDYVMSNAAVSRSFTAYLGTAFGISTSKWRFVVSGLPKGFNEIDPVAVLVVLVITVIICCSTRESSKVNMIMTAFHIAFIFFVIVMGFIKGDSKNLSSPANPEHPSGFFPFGAAGVFNGAAMVYLSYIGYDAVSTMAEEVENPVKDIPVGVSGSVAIVTVLYCLMAVSMSMLLPYDLIDPEAPFSAAFRGSNGWEWVTKVVGIGASFGILTSLLVAMLGQARYMCVIGRSRVVPFWFAKIHPKTSTPVNASTFLGIFTAALALFTDLNVLLNLVSIGTLFVFYMVANALIFRRYVPVGPTKPWPTLCFLTLFSITSLVFTLIWKLVPEGKPKAFMLGASAVVAIAIVLSFQCVVPQARKPELWGVPFMPWTPCVSIFLNIFLLGSLDAPSYVRFGFFSGLIVLVYLFYGVHASSDAEANGSFGVKDGQVMKELIEV

SEQ ID NO: 74316 - protein, 95 aa, Vitis vinifera
MASQKERSQLDAKARQGETVVPGGTGGKSLEAQEHLAEGLSRGGQTRKEQLGTEGYHEMGRKGGLSTGDQSGGERAEEEGIPIDESKSRTKSEIK

SEQ ID NO: 74317 - protein, 93 aa, Vitis vinifera
MASRQENRAELDAKARQGQTVVPGGTGGGSLEAQEHLAEGWSRGGQARKEQIGREGYQEMGRKGGLSTVDQSGGERAEQEGIPIDESKFRTKT

SEQ ID NO: 74318 - protein, 114 aa, Brassica oleracea
MGLDFAKLVMVGLDAAGKTTILYKLKLGEIVTTIPIIDKLFFSICFNVETVEYRNISFIVWDVGGQDKIRPLWKYYFQNTQGLIFVVDSNDRDRVVEARDELHRMLNEVTGMFL

SEQ ID NO: 74319 - protein, 394 aa, Anaplasma phagocytophilum HZ
MLSERMNCIKPSPTLELSRLTLELRAQGLDIISLGAGEPDFDTPDHVKDAAIAAINAGKTKYTPVEGIPELKDSIIRSVRRDYGIDYVANQVLVGAGAKQCIYNLFMATINEGDEVIIPAPYWVSYPDMVKIAGGAPVIVNCGDYLKLTPELLRGAITPKTKWLIINSPSNPTGAVYSREELAAIAEVLKQHKHVLVITDDIYAKLVYDAEFCGILQVEPSLYDRVYIVNGVSKAYSMTGWRIGYILGNAEAIKAVSTIQSQSTTNANSIAQYAAIAALDGDQSFLDTRIKAFARRRDRVMDAVLSSGVLQADVPQGAFYVFISCGNAIGKHAPKVGVINDGSDMAKHLLNHRVAVVPGVAFGAPNFFRISYALSDDRLSEACERILEACSYLS

SEQ ID NO: 74320 - protein, 176 aa, Picea sitchensis
MAKSSSWAHALVQISPYAYSAVGIGIAIGVSVLGAAWGIYTTGSSLIGAAIKAPRITSKNLISVIFCEAVAIYGVIVAIILQTKLESVPSTNMFAPEAMRAGFAIFASGVIVGFANLVCGVCVGIIGSSCALADAQNSSLFVKILVIEIFGSALGLFGVIVGIIMSAQAAFPTKVQ

SEQ ID NO: 74321 - protein, 714 aa, Mycobacterium leprae TN
MADTAIQWSKDADGIVTLTMNDPSRSANVMNEIYIESMGNAVDRIVAEKDSITGVVITSAKRTFFAGGDLTAMINTGSEEAGQCFDTVETVKKQLRTLETLGKPVVAAINGAALGGGLEIALACHHRIAADVKGSQLGLPEVTLGLLPGGGGVTRTVRMFGIQNAFVNILSQGTRFKPAKAKEIGLVDELLSTVEELVPAAKAWIKANPEAHEQPWDKKSYEMPGGTPTSPGLAAILPSFPSLLRKQLKGAPMPAPRAILAAAVEGAQVDFDTASRIESRYFVSLVTGQVAKNMIQAFFLDLQHINSGGSRPDGIGKTPIKKIGVLGAGMMGAGIAYVSAKAGYNVVLKDVSLEAAQKGKSYSEKLEAKALERGRTTQEKSDVLLACIAPTGDPTDLKGVDFVIEAVFENQELKHKVFQEIEDIVDPNAVLGSNTSTLPITGLATGVKRQEDFIGIHFFSPVDKMPLVEIIKGEKTSDEALARVFDYALAIGKTPIVVNDSRGFFTSRVIGTFVNEALAMLGEGVEPSSIEQAGAQAGYPAPPLQLSDELNLELMHKIAIATRKGVEDAGGMYESHPAETVVEKMIKLGRSGRLKGAGFYEYVDGKRSGLWLGLRETFKSGSSQPPLQDMIDRMLFAEALETQKCLDENVLTSTADANIGSIMGIGFPPWTGGSAQFIAGYSGPAGTGQQAFVSRARELVAKYGDRFLPPESLL

SEQ ID NO: 74322 - protein, 437 aa, Nostoc sp. PCC 7120
MRRIGEKHMVSMPTLPLEGASPAHICPFDQACSYLEAAAKELRLDQGALEILSHPRKVVTVSIPVRLDNGDIRVLAGHRVQHSDILGPYKGGTRYHPAVTLREVSALAMLMTWKCALLGIPYGGAKGGIAIDPEHYSVGELERITRRYTSELIKDIGPSVDIPAPDVGTSAREMAWMMDTYSMNVGHAVPGVVTGKPISIGGSRGREMATGRGVMIIVREALADMGRTLEGVKVVIQGFGNVGGAAAELLYQAGAKILAVSTGAGGLFASDGLDIPALKAYAAENHRSIVGFPQAVPISNAELLTLPCDVLIPAALENQITEENVDQIQAQIVAEAANGPVTLEANRVLEGRGVTVLPDILANAGGVVVSYLEWVQGLSYLFWDEERVNREMEHLMVQAYHQVIKQSQMRQVPLRLAAYTLGVGRVAQALSDRGLYP

SEQ ID NO: 74323 - protein, 335 aa, Triticum aestivum
  misc_feature (112)..(112): Xaa can be any naturally occurring amino acid
  misc_feature (129)..(129): Xaa can be any naturally occurring amino acid
  misc_feature (155)..(155): Xaa can be any naturally occurring amino acid
  misc_feature (200)..(200): Xaa can be any naturally occurring amino acid
AYLGDTIEQVCTKKQAGTGPEFPGYRRPTRPLFCTPGALQYLSGVILFEETLYQSTKGGKPFVDILKAGNVLPGIKVDKGTIELAGTNGETTTQGFDDLGKRCAKYYEAGAXRFAKWRAVLKIGATEPXSQLSIDQNAQGLARYAIICQENGLVXPIVEPEILVDGPHDIDRCAYVTEIVLAACYKALNDQHVLLEGTLXLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 74324 - protein, 310 aa, Anabaena variabilis ATCC 29413
MDNFILFAGTANPDLAGTVAQKLDIPLGKSAVERFPDGEVNVRLLESVRQKSVFILQSTAPPVNDHLVELLAFADACRRAAASRITAIIPYFGYARADKRHGRREPITASMVAEVLQAVGVNHVVTLDLHTLQIEGFFRIPVDSLTAVPIFCEAIRHYLPPNFVVVSPDTGRVQMATQYAQKLDSSVVVLHKHRTSGTETEVTRVVGDVKGYACLIIDDMISTGGTLAKSIEALLKAEARPEIIIAATHGLFVKEARAKLSHPSVKAIFVTDSVTSKETDWQQLKIVSIAPLVATTIQRFKTDGSISDLF

SEQ ID NO: 74325 - protein, 669 aa, Streptococcus suis 89/1591
MNTKKWRTSLLIPGIVLFGTVALVNNVSAQEVKNTIISAKQPDGRQATSKAVNVKIPAVVRLFGRELLENEFKFELREANSEKLIDTTQNTKEGQVSFKNLSFNKPGEYWYTISEVKNELSGVEFDSKYIVAKITVEDRNNGQLQAMIEFIADDNVFNNFYTPAPAAASLSIKKVLEGRTLNTGEFEFVLKNEKGDEIEKVSNQADGSVNFSALTFTKEGTYTYTVSEVDGGLGDIIYDKSDIKATVTVKDNNHGQLVSTVTYENSDQIFENILNPGKLITPTTDSVITDNEVSKEAMTDKEKGNIEPPKEQIATEEKDNIEASEKQMPSIVNDMVVTPEKQMTNKENDNVETSEKQMPSVMNENAVTPEKQMTNKENDNIETSEKQMPSVMNENAVTPEKQMTNKENDNIETSEKQMPSVMNENAVTPEKQMTNKENDNIETSEKQMPSVVNENAVTPEKQMTNKENDEVVISEKQMPSVMNENAVTPEKQMTNKENDNIETSEKQMPSVVNENAVTPEKQMTNKENDEVVISEKQMPSIVNDMVVTPQEQMANKENDNVETSEKQMPVNEKDNAVTPERQIANKEKENIETSKKQIPVNGNNQNGTVGENSNTKPTTEKTDKQETSTFKTETAKQILPVTGEKGSLWLLTSGIIGLAIALFTRKRKL

SEQ ID NO: 74326 - protein, 574 aa, Schizosaccharomyces pombe 972h-
MLSKFYEDIDSKLENAMLSQIESSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLSVGNSASYAASRALFALAKNGYAPKIFNKTNKRGHPIYAIAVTLLFGSIAYFTEAGVGGALFGWLLSICGLSTTFIWGSICLAHIQFRRAWKIQNRKLEDLPYRSIFGVYGSIYGVAMTILALIAQFYVAVFPIGKKPNPVDFFQAYMAAPILIISFVAWKFFRRTSFVRIEKIDLSEGAHGEQKQNLEPVINIPVEEIDFPMKVATKESMKNVEKNAL

SEQ ID NO: 74327 - protein, 308 aa, Glycine max
  misc_feature (133)..(133): Xaa can be any naturally occurring amino acid
MTGGGSTGRLPTWKERENNKRRERRRRAIAAKIYTGLRAQGNYKLPKHCDNNEVLKALCAEAGWIVEEDGTTYRKGCKRPTSEIGGTPLNLSACSSIQASPQSSSYPSPVPSYHASPTSSSFPSPTRIDGKPXSSFLIPFIRNITSIPANLPPLRISNSAPVTPPLSSPRSSKRKADFDSLRHPLFATSAPSSPTRRHHVATSTIPECDESDASTVDSASGRWVSFQVQTTMVAAAAAAPPSPTFNLMKPAMQQIAAQEGMQWGSVAERGRGGSDFDFENGRVKPWEGERIHEVGMDDLELTLGVGKA

SEQ ID NO: 74328 - protein, 334 aa, Staphylococcus aureus subsp. aureus MSSA476
MSQERYSRQILFKQIGEIGQSKINQKCALIIGMGALGTHVAEGLVRAGIAKLIIVDRDYIEFSNLQRQTLFTEEDALKMMPKVVAAKKHLLALRSDVDIDDYIAHVDYYFLETHGQDVDVIIDATDNFETRQLIDDFAYKHRIPWIYGGVVQSTYTEAAFIPGKTPCFNCLVPQLPALNLTCDTVGVIQPAVTMATSLQLRDAMKVLTEQPIDTKITYGDIWDGSHYSFGFSKMQRSDCTTCGDVPSYPYLNKNEQRYATLCGRDTVQYENASITHDILVQFLKQHQLNYRSNSYMVMFEFKGHRIVAFKGGRFLIHGMTRTSDATHLMNLLFG

SEQ ID NO: 74329 - protein, 293 aa, Brassica napus
MGGGRVMATAAKVAGIGVAKGGFRGGFGVPAAANDQFIVRNTSASKPVSASISSAVHPSVEEDAVVMRKPVWEDEWEFAEVETKTIPRVVFDKPPSLQEAKEATDDLKDALNMACMEGSNEVGSVSRMFSSFQPARGRAVESAVPQVALKAFAFLSENTAAQSVVASIASDPKVWDAVMENKDLMKFLETNISVAAASTTVEADNDDKSELSSETESEEESEAKPINLMEILRDMKLKPVQMMENVSSYFGGLFRTETFTKGGQERKRMLLNDPTTLFGLAVCVIFMVVLKRA

SEQ ID NO: 74330 - protein, 635 aa, Gluconobacter oxydans 621H
MSLLTITDLTLRIAGRTLLDNASLSVDPGRKIGLIGKNGAGKSTLLAAIAGDFAPDGGTITLAARATMGRVKQETPSGSTSILDTVLEGDLERTRLLAEAETATDPVRIADVHERLIAIDAYTAPARAGAILSGLGFDQDAQNRAVSDFSGGWRMRVSLATALFLNPDLLLLDEPTNHLDIEATLWLESWLAKFSGAAIIVSHDRSLLDNTVDAIAHLDHQKISVTPGGYDNFVRIRTEQALQQNRAAERIAAQRAHMQSFVDRFRAKATKAKQAQARLKALERLPQIDSVVEDTPTRFSFPEPQPLPPPMLSLNNVSLGYDGRVVLKGLNQRLDMEDRIALLGQNGRGKSTFAKLLAGRLEPMSGTYTHSPKLKIGYFAQHQSDELVLTDTPIDHMSRAMPDALPAAVRAQLARFGLDENRAETKVGELSGGEKARLLLALSTREAPHLLILDEPTNHLDLDARDALIRALSEFEGAVVLISHDSHLVESVADRFWLVEDGTIAPFEGDMAEYRAWLLERARKARAEMAERNKAATTSENSGSSSAQKRIDRKEQTRALAPLRRKIRDAESKMAQLTGEKTKIEARLANPALYQSGDAAEVTSLNVHLAALNATLETVEESWLEAQAELENATG

SEQ ID NO: 74331 - protein, 380 aa, Streptomyces avermitilis MA-4680
MTTSTRGAAKVPAVLVLEDGRTFRGRAYGAVGVTFGEAVFSTGMTGYQETLTDPSYHRQVVVMTAPHVGNTGVNDEDPESKRIWVSGYVVRDPARVPSNWRSRRSLDEELRHQGVVGISGIDTRALTRHLRESGAMRVGIFSGSALPDEGTMLAEVRQAPEMKGANLAAEVATKETYVVPAIGAKRFTVAAVDLGIKGMTPHRMAERGIEVHVLPATATAEDVYAVNPDGVFFSNGPGDPATADGPVAVMREVLARKTPLFGICFGNQILGRALGFGTYKLKYGHRGINQPVQDRTTGKVEVTAHNHGFAVDAPLDQVSDTPYGRAEVSHVCLNDNVVEGLQLLDQPAFSVQYHPEAAAGPHDAAYLFDRFVSLMEGQRA

SEQ ID NO: 74332 - protein, 140 aa, Gluconobacter oxydans 621H
MALERTLSIIKPDATKRNLTGKINAVFEGAGLRIVAQKRIQLTEKQAGAFYAVHKERPFYGSLVSSMIAEPVVVQVLQGENAVAKNREVMGATNPADAAEGTVRKLFAESIEANSVHGSDSLENAKNEISFFFAETEILP

SEQ ID NO: 74333 - protein, 411 aa, Brassica napus
MNALAATNRNFRHASRILGLDSKIERSLMIPFREIKVECTIPKDDGTLVSFIGFRVQHDNARGPMKGGIRYHPEVDPDEVNALAQLMTWKTAVADIPYGGAKGGIGCNPRDLSLSELERLTRVFTQKIHDLIGIHTDVPAPDMGTNAQTMAWILDEYSKFHGHSPAVVTGKPIDLGGSLGREAATGRGVVYATEALLAEYGKSIQGLTFVLQGFGNVGTWAAKLIHEKGGKVVAVSDITGAVRNPEGIDINALLKHKDATGSLKDFNGGDAMDSEELLLHECDVLIPCALGGVLNKENAGDVKAKFIIEAANHPTDPDADEILSKKGVIILPDIYANAGGVTVSYFEWVQNIQGFMWEEEKVNLELQKYMTRAFHNIKSMCHTHSCNLRMGAFTLGVNRVARATQLRGWEA

SEQ ID NO: 74334 - protein, 228 aa, Bacillus halodurans C-125
MSVKDQLKQIQEQMNEACERAGRNPDDVHIIAVTKYVSEARTREALEAGITHIGENRVEGGVEKRRAFPNEGTWHFIGSLQSKKVKKMIADFDYLHSLDRLSLAKEIDRRLPDGQALNCFVQVNVSGEQSKSGLKPEEVLPFIEELQTYPSIRVVGLMTMAPFVEDPEDTRWVFRELRHLRDEVQAKRFNHAPCSELSMGMSNDFIVAIEEGATFVRIGTALVGKEVD

SEQ ID NO: 74335 - protein, 400 aa, marine gamma proteobacterium HTCC2143
MTSSHAVLKLKSQADRRLRAGHLWIYSNEVDVQATPLKDFEPGQQVRVENSAGKAMGLAYINPHSLICGRVFGRDIRYPLDKSLLVHRLNVALSLREGMTDKPYYRLVYGDSDFLPGLVVDRFADVVVVQIATAGMEAVKQDIIDALVQVLKPEGILLKNDSRIRVSENLPEYVDVVYGQVPERVVMEENGVKFSVPVFSGQKTGWFYDHRANRLRLADYVRGKRVLDVFSYIGGWGVQAAVFGAESVSCIDASEFALDGVDVNAELNQVSDKVGTIQGSAFDAMKMLINEGERYDVVIVDPPAFIPKRKDVKSGEQAYRRINELAMRLLSKGGLLVSASCSMHLGRDRLTDILRASARHLDRDLQILEQGGQCFDHPVHPAITETEYLKAVFARVLPAN

SEQ ID NO: 74336 - protein, 569 aa, Mycobacterium leprae TN
MTAPKIEAVYTVGAYLLDRLAELGVTEIFGVPGDYTLEFLDHIVAHPTIRWVGNANELNAGYAADGYGRLRGISALVTTFGVGELSAANAIAGSYAEHVPVVHIVGAPPKDAQSTHRALHHSLGDGDFEHFIRISSEITCSQANLTTATACKEIDRVLSEVRKHKRPGYILLSTDVARFPTEPPAAPLPGHTDGTSPRALSLFIDAATKLIADKRMTVLADLLVHRLQVVKELETLLTADVVPYATLMWGKSLLDESSPNFLGIYAGAASTEAVRAAIEQAPVLVTAGVVFTDMVSGFFSQRIDPARTIDVGQYQSSVADKVFTPLEMGDALEALASILVRRGVSSPPVELPPGNPTADTPSPTQRLTQQILWDRLCAALTPGNVVLADQGTAFYGMVEHRLPRGVTFIGQPLWGSIGYTLPAALGAGLAHRNRRTVLLLGDGAAQLTIQELGSFYREGLSPVIVVVNNDGYTIERAIHGATAPYNNIARWRWTDIPGALGVANHSSFRAETYGELDEAFAVAAELKDQMVFVEVIVPKLDLPSLLTALTRPAQDSNRIFQLPNPGWDN

SEQ ID NO: 74337 - protein, 539 aa, Rhodobacter sphaeroides 2.4.1
MTAGGERVTERGTGSDPVDLFIIGGGINGCGIARDAAGRGLSVTLAEMGDLAQATSSASTKLFHGGLRYLEYFEFRLVREALEERETLLVAMPHISWPMRFVLPWQPEMRFAGDTPTARLLGRLMPWARGRRPAWLIRLALETYDRLGGRKILPPARSVDLTRDPAGRALQPRFTKGWEYSDCWVEDSRLVVLNARDAEIRGATILTRTKVVGAERRGDLWHVTTEGARGRQVHRARALVNAGGPWVARIIRETLALPTTEGVRLVRGSHIVTKRLFDHDRCYFFQGTDGRIIFAIPYETDFTLIGTTDQDHRGAPDEARCTPEEQDYLCTFASDYFRKPVTREDIVWTYSGVRPLHDDGARSATAATRDYVLSLDSRGAPLLNVFGGKITTYRRLAESAMAKLAGHFPQARGAWTARVPLPGGDFPWDGAPALAEGLRRDYPFLTERWAMRLVRAYGTDARNLLGPARSALDLGRDFGATLTEAEVRWLMDREYAERAEDVVWRRSKLGLRLTPEEIAALDGWMKDAGGAMEARADTG

SEQ ID NO: 74338 - protein, 765 aa, marine gamma proteobacterium HTCC2143
MMRKNMLESLRRIVQEVNTAGNLQAVLDVAVLRVRRAMGTEVCSVYLREPSLGRLVFSATQGLNKDFVGKVSMAANEGLVGQVAGREEPLNLEHAEAHAAFLLMPGIGEERFSSFLGVPIIHQRQVLGVLVVQQQERRRFNEDDEAFLVTVSAQLAGVIAHAQATGSIVTLEAGQEKHRSARFRGVAGAPGIAIGETAIITPFADLYAVPMRRCKDIDEERDFFRECIEAVKEDMRALGRKFSRRLVPQEQALIDVYLHMLDDNALAGEVDARISRGEWAQGALSKVIIQHLRTFETMSDEYLKERATDVKDLGRRILAYLQSANSGPKEYPARTILVGEELTASMLAEVPPENLVGLVSIRGSSNSHVAILARSMGIPTVMGAVDLPFTQLEGREIILDGYNGHVYFNPSAELYGRFQAIYEGEQQLSKGLEALKDLPCITTDDVRMPLWVNTGLQADIARSLDRGAEGVGLYRTEVPFLLRERFPSEEEQRQIYREQLQAFAPMPVTMRTLDVGGDKSLPYFPIEEDNPFLGWRGIRVTLDHPEIFLVQVRAMMKANAGLGNLQIMLPMISSVPELEEALELIYRAHDELIVELGVDLEIPVVGVMVEVPAAVYQAREFAKRVGFLSVGSNDLTQYLLAVDRNNARVADIYQAYHPAVLQALQKVVDDGHAEGRKVSICGELAGDPAAAILLTAMGYDVLSMNATNLPRVKLVLRSISSVRARELLREVMTMESAHQIQAFMEQALIDTGVQQLVRPQVAEIA

SEQ ID NO: 74339 - protein, 1518 aa, Saccharomyces cerevisiae YJM789
MTGHVSKTSHVPKGRPSSLAKKAAKRAMAKVNSNPKRASGHLERVVQSVNDATKRLSQPDSTVSVATKSSKRKSRDTVGPWKLGKTLGKGSSGRVRLAKNMETGQLAAIKIVPKKKAFVHCSNNGTVPNSYSSSMVTSNVSSPSIASREHSNHSQTNPYGIEREIVIMKLISHTNVMALFEVWENKSELYLVLEYVDGGELFDYLVSKGKLPEREAIHYFKQIVEGVSYCHSFNICHRDLKPENLLLDKKNRRIKIADFGMAALELPNKLLKTSCGSPHYASPEIVMGRPYHGGPSDVWSCGIVLFALLTGHLPFNDDNIKKLLLKVQSGKYQMPSNLSSEARDLISKILVIDPEKRITTQEILKHPLIKKYDDLPVNKVLRKMRKDNMARGKSNSDLHLLNNVSPSIVTLHSKGEIDESILRSLQILWHGVSRELITAKLLQKPMSEEKLFYSLLLQYKQRHSISLSSSSENKKSATESSVNEPRIEYASKTANNTGLRSENNDVKTLHSLEIHSEDTSTVNQNNAITGVNTEINAPVLAQKSQFSINTLSQPESDKAEAEAVTLPPAIPIFNASSSRIFRNSYTSISSRSRRSLRLSNSRLSLSASTSRETVHDNEMPLPQLPKSPSRYSLSRRAIHASPSTKSIHKSLSRKNIAATVAARRTLQNSASKRSLYSLQSISKRSLNLNDLLVFDDPLPSKKPASENVNKSEPHSLESDSDFEILCDQILFGNALDRILEEEEDNEKERDTQRQRQNDTKSSADTFTISGVSTNKENEGPEYPTKIEKNQFNMSYKPSENMSGLSSFPIFEKENTLSSSYLEEQKPKRAALSDITNSFNKMNKQEGMRIEKKIQREQLQKKNDRPSPLKPIQHQELRVNSLPNDQGKPSLSLDPRRNISQPVNSKVESLLQGLKFKKEPASHWTHERGSLFMSEHVEDEKPVKASDVSIESSYVPLTTVATSSRDPSVLAESSTIQKPMLSLPSSFLNTSMTFKNLSQILADDGDDKHLSVPQNQSRSVAMSHPLRKQSAKISLTPRSNLNANLSVKRNQGSPGSYLSNDLDGISDMTFAMEIPTNTFTAQAIQLMNNDTDNNKINTSPKASSFTKEKVIKSAAYISKEKEPDNSDTNYIPDYTIPNTYDEKAINIFEDAPSDEGSLNTSSSESDSRASVHRKAVSIDTMATTNVLTPATNVRVSLYWNNNSSGIPRETTEEILSKLRLSPENPSNTHMQKRFSSTRGSRDSNALGISQSLQSMFKDLEEDQDGHTSQADILESSMSYSKRRPSEESVNPKQRVTMLFDEEEEESKKVGGGKIKEEHTKLDNKISEESSQLVLPVVEKKENANNTENNYSKIPKPSTIKVTKDTAMESNTQTHTKKPILKSVQNVEVEEAPSSDKKNWFVKLFQNFSSHNNATKASKNHVTNISFDDAHMLTLNEFNKNSIDYQLKNLDHKFGRKVVEYDCKFVKGNFKFKIKITSTPNASTVITVKKRSKHSNTSSNKAFEKFNDDVERVIRNAGRS

SEQ ID NO: 74340 - protein, 298 aa, Vitis vinifera
MTSILTSRSKAACGLTDKKPKEQIVDIDAADANNELAVVEYVEDIYKFYKLIESESHIHDYMDSQPEMNEKMRSILVDWLIEVHHKFELMPETLYLTINIIDRFLSVKTVPRRELQLVGISAMLIASKYEEIWAPEVNDFVCISDRAYSDQQIRNMEKAILGRLEWTLTVPTPYVFLVRFIKASIPDQEMEHMVYFYAELGLANYATMMYCSSMFAASSVYAARCALNKSPVWDETLKAYTGFSEAQLLDCAKLLASFHSMAAENKLIKAVYRKYSQPHRSGVAFRPPAKVLLAAAAS

SEQ ID NO: 74341 - protein, 426 aa, Polaromonas sp. JS666
MSVWALGLNHTTAPLDLRGRFAYALDQIEPTLRGLRESLARQPEATLLSTCNRTEIYCAGDHNDLEHTLEWLAHNGGVSPALLRSHAYTLQDDQAARHAFRVASGLDSMVLGEPQILGQLKDAVRAAEDAGAMGSTLHQLFQRSFAVAKEVRTSTEIGAHSISMAAASVRLAGQLFENLGDIRVLFVGAGEMIDLAATHFAAKTPKSMAIANRTLERGEKLASRFGAEVMRLADLPSRLHEFDAVISCTASTLPIIGLGAVERAVKLRKHRPMFMVDLAVPRDIEPEVKDLPDIYLYTVDDLAHVVQTGKDNRQAAVAQAEVIIDAGVQNFMHWLGQRRTVPLIQQLNAQTDEWRAAEIARAKKLIAKGEPMDAVLDALTRGLTQKMLHGALAELHAGDAASREATAHTVSRLFLRGQPPKEHKER

SEQ ID NO: 74342 - protein, 153 aa, Ustilago maydis 521
MAVTNAVSWRSEGIRYRKNEVFLDVVESVNLLVSANGNVVRSEILGAIKMKCYLSGMPELRLGLNDKVMFENTGRAARGKSIEMEDVKFHQCVRLSRFENDRTISFIPPDGEFELMSYRLSTQTWVRYITQHGEYDLRTQSEKPSARLAPFSA

SEQ ID NO: 74343 - protein, 540 aa, Oryza sativa Japonica Group
MQAWFSGTGPSASSASSSSSPPQPSLLAEWNSYAAARSAEEEEDGGGGGFGIDIEAAVRSANDRVSGTFGVVSKGVLGLPGSFKSTTSSVPSSKSLVYFGLFLASGIFLVFIAFTIFLPVMRLPFTMGFVGSMAATIYVSMVLHSYILSVFFSCLQNLTGILGGMARLPYPGTGDGVFAAHGYLRFGLGIWYILSLSLSAYELIKTAKYIATPGKGILAADESTGTIGKRLASINVENVEPNRQALRELLFTTPGAFQYLSGVILFEETLYQSTAAGTPFVDVLKAGGVVPGIKVDKGTVDIAGTNGETTTQGLDSLGARCAKYYEAGARFAKWRAVLKIGAAGEPSELAVKQNAEGLARYALICQENGLVPIVEPEILTDGAHDIKTCAAVTERVLAAVYKSLNDHKVLLEGTLLKPNMVGAEVIGEYTVAALRRTVPPAVPGIVFLSGGQSEEEASQNLNAMNKLEVLKPWTLTFSFGRALQQSTIKKWGGKKENVAAAQAAFLARCKANSEATLGKYGGAAGDAATSESLYVKGYTY

SEQ ID NO: 74344 - protein, 352 aa, Oryza sativa Japonica Group
MELSLTMVTEALAQAGLESSNLIVGIDFTKSNEWTGKLSFNRRCLHDIGNTPNPYEQAISIIGRTLSAFDEDNLIPCFGFGDASTHDQEVFSFYPENRPCNGFEEALERYREIVPTLRLAGPTSFAPMIETAIGIVDSTGGQYHVLLIIADGQVTRSVDTQSGQLSPQERDTIDAIVKASQFPLSIVLVGVGDGPWDMMHQFDDNIPARSFDNFQFVNFTDIMSKSIAADRKEAEFALSALMEIPTQYKATLDLQLLGRRQRIQPRIPLPPPMRNAYSRSTSFDQHSGVYSRSSSFGPQTSGFQQSESFKQRQPVATTAPDTYTSESSLEGRLLCAICMDKSKDLAFGCGHQ

SEQ ID NO: 74345 - protein, 981 aa, Oryza sativa Japonica Group
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRDANGHGTHTLATAGGSAVRGAEAFGLGGGTARGGSPRARVAAYRVCYPPFNGSDACYDSDILAAFEAAIADGVHLGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKVRNFSWRELDVAPRAHERRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 74346 - protein, 333 aa, Thiomicrospira crunogena XCL-2
MTIKVGINGFGRIGRMAFRAAAKDFANIEVVAINDLLDPEYLAYMLKYDSVHGRFDGTVEVKDGNLVVNGKTIRITAERNPADLAWSDVGADLVIECTGFFLTEESCQAHIEAGAKKVVQSAPSKDHTPMFVYGVNHEEYAGQAIVSAASCTTNGLAPVAKVLNDNFGIKRGLMTTVHAATATQKTVDGPSMKDWRGGRGILENIIPSSTGAAKAVGKVLPALNGKLTGMAFRVPTSDVSVVDLTVELEKETSYDDICAAMKKASEGEMAGVLGYTEEANVSTDFRGDSHPSIFDAKAGIALDPTFVKVVAWYDNEYGYTCNMMRVVEHVGNN

SEQ ID NO: 74347 - protein, 361 aa, Ustilago maydis 521
MSASSSAISPSASHLGADPKIVRRLSSVSHIILVLSGKGGVGKSSVSAQLALSLSSSASPSDRSRMARVGILDIDLTGPSIPRMLGLGGASVKQSTDGWVPVYTDASQHLAVMSVGFLLRSKNDSVVWRGPKKNAMIKQFLGDVRWGTLDYLIIDTPPGTSDEHISILEYLRTFEPAAVMVTTPQAVSLADNLRSLDFCRKTSLPVLGLIENMSGYICPHCNDCTNVWGKGGGEALAKREGLRFLGRIPIDPGLVRVLDDAKDDAHVELQKQLHQTSLNDNVLKAIDQPLTPHSQSAAAQLPNSGDTESLTPAGTMLSRTTIQRYKNSLTFPIFQEITDQIRDLATKHKLHPQSSVLTTAL

SEQ ID NO: 74348 - protein, 393 aa, Thiomicrospira crunogena XCL-2
MSVIKMSDLNLAGKRVLIREDLNVPVKDGKVTSDARIRASLPTIKMASEAGAKVMLMSHLGRPTEGEYAEEFSLAPVAADLSAKLGKEVRIIKDYLGGDFDVAEGEVVLLENVRFNVGEKKNDETLSKQYAALCDVYVMDAFGTAHRAQASTHGAGAFAETACAGPLLAAELDALGKALNNPARPMVAIVGGSKVSTKLTVLESLSEKVDQLVVGGGIANTFIEAAGYNVGKSLSESDLVPTCKKLNEIMEARGAAIPLASDVVCGKEFSESAAAETKNVSEVADDDMIFDIGPDSAAELATIIKNAGTVVWNGPVGVFEFDQFGEGTKAISMAIAESSAFSIAGGGDTLAAIDKYDIADKVSYISTGGGAFLEFLEGKKLPAVEMLEKAAAK

SEQ ID NO: 74349 - protein, 463 aa, Shewanella sp. ANA-3
MSTGTVVQVIGAVVDVEFPQDAVPQVYDALKITGEGSCNGLVLEVQQQLGGGVVRTIAMGTSDGLRRGLEVVNSGSPISVPVGTATLGRIMNVLGDPIDEAGAIGEEERYVIHRSAPSYEEQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDEDKMTVSRARKIERFLSQPFHVAEVFTGSPGKYVSLKDTIRGFKGILSGEFDHIPEQAFYMVGSIDEAVEKANKKK

SEQ ID NO: 74350 - protein, 491 aa, Escherichia coli K12
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 74351 - protein, 480 aa, Thiomicrospira crunogena XCL-2
MPSGLRRTKIVATLGPATDRDGELEKMIKEGVDVVRINMSHGNPSEHIERAQNVRDIAARLDREVGILVDLQGPKIRIARFSEGSIFLEQGDKFSLDNNVDPLAGNQKEVGLTYKSLPYDVKAGDRLLLDDGRVVLDVDNVEGERVNCTVVVGGKLSNNKGINLHGGGLSAAALTEKDKEDILTAAEIQCDYLALSFPRSAEDVEYCRSLAEKAGLVCSIVSKIERAEAVNDDFTLDGIILASDVIMIARGDLGVEVGDAQLPALQKKMIKRARQLNRITITATQMMETMIENAIPTRAEVFDVANAVMDGTDAVMLSGETATGHSPSLVIKTMSDIAHEAEKSRSTRESTHRIDEFFTAVDETIAMSAMYAANHFGVQCIAALTESGNTPLLMSRISSGIPIIALTPHIDTRRKVTLYRGVYPTSVDYTGLNDDQVKDRILEELKEKGVAKSGDLIIVTRGQSRGAMGGTNQMEIVKVP

SEQ ID NO: 74352 - protein, 480 aa, Escherichia coli K12
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 74353 - protein, 148 aa, Solanum chacoense
MEQTFIMIKPDGVQRGLVGEIIGRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSWIYE

SEQ ID NO: 74354 - protein, 293 aa, Schizosaccharomyces pombe 972h-
MPPKLYHPQPTHAIPVSNMRVNTRYEPTAGFSGTSVPSVQAANPSAYLPNSATAQMGFQLGKNAVNAGQEYVEQNFGKWLSTTRLHHYFTVTNSYVVAKLLLIIFPWRRRSWARKLRRSEINGSAEGYCPPAEDLNSPDMYIPLMAFTTHILLLCALAGLQDDFQPELFGLRASKACAVVLVEFLATRLGCYLLNISSQSQVLDLLAFSGYKFVGLILTSLSKLFEMPWVTRFVFLYMYLATAFFLLRSLKYAVLPESTMAINATITSHQRSRRIYFLFFIAASQILFMYVLS

SEQ ID NO: 74355 - protein, 173 aa, Schizosaccharomyces pombe 972h-
MSVESQPVEKISELPAGSTTVVHAEKAQKLIQKLGLKRVEGITRVAMRRPKNILLIINEPIVYKSSNNAYIVLGKVTVEDMAAQARAFNESQKQATETKEEAAITEESGDAQPADTAKIEESFEQEKAVDETGVDAKDIELVMAQANVSRAKAVTALKENNSDVVNAIMSLTM

SEQ ID NO: 74356 - protein, 276 aa, Brassica napus
  misc_feature (114)..(114): Xaa can be any naturally occurring amino acid
MEMATSFLYPPPPSVLLNTMTVVGLAALPVIGLSEVRGNNLKYSKFNNNNASSSPSSLSSSSQRFSSVSSRTGMLCLYTPAFLAASASFFLSPSQDLRFLLLKSALSLHFFKRXFEVLFIHKYSGEMASDAAFTISSGYFSSAALVLYSQSFALGLPDPGLDLKFYGILMFVVGIVGNMYHHVLLAKLRKEGDGGGKKEYKIPKGGLFGEVICPHYMFEILVFWGFFMISQTIYSLSLAMSTTFYLMGRSYATRRWYLSKFDDFPKRIKALIPFVF

SEQ ID NO: 74357 - protein, 310 aa, Staphylococcus arlettae
GFGRIGRLAFRRIQNVDGIDVVAVNDLTDDEMLAHLLKYDTMQGRFTGEVEVENDGFRVNGQEVKSFSEPDPNKLPWGDLDIDVVLECTGLFADKDKASAHIDAGAKKVLISAPASGDLKTIVFNTNHNELDGSETVVSGASCTTNSLAPVAKVLNDDFGLVEGLMTTIHAYTGDQSTQDAPHRKGDKRRARAAAENIIPNSTGAAKAIGLVIPEIDGKLDGGAQRVPVATGSLTELTVVLDKEVTVEDVNSAMKNASNESFGYTEDEIVSSDVIGMTYGSLFDATQTRVMTVGNQQMVKVAAWYDNEMS

SEQ ID NO: 74358 - protein, 170 aa, Streptococcus suis 89/1591
MNLKDYIATIPNYPKEGIEFRDISPLMADGNAYSYAVREIVQYATDKQIDMIVGPEARGFIVGCPVAFELGIGFAPVRKPGKLPREVISADYEKEYGVDTLTMHADAIKPGQRVLIVDDLLATGGTVKATIEMIEKLGGIVAGCAFLIELDDLKGREAIGDYDYKVLMHY

SEQ ID NO: 74359 - protein, 793 aa, Cryptococcus neoformans var. neoformans B-3501A
MAPKQRRATNSKAKATPTSVTSPPDQSSPVRSRGGSSSLSPIRSPQENSDLEDNNERHPGTNGSGLKAEDEGSTDLLDRDGDLEEVHACPDSITFRYPSSVPDFTILSPREKAFKVARFLHCTAPSCACTGLEPPAGRTIRITKHDSSNEDEDDEDEDDDVSMEDSENPLDFEDKKDEWRTKEGWWRICGKCGHGWESGGHVWADDVPPKERTRRGKVVGRIEEILEDENKLVEFPTPQPESISSLLKQLHEFVPPPAGKTTISALPPPVDLSTPDDDTQEDNSDGERPRKRRRQASESTHSDIEGEQHRGQGKKKQGKGPAKGAKPRVPRTVVRGAHGFIPMATDPDGNQHVEGHLPISAGGTGADETFEEEEEEEEELSTAKRPELDETERRRRTEIKVKEKEREEELVSRLAAGVNPEDAGGAVEIWEGIELQKLPLRPAAIEQANREIMLPVVSSRNPTPVATILLVGLKNVFQRQLPKMPREYITRLVLDKNHISMAIVKRGYRVVGGICYRPFEARGFAEIVFCAVDSSEQIKGYGSHLMNSLKDHVRKAHPTINVFLTYADNYAVGYFKKQGFTKEISYPRERWVGYIKDYEGGTIMQGRMLPKVKYMEVHQMLADQKAAIIAKIKTLTKSHIIHPGLQIFKERQPDEEIKLTKEQVPGLAESGWNPDLDDIVRQPKRNPYHVLLQHVLNDLQNEPSAWPFVKPVDSSVVADYYDVIKDPMDLSTMEYKLENNHYESIEGFVADVKLMCANCRQYNGEKSTYTKQANLLEKALDRILKKRKSVLAD

SEQ ID NO: 74360 - protein, 248 aa, Mycobacterium sp. MCS
MGDSTLILLRHGESEWNAKNLFTGWVDVDLTDKGRAEATRAGELIADLDRLPDVLYTSLLRRAITTANIALDKADRHWIPVHRDWRLNERHYGALQGLNKAETKEKYGEEQFMAWRRSYDTPPPPIEAGSEYSQDRDPRYADIDGGPLTECLADVVARFVPYFEQTIVPDLREGRTVLIAAHGNSLRALVKYLDGMSDEDVVGLNIPTGIPLRYDLDSDLKPTVAGGTYLDPEAAAAGAAAVASQGAK

SEQ ID NO: 74361 - protein, 430 aa, Xylella fastidiosa Temecula1
MTVIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRNNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 74362 - protein, 262 aa, Glycine max
  misc_feature (212)..(212): Xaa can be any naturally occurring amino acid
  misc_feature (242)..(242): Xaa can be any naturally occurring amino acid
DKVADGFKVVARSGNIVAGIANESKKLYGVQFHPEVGLTENGKVILKNFLYDIAGCSGNFTVQNRELECIREIKEKVGTSKVLVLLSGGVDSTVCTALLNRALNQDQVIAVHIDNGFMRKRESQSVEEALKKLGIQVKVINAAHSFYNGTTTLPISDEDRTPRKRISKTLNMTTSPEEKRKIIGDTFVKIANEVIGEMSLKPEEVFLAQGTXRPDLIESASLVASGKAELIKTHHNDTELIXKLRGEGKVIEPLKDFIKMKS

SEQ ID NO: 74363 - protein, 298 aa, Rhizobium tropici
MKEAYAAISREKAKPLVLECIGIDQPRPDEILVRIVASGVCHTDMVVRDQGYDVPQPVVLGHEGSGVVEVVGADVKGLSPGDHVALSYAYCGKCEKCRGGTPYYCEDFFGRNFRGTRPDGSCPLHDSHGTQISGCFFEQSSFATYAIASERNAVKVSKDVPLELMGPLGCGLQTGAGAVLNCLKPQPGSSIAVFGAGAVGMAAVMAAKIAGCSTIIVIDLNDERLELAIELGATHIINARNGDSVKAIREIIPEGADFSLECTSSPKVFRQAVDCLGTPGTCGLVGSSALGTEGIVDI

SEQ ID NO: 74364 - protein, 335 aa, Spinacia oleracea
KLKVAINGFGRIGRNFLRCWHGKDSPLDVVVINDTGGVKQASHLLKYDSILGTFDADVKTAGDSAISVGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPQLKGKLNGIALRVPTPNVSVVDLVVQVSKKTFAEEVNAAFRESADQELKGILSVCDEPLVSIDFRCTDVSSTIDSSLTMVMGDDMVKVIAWYDNEWGYSQRVVDLADIVANKWQA

SEQ ID NO: 74365 - protein, 257 aa, Vibrio vulnificus YJ016
MITMARFYKTQRKQGKRMKKTVIAAVLATGLTAMGCHAAEWGYEGKHGPEHWGEIAKECAMGKNQSPIDIRQPTQADLKGLDLHYSGQVIALSNNGHTLQGSLSGENVLDIDGKSFELKQFHFHTPSENLIQGKQYPLEAHFVHADKAGNLAVVAVMFESGSQNQALNSLIAKVPKAGEEVKLAQAFDVNDLIPAHAEYYRFNGSLTTPPCSEGVRWFVIKEASELSPTQTHVLMQAMGENNRPVQPLNARVVLSKE

SEQ ID NO: 74366 - protein, 218 aa, Zea mays
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSVRGCIVSQDLSVINLVIVKKGENDLPGLTDTEKPRMRGPKRASKIKKLFNLGKDDDVRSYVNTYRRTFLNKKGKKVSKAPKIQRLVTPLTLQRKRARIADKKKRIAKKKSEAAEYQKLLA

SEQ ID NO: 74367 - protein, 568 aa, Solanum lycopersicum
MASSALISDTQSWKDLRAHVEEINKTHLRDLLNHTDRCQSMMVEFDGILIDYSRQRATLDTLKKLFNLAEAAHVKEKIIRMFNGEHINSTENRPVLHVALRAPRDAVINSDGKNVVPEVWHVLDKIRDFSERVRSGSWVGATGKALKDVVAVGIGGSFLGPLFVHTALQTEAEASECARGRQLRFLANVDPIDVARNITGLNPETTLVVVVSKTFTTAETMLNARTMREWISSALGPQAVAKHMVAVSTNLKLVEQFGIDPNNAFAFWDWVGGRFSVCSAVGVLPLSLQYGFSIVEKFLKGASSVDQHFLSAPFEKNIPVLLGLLSVWNVSFLGYPARAILPYSQALEKLAPHIQQVSMESNGKGVSIDGVPLPYQTGEIDFGEPGTNGQHSFYQLIHQGRVIPCDFIGVVKSQQPIYLKDEVVNNHDELMSNFFAQPDALAYGKTPEQLQKENIPEHLVSHKTFSGNRPSLSILLPSLSAYNIGQLLAIYEHRVAVQGFVWGINSFDQWGVELGKSLATQVRKQLHASRKKGESVEGFNFSTKMLITRYLEASADVPSDPSTLLPNI

SEQ ID NO: 74368 - protein, 236 aa, Rhizobium tropici
MQEKSMVKITAAVAVKPKAPLEFRELELADPEGNEILVRTVATGICHTDLLLRDGIFGPPAPVIPGHEGVGIVEAIGADVQGLRVGDHVALSQSSCGFCGDCRRSHPMNCQNYTQYNLTGLRPNGKKALLCDEVGIGSNFVGQSSFATHILATENNAAQLPKDFDLTNAAPLGCGMATGAGTVINAMKPEIGQTIAVFGAGAVGMAAVMAAKVRRCSKIIIIDLNEQRLAMAKTVW

SEQ ID NO: 74369 - protein, 243 aa, Polaromonas sp. JS666
MTKTHFGFESVEEQDKARRVRGVFDSVAPKYDVMNDLMSMGLHRAWKAYTVLVANVKEGQQVLDIAGGTGDLALAFAPKVGSSGRVVHTDINEAMLREGRNRLLDAGVNLPTLVCDAEHLPFADASFDVVTVAFGLRNMTHKEDALREMNRVLKPGGKLLVLEFSKVAKPLEKIYDWYSFKVLPRLGKLVANDDSSYQYLAESIRMHPGQEELKALMLKGGFGHVDYHNLTGGVVALHVAIKC

SEQ ID NO: 74370 - protein, 157 aa, Anaplasma phagocytophilum HZ
MGFDVHRFTESREEGQYIPICGIKVAHTQGIVAHSDGDVALHALTDALLGCMGEGSIGQHFPNSDPQWKNASSSYFLLEAQKKAAAKSYAILNFDVTIVCEQPKIMPHVPKMKEFLSKLLDVDVSQMNIKAVTTEKLGFLGRGEGIAAHAVLMCYRV

SEQ ID NO: 74371 - protein, 310 aa, Saccharomyces cerevisiae YJM789
MTTSILDTYPQICSPNALPGTPGNLTKEQEEALLQFRSILLEKNYKERLDDSTLLRFLRARKFDINASVEMFVETERWREEYGANTIIEDYENNKEAEDKERIKLAKMYPQYYHHVDKDGRPLYFEELGGINLKKMYKITTEKQMLRNLVKEYELFARYRVPACSRRAGYLIETSCTVLDLKGISLSNAYHVLSYIKDVADISQNYYPERMGKFYIIHSPFGFSTMFKMVKPFLDPVTVSKIFILGSSYKKELLKQIPIENLPVKYGGTSVLHNPNDKFYYSDIGPWRDPRYIGPEGEIPNIFGKFTVTS

SEQ ID NO: 74372 - protein, 574 aa, Vitis vinifera
MGESRKPGLGILMVVIMCSLYQNLGLCWSLNDEGLALLRFRERVVSDPFRALANWDDGELDPCSWFGVECSDGKVVILNLKDLCLRGTLAPELGSLANIKSIILRNNSFSGTIPEEIGELKELEVLDLGYNNLCVPIPANLGNNLSLTILLLDNNVLISSLPSQIHELVVLSESQVDENRLSNIAKISSLHGGSCTRYTRSTTTPVPTPSPNSSDPSVSSSGPSLTNTSSSSPSESSSGKSNLKHTLLLVGVIGGSVLVFICIICIYLFRTNKVATVKPWATGLSGQLQKVFVTGVPKLKRSELETACEDFSNVIGSSSIGTVYKGTLSSGVEIAVTSAAVTSSKDWSKNLEVQFRKKIERLSKVNHKNFVNLLGYCEEEEPFTRMMVFEYAPNGTLFEHLHIKEAEHLDWAMRLRAAMGMAYYLNHIHQLTPPIAHENLNSSAVNLAEDYAAKVSDFSLSASPSADPESNVYSFGVILFEMITGRDWASNYLQGDRPIKEMVDPTLKFFQEEQLESIREVIKSCVNPDPKQRPTMRDVTARMREITEIGPDGAIPKLSPLWWAELEILSTEAS

SEQ ID NO: 74373 - protein, 285 aa, Salicornia bigelovii
MEGKEEDVRLGANKFGEKQGLGTVAQDRDYKEPPPAPLFEPGELTSWSFYRAGIAEFIATFLFLYISILTVMGYNRATNKCATVGIQGIAWSFGGMIFALVYCTAGISGGHINPAVTLGLFLARKLSLTRAVFYMIMQCLGAICGAGVVKGLQPTPFQSTGGGANYIHHGYTKGDGLGAEIVGTFVLVYTVFSATDAKRSARDSHVPILAPLPIGFAVFLVHLATIPVTGTGINPARSLGTAIIYNSDLNSWNDHWVFWVGPFIGAALVAVYHTVVIRAIPFKSK

SEQ ID NO: 74374 - protein, 196 aa, Buchnera aphidicola str. Sg (Schizaphis graminum)
MQLIQIEKAILPTPWGDFLIFGFEEKKNGKNHIALVYGKIKKNIPILARIHSECLTGDAFFSLRCDCGIQLEMAMSRIASEGNGILIYHRQEGRNIGLLNKIKAYSLQDKGLDTVEANQKLGFSADERDFSLCADIFNILNIKKIRLLTNNPFKVDMLIASGIEIVERIPIIVEKNDKNAHYLKTKAEKMGHLLFK

SEQ ID NO: 74375 - protein, 217 aa, Brassica napus
MASSDGLASVEPWSFRQSFNIDSWLLPDHDSDILAKALHRSISTSTPTDPFSPSAYFDSAAVADLSPPQTLSNVSFASDPDISGAGGAKRKRGPGVAGDKSAKRRSRVSTKKSQTTFITADAANFRQMVQQVTGAKFIGSSSHGIFPPIVKPEPHRLASRLPPPSSSAVPTLDTSSFLSNHHQENMVNDFSSVSAPASSFFQSSTVKAGVSGGGGSA

SEQ ID NO: 74376 - protein, 280 aa, Anaplasma phagocytophilum HZ
MMRCHIKERVKDFSNLVGKELTKLIETQVTGGPAAGLVDAIGYCILPPGKCLRAFLASSVAQTFGVSIERTLPLCLAIEVLHSYSLVHDDLPSMDNAPTRRGKNSCHIEHGEALALLTGDALLTLTFELLSSMDESCTVKCAIIRVISDACGHRGMVAGQALDMGNLEPSLEAVKQIHKLKTARLFSAACESGAILAEVSTANQQALASYGETLGCAFQAKDDLCDINEDDSCLNIARILGREKTLEYIDYLLHQSEEYLERIDEDTAVLKELVAFIRNL

SEQ ID NO: 74377 - protein, 533 aa, Pleurotus eryngii
MAVAFIALVSLALALVRVEASIGPRGTLNIANEVIKPDGFSRSAVLAGGSYPGPLIKGETGDRFQINVVNKLADTSMPVDTSIHWHGIFVRGHNWADGPAMVTQCPIVPGHSFLYDFEIPDQAGTFWYHSHLGTQYCDGLRGPFVVYSKNDPHKRLYDVDDESTVLTVGDWYHAPSLSLSGVPHPDSTLFNGLGRSLNGPASPLYVMNVVKGKRYRIRLINTSCDSNYQFSIDGHAFTVIEADGENTQPLQVDQVQIFAGQRYSLVLNANQAVGNYWIRANPNSGDPGFANQMNSAILRYKGARNVDPTTPERNATNPLREYNLRPLIKEPAPGKPFPGGADHNINLNFAFDPATVLFTANNYTFVPPTVPVLLQILSGTRDAHDLAPAGSIYDIKLGDVVEVTMPALVFAGPHPMHLHGHSFAVVRSAGSSTYNYENPVRRDVVSIGDDPTDNVTIRFVADNAGPWFLHCHIDWHLDLGFAVVFAEGVNQTAVANPVPEAWNDLCPIYNSSNPSKLLMGTNAIGRLPAPLKA

SEQ ID NO: 74378 - protein, 392 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHGLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMFRVEVLEKVPIMQHFLFGWLIKWEE

SEQ ID NO: 74379 - protein, 471 aa, Photobacterium sp. SKA34
MTDTQCSNNSHFDVIIIGSGPGGEGAAMGLTKAGFNVAIIEREDSVGGGCTHWGTIPSKALRHAVSRIIEFNQNPLYCRNNSTLHSTFSQILGHAEVVVNKQTRMRQGFYDRNQCQIIHGEARFIASHDVEVTSTDGSIERYSADKFIIATGSRPYHPDGVDFDHSRVYDSDSILRLEHDPRHIIIYGAGVIGCEYASIFRGLGVKVDLINTRQRLLEFLDNEISDSLSYHLWNNGVMIRNDEIFEEIEGTDDGVILHLQCGKKMRADCILYANGRTGNTDKLELEHVGLTPDSRGQLNVNRSYQTEVDHIYAVGDVIGYPSLASAAYDQGRFAAQAISKGQAQGQLIDHIPTGIYTIPEISSVGKTEQQLTAEKVPYEVGRSQFKHLARAQIAGTEVGSLKLLFHRETKEILGIHCFGERAAEIIHIGQAIMEQKGEGNTIDYFVNTTFNYPTMAEAYRVAALNGLNRLF

SEQ ID NO: 74380 - protein, 228 aa, Oryza sativa
  misc_feature (138)..(138): Xaa can be any naturally occurring amino acid
SKKRRLLWSLARSRGRWRRSSYRDGRHGRARGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIXGATNPLQAEPGTIRGDLAVQTGRNVVHGSDSPDNGKREIALWFKEGELCEWESVLTPWLCRVMLPDQCKKLDAVLVLDFEGYGMISEFTE

SEQ ID NO: 74381 - protein, 90 aa, Zea mays
MAQPAFLSSLRSRLGSAPPPPPNHRLQPRRGYHVELGAREKALLEEDVALKRFKSYKNSVKQVSKIGNALTLAVVLACSYELAVLATSTK

SEQ ID NO: 74382 - protein, 73 aa, Phaseolus vulgaris
DEKYTQWKSLVPVLYDWLANHNLVWPSLSCRWGPQLEQATYKNRQRLYLSEQTDGSVPNTLVIANCEVVKPRV

SEQ ID NO: 74383 - protein, 311 aa, Staphylococcus capitis
GFGRIGRLALIRIQDVEGLEVVAVNDLTDDEMLAHLLKYDTMQGRFTGEVEVIDGGFRVNGKEIKSFDEPDASKLPWGDLDIDVVLECTGFYTDKDKAQAHIDAGAKKVLISAPATGDLKTIVFNTNHDELDGSETVVSGASCTTNSLAPVAKVLNDEFGLVEGLMTTIHAYTGDQNTQDAPHRKGDKRRARAAAENIIPNSTGAAKAIGKVIPEIDGKLDGGAQRVPVATGSLTELTVVLDKQDVTADQVNEAMKQASDESFGYTEDEIVSSDVVGMTYGSLFDATQTRVMTVGDRQLVKVAAWYDNEMS

SEQ ID NO: 74384 - protein, 228 aa, Streptomyces avermitilis MA-4680
MAVQINPSILSADFARLAEEAKAVEGADWLHVDVMDNHFVPNLTLGVPIVEALARATDTPLDCHLMIEDADRWAPQYVEAGAGSVTFHAEAAAAPVRLAREIRAKGARASMALKPATPIEPYEDLLPELDMLLIMTVEPGFGGQAFLDIMLPKIRRTRELISKHGLELWLQVDGGVSASTIERCAEAGADVFVAGSAVYGAADPADAVRALRTQAEGATALASWACDH

SEQ ID NO: 74385 - protein, 311 aa, Staphylococcus caprae
GFGRIGRLAFRRIQDVEGLEVVAVNDLTDDEMLAHLLKYDTMQGRFTGEVEVIEGGFRVNGKEIKSFDEPDANKLPWGDLDIDVVLECTGFYTDKDKAQAHIDAGAKKVLISAPATGDLKTIVFNTNHDELDGSETVVSGASCTTNSLAPVAKVLNDEFGLVEGLMTTIHAYTGDQNTQDAPHRKGDKRRARAAAENIIPNSTGAAKAIGKVIPEIDGKLDGGAQRVPVATGSLTELTVVLEKQDVTADQVNEAMKQASDESFGYTEDEIVSSDVVGITYGSLFDATQTRVMTVGDRQLVKVAAWYDNEMS

SEQ ID NO: 74386 - protein, 208 aa, Streptococcus pyogenes M1 GAS
MLKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 74387 - protein, 310 aa, Staphylococcus carnosus
GFGRIGRLAFRRIQDVEGIDVVAVNDLTDDEMLAHLLKYDTMQGRFTEEVEVVDGGFRVNGKEVKSFEEPDASKLPWKDLDIDVVLECTGFYTSEEKAKAHIDAGAKKVLISAPATGDVKTIVYNVNQDTLDSSDVIVSGASCTTNSLAPVAQVLNDSFGLVEGFMTTIHAYTGDQNTQDGPHRKGDKRRARAAAENIVPNSTGAAKAIGKVIPEIDGKLDGGAQRVPVATGSLTELTVVLDKDVTVDEVNEAMKQASNESFGYNEDEIVSSDVVGMTFGSLFDATQTRVMTVSGRQLVKVAAWYDNEMS

SEQ ID NO: 74388 - protein, 310 aa, Macrococcus caseolyticus
GFGRIGRLAFRRIQDVENIEVVAVNDLTDDDMLAHLLKYDSTQGRFTEEVEVIDGGFRVNGKEVKSFSEPEPKNLPWGDLDIDVVLECTGFFTDKDKAEAHIEAGAKKVLISAPAKGDLKTIVYNVNHELLDGSETVVSGASCTTNSLAPVAKTLQDNFGIVEGLMTTIHAYTGDQNTLDAPHRKGDKRRARAAAENIIPNSTGAAKAIGLVIPEIDGKLDGGAQRVPVATGSLTELTVVLEKEVSVEEVNKVMKEATNESFGYTEDEIVSSDVIGMTFGALFDATQTRVMTVGDRQLVKVAAWYDNEMS

SEQ ID NO: 74389 - protein, 475 aa, Streptococcus pyogenes M1 GAS
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVSFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 74390 - protein, 492 aa, Streptomyces avermitilis MA-4680
MLDQGAPPQSRSHPSAPGLGARLMRRKPVENLVAEGGQGEGGTLRRSLGLWQLTMISIGATLGTGIFVVLGEAVPKAGPAVTLSFVIAGLTALFSALSYAELAGTIPVSGSSYSYAYATMGELIAWICGWCLVLEYGVSVAAVAVGWGEYLNELLDGTIGVTIPDALSAPPGDGGIFNLPALIVVLLAMAFLLGGAKESARANTIMVIVKIAALLMFCAIGIQGFKSGNYENFMPLGMAGVSAAGATLFFSYIGFDAASTAGEEAKNAQRDLPRAIMLSLVIVTALYVLVAAVAVGAKPWKGFNDSEAALAGIMKDVTGQTFWGTLLAACAVIAIASVVLTVLYGQTRILFAMARDGLVPKVFARVHPKTGAPRANTVIVSLFCGVLAAAIPLGQLADATSIGTLFAFGLVNIAVVVLRRTRPDMRRTFRVPLSPVLPAIGFALCVWMMGSLSAVTWVVFGVWMAVGLVFYFSYGHRRSRLATADTAVSAQK

SEQ ID NO: 74391 - protein, 533 aa, Gluconobacter oxydans 621H
MTLTQQDASTVEKLDETLHEDRILILDFGSQVTQLIARRVRESGVYCEIWPFTATEEKIRAFNPRGIILSGSPASVHDENAPPIPNVVFALNRPVLGICYGQQAMCQMLGGKVESHEHREFGRAYIDIAEDCSLFRGVWARGKREQVWMSHGDRVTQLPPGFRAVAHSEGAPFAIIADEGRRLYGVQFHPEVVHTPHGAALIRNFTHNVAGCSGTWTMAGFRELEIARIRKQVGSGRVICGLSGGVDSSVAAKLIHDAIGDQLTCIFVDPGIMRTGEADEVVKTFRGRFNIRLVHRDASELFLKELAGVTDPETKRKTIGRLFIEVFEEEAAKLGGAQFLAQGTLYPDVIESVSFSGGPSVTIKSHHNVGGLPDRMNMELVEPLRELFKDEVRMLGRELGIPESIVGRHPFPGPGLAIRIPGDVTKEKLDLLRKVDAIYLEEIRRAGLYDAIWQAFAVLLPVRTVGVMGDGRTYDQACALRAVTSTDGMTAEVYPFDFAFLNRVAGRIVNEVRGINRVTYDITSKPPGTIEWE

SEQ ID NO: 74392 - protein, 563 aa, Arabidopsis thaliana
MAAMITFDFQNSFIFILFFLFSLLCYSLFFRKPKGSRAGRDLPPSPPSFPVIGHLHLLLSALVHKSFQNISSKYGPLLHLRVFHIPIVLASSASVAYEIFKAQDVNVSSRGHAPVGESLWFGSSSFFFAPYGDYFKFMRKLIATKLLGPQALERSRKIRADELDRFYKTLLDKAMKKESVEIGEEAAKLNNNIICKMIMGRSCSEENGEAEKFRHLVIESMALTKQIFFGMIFHKPLKKLGISLFQKDILSLSRKFDELLEKILFEHEEKKAEHNQANDMMDFLLEAYGDENAEYKITRNHIKSLFVDLVIAGTDTSVQATQWTMGELINNPKILQRLREEIESVVGNTRLIQENDLPNLPYLQAVVKEGLRLHPPGSISVRMFQERCELKGFYIPEKTLLVVNTYAIMRDPNFWEDPEEFKPERFIASSRSEQEDEVREEVLKYIPFSAGRRGCPGSNLAYISLGIVIGVMVQCFDWRIEGEKVNMNEAAETTALSMAQPLKCTPVSRTKNPLPSMAGEIFRAHDMNVSSRGAAAIDESLVFGSSGVVYAPYGDNLKFVKKK

SEQ ID NO: 74393 - protein, 427 aa, Streptococcus pyogenes
MNKTKQNKTKQNKTKQNSLLCRYGLTSAAALLLTFGGASAVKADAASIKEVQAKLQSYRQALPRFKNYNTNTPNSGVEDTPTYKYLTEMEDKLNRYLETLDEGLDQLQGAKGEAGPAGPKGPAGEKGERGERGETGPAGPAGKDGDAGAQGPMGPAGPQGPRGDKGETGDKGDQGPAGKDGERGPVGPAGKDGQDGLPGKDGKDGQDGQDGLPGKDGKDGQNGKDGLPGKDGKDGQNGKDGLPGKDGKDGQDGQDGLPGKDGKDGQNGKDGLPGKDGKDGQNGKDGLPGKDGKDGQNGKDGLPGKDGKDGQNGRDGLPGKDGQPGKPAPKTPEVPQKPDTAPHTPKTPQIPGQSKDVTPAPQNPSNRGLNKPQTQGGNQLAKTPAAHDTHRQLPATGETTNPFFTAAAVAIMTTAGVVAVAKRQENN

SEQ ID NO: 74394 - protein, 577 aa, Streptococcus pyogenes M1 GAS
MTEMLKGIAASDGVAVAKAYLLVQPDLSFETVTVADTNAEEARLDVALQAAQDELSVIRENAVESLGEEAAAVFDAHLMVLADPEMISQVKETIRAKQTNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITKRVKDGDVIAVNGITGEVIIDPSEDQVLAFKEAGAAYAKQKAEWSLLKDAHTETADGKHFELAANIGTPKDVEGVNDNGAEAVGLYRTEFLYMDSQDFPTEDEQYEAYKAVLEGMNGKPVVVRTMDIGGDKELPYFDLPKEMNPFLGFRALRISISETGDAMFRTQMRALLRASVHGQLRIMFPMVALLKEFRAAKAVFDEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDSAKMEEYANRALTECSTAEEVLELSKEYVSED

SEQ ID NO: 74395 - protein, 294 aa, Mycobacterium sp. MCS
MLWRMARIAIIGGGSMGEALLSGLLRAGRQVKDLVVAEKHPDRAKFLAEKHSVLVTSVVEAIDNAHYVIVAVKPADVEHVIDDIAEAAANADTDTAEQVFVTVAAGVSTAYYENKLPAGAPVIRAMPNAPVVVGGGVSALAPGRFATPEHLKEVSAIFDSVGGVLTVPESQLDAVTAVSGSGPAYFFLMVEALVDAAVASGLSRTVATDLVVQTMAGSAAMLLERLDEAQPVGDAAMGTAMDTTAAQLRATVTSPAGTTAAGLRELERGGLRSAVANAVEAAKTRSEQLGITSE

SEQ ID NO: 74396 - protein, 459 aa, marine gamma proteobacterium HTCC2143
MSDNFASLDLPPGQLANLQQLGYEKMTPIQQQSLPLVLAGSDIIAKAKTGSGKTAAFGIGLLTKINPRDFGTQTMVICPTRELSTQVATEIRRLARYQQNIKVVVLCGGQSIGPQIGSLEHGAHIVVGTPGRIKDHLRKKTLSLSRLGILVLDEADRMLDMGFYSDIETIIHEMPDDRQTLLFSATYPDKIKTLSSSFQRSPVEISVESVRGNEKIHQQLFICDKRERLAGLQRLLMNYPIESAVIFCNTIKLVKEVCDYLVDIGISAKAIHGDLEQRDRDQVLIQFANHSCSLLVATDVAARGLDIEDLPAVINFELPREADVYIHRIGRTGRAGKEGLAFSLFTDSEKYRFDAISTLQENKLNFESIGVLKDIDRQLAAPPMVTLCISGGRKDKFRPGDIVGALTGEAGMDGSVIGKISVLDFVSYVAIERHAANDALRGLEQGKIKGRKVKIRKLR

SEQ ID NO: 74397 - protein, 637 aa, marine gamma proteobacterium HTCC2143
MIKLDQISLQRGSKFLLEKASVVFHPGQKIALIGANGSGKSSLFQLFLGKLTADEGSVAIPVQWRIAHMAQEVATSNRRALDFIIDGDHQLRGIEAAIDKAEREENHTLMASLHEKLDTIDGYNARVRAEQLMLGLGFKLDDRDKPANSFSGGWRIRLNLAQALMSPSDLLLLDEPTNHLDLDAELWLEQWLQRYQGSLLLISHDRDFIDSVCEGIVHIEHQTLNTYRGNYSAFERQRAEKLAQQQVNYEKQQRRKDEINDFVRRFRAKATKAKQAQSRLKELGRMEDIAPAHIDSPFNFSFPEPEKFSDPLLNLSHASLGYNQDPIVSHINLSIHPGSRIGLLGANGAGKSTLIKSLAKEIDLLSGEFTEGENLQLGYFSQHQLEALDLDASPMLHLQRLDAQAREQDIRNFLGGFNFHGDMAVGSIRHFSGGEKARLALAIVVWQKPNLLLLDEPTNHLDLEMCHALTMALQVFEGAVIIVSHDRHLLRNTVDQFLLIAGGKAQAYDGDLDDYSRWLISQRKQDAPASTPGSDSTGKTGKKEQRQQAAEIRKQLNPISNAIKKIEHKMEKTDKLLKDMEAELGDNDLYKANNNEKLQQLLRQQGHLKLEKNHDEERWFELTEKLESLQDELASQG

SEQ ID NO: 74398 - protein, 646 aa, Arabidopsis thaliana
MATRFDTGESIGSGKTSISRDEFAEDSLKIVSLPPVENDDSVEEMISPKKQVKSSPFTSVFEKDGEIIHSDSIDISFSETTLEETVAMNVECPGVVVVSVPENGSTILEENKVGEEIKESSEISTTEGDRLGDDVLKIKDVVETDGFVVSISDMKESLNSEKKGQDSDGQRIVEAEKIILFAEIGDGSTFLEENKELQQIKEVSEISTESDQFGDDVYKIEDDCVGSISDMKEILNSQKKGQDSDVQILWETEKKNDGDTLARASDIHKIEKNGNGSKDQREKVERVRVKDNAFVGRSVNIDLVDDTALFDVVPFYKKGKDHSKRPVTAHTDKDAPRKHKKVGVEKPIDKGNASSIVERNASTKVSDFRNSGEMNGKQLRIMYSRNQMESMRLLPELVTEYEGLKNHKSILEDYVVKEEKTEDNDDYNSILRPAFAVDGEPDFDSGPPEDGIEYLRRVRHIWLSCFHHLRWEAKRIPNVKVAKVSGSKYREKEQSVYMPQIPRAPATGEGMGGLVAFRLLTHSSGIPFFQLAYLSVFLLTDKDTRNGLSDTGIKAEKADMFGEKESGLESSDCKWVVALCASVDTPPDADTSACLRALVRKCASLRALEVGVLEMNKLSLWQICSSPSQADILAKWNERRSVFTTV

SEQ ID NO: 74399 - protein, 256 aa, Cryptococcus neoformans var. neoformans JEC21
MAERGGFGRGRGGAGGRGRRGPRRGGKKEEDKEWVPVTKLGRLVKDGKIKSMEEIYLFSLPVKEFQIIDLFLPALKDEVMKIMPVQKQTSAGQRTRFKAFVAVGDFDGHVGLGIKCAKEVATAIRGAIISAKLSIVPVRRGYWGSHIAEPHTVPCKVSGKSGSVMCRLIPAPRGTGIVAAPASKRMLQMAGIQDCYTQSKGCTATQGNFLKATMAALAKTYQFQSPDLWNVIAPGLTPYDEHSSWLAIAAKKAANY

SEQ ID NO: 74400 - protein, 386 aa, Arabidopsis thaliana
MKKLLVTNLLGPQALERSRGFRADELDLFYENLLDKAMKKESVDICVEALKLSNNSICKMIMGRSCSEENGEAERVRALATQLDGLTKKILLANMLRAGFKKLVVSLFRKEMMDVSSRFDELLERILVEHEDKLDMHHQGTDLVDALLAACRDKNAEYKISRNHIKSFFADLLFASTDTFVQTTQWTVAEIINNPNVLERLRGEIDSVVGKARLIQETDLPNLPYLQAVVKEGLRLHPPGPLFARFSQEGCRIGGFYVPEKTTLMINAYAVMRDSDSWEDPDEFKPERFLASSRSEQEKERREQAIKYIAFGSGRRSCPGENLAYIFLGTAIGVMVQGFEWRIKEEKVNMEEANVGLSLTMAYPLKVTPVPRTLVPLTQNPLNRSS

SEQ ID NO: 74401 - protein, 111 aa, Brassica napus
GQVGPATGIAGRPQPGAVANEPDPLVGKKVWTKWPEDNNFYEAVITDYKAAEGRHALVYDMNTLNETWEWVNLKEISPGDIRWEREDAGVSRKGRHPAQCPGSTKAMARGG

SEQ ID NO: 74402 - protein, 237 aa, Glycine max
MAAEGDLKLLGLSVSPFVVRVRMALHMKGLSYEYIEQDLFNKSELLLKSNPVETKVPVLIHDGKTILDSSAIVQYIDEVWAAMGPSILPVDPNERATARFWAAYVDDKLFSAYVGINKATTEVEREEKVSEMLAVLEQLEEAFAKNSNGKAFFAGDSIGYLDLAVGCHLLWLKAQHKMFGVVFLDAGKTPLLEAWAKRFAETDAAKEVVPDTGMVMEYAKKRQAYRAAVAAAAATAK

SEQ ID NO: 74403 - protein, 445 aa, Brassica oleracea
MDMESGKLFIGGISWETTEDRLRDYFQSFGEVLEAVIMKDRSTGRARGFGFLVFADPNVAERVVLLRHVIDGKLVEAKKAVPRDDHKSNSSLQGSSPGPANSKKIFVGGLASSVTEAEFKKYFAQFGTITDVVVMYDQRTQRPRGFGFISYESEDAVDRVLRRTFHELNGKMVEVKLAVPKDPVRNQMNVNGFGSNRISALLMNEYTQGFTPSPISSYGVKPEVRYSPGVVNRGGFSPFGHGYGIDLNFEQDQTQRYGSGSSAGFGRPFSPGYTPSLSRYGSQIETGGGANGSVLNASTKNHLWGNGGGLGYMSNSPVSRSSFNGNSGMSSLGSIGDNWGGAGARARNSYRSEGGGLGLEAMRGVHVGGLSNGLNSLEADSLYSDSAWLSMPAKADEKLGMGAFDFMSRGPAGYINRQPNGGMNNDHLFSSKNMNIFVFLLEKKN

SEQ ID NO: 74404 - protein, 651 aa, Ustilago maydis 521
MSSTESPVPAAAAPAEAVPASTPAPAAEQPAVGNGEQRNNADAANNTSLYVGELDPSVTEAMLFEIFSMIGTVASIRVCRDAVTRRSLGYAYVNFLNAADGERAMEQLNYSLIRNRPCRIMWSQRDPALRRTGQGNIFIKNLDAGIDNKALHDTFAAFGNILSCKVATNETGSLGYGFVHYETAEAAEAAIKHVNGMLLNDKKVYVGHHIPRKERQAKIEETRANFTNVYAKNVDPEVTDDEFEKLFTKFGKITSCVLQRDEDGKSKGFGFVNFEDHNEAQKAVDELHDSDFKGQKLFVARAQKKSEREEELRRSYEAAKNEKLAKFQGVNLYLKNIPESYDDERLREEFAPFGAITSCKIMRAPSGVSRGFGFVCYSAPEEANKAVSEMNGKMLDNRPLYVALAQRKDVRRQQLEAQIMQRNQLRLQQQAAAQGMGYPGPGMYYPQPGAFPGQPGGMVPRPRYAPAGMMPQGMPMAPYGQPGQFPAGMMPQGYRPARPPRGAPNAAGGPAPPAGARPPTGVNGAPRPAGQPVPGQPMPRGPAARPAGRPEADQPGALTAAALAKASPEEQKQMLGEAIYPKVAASQPELAGKLTGMILELPVTELLHLLEESEALDAKVNEALEVLKEYQQNDSAGAEAEANAEAPKTEA

SEQ ID NO: 74405 - protein, 443 aa, Mycobacterium leprae TN
MPTLASTTSSPTAMMLGMPASAADLCEFINASPSPFHVCATVAGRLLDAGYAELSEVERWPDHPGRYFIVRAGSLVAWSAGQGVKAHAPFRIVGAHTDSPNLRVKQHPDLLVAGWRVVALQPYGGAWLNSWLDRDLGVSGRLSVRSAGKGSEITDRLVRIDDPILRVPQLAIHLAEDRKSLTLDPQRHVNAVWGVGDKAGSLLEYVAERTGVAVADVLAVDLMTHDLVPSMVIGADANLLSAPRLDNQVSCYAGMEALLASVPHDCLPVLALFDHEEVGSTSDRGARSNLLSTVLERIVLAAGGGRDDYLRRLPASLLVSADMAHATHPNYPECHEPSHLIEVNAGPVLKVHPNLRYATDGRTAAAFEVACQQAGVRLQRYEHRADRPCGSTIGPLASARTGIPTVDVGAAQLAMHSARELMGAHDVAVYSAALQAFFSADLF

SEQ ID NO: 74406 - protein, 216 aa, Oryza sativa Japonica Group
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGVSVFLC

SEQ ID NO: 74407 - protein, 473 aa, Nostoc sp. PCC 7120
MLIDSSGLSKVKDSVRKQIFFGNEPSAELIAILSVYFVQGILGLARLAVSFFLKDELLLSPVQVSALMGIVALPWMVKPLFGFVSDGLPIFGYRRRPYLVLSGILGAISWISLATIVHTSWAATVAIALGSLSVAVSDVIVDSLVVERAREESVAHVGSLQALCWGASAFGGLITAYFSGLLLEHFTTRTVFGITASFPLIVSGVAWLIAESPVSKDGSGNTNLLSVKHQLQQLRQAFTQKSIWLPTAFVFIWQATPTADSAFFFFSTNELHFEPEFLGRVRLVTSLASLIGVWIFQRFLKSVSFRLIFGWSTVISAVLGMTMLLLVTHTNRALGIDDRWFSLGDSLILTVMGQIAYMPVLVLSARLCPPGVEATLFALLMSVFNLAGMVSYEAGAIIMHWLGITETNFDLLWLLVLITNLSTLLPLPFLNWLPSDDAEIETQALAPASANTQVSNLVPELRLREAEPRTESS

SEQ ID NO: 74408 - protein, 134 aa, Brassica oleracea
MAGRLSGVASRIMGGNGIVARSNASSLRQRAGMGLPVGKHIVPDKPLSVNDELMWDNGTAFPEPCIDRIADTVGKYEALGWLCGGLGFFATLGLLAVVNDKASKVPFVSEIISTCISFALQKCLLLQDIVVSAT

SEQ ID NO: 74409 - protein, 313 aa, Ustilago maydis 521
MVASSSSKHTSGASSSTSKAKKGGATKAGLVGTANRASTGEANGEAVLKHSKPFGEEDSDDDVDVDVDVQDETFHTAASVEGDDDELMIGESCTAGASGASTGTNDGSSGSVRKPKFEPLSSTAASSLTAVAKGQLRKIAIPPHRLTPLKNEWHKIYTPLVEMASLQVRMNVAKKCVELKSSRYTSEQGMLQKGADFVKAFALGFEADDAIALLRMDDLFIDTFEIKDVKTLQGDNLSRAIGRIAGKDGRTRFAIENASRTRLVIADTKIHILGNFANIKIARDAVVALIRGSPPGKVYANLKTIGARQRQRA

SEQ ID NO: 74410 - protein, 269 aa, Buchnera aphidicola str. Sg (Schizaphis graminum)
MHPMLNIAIRAIRKGGNIIVQNYDTQKFIKEDLDKKKIFIKNIMYKTYRIISEVIYKSYPNHIILNKNTDLIKNEKNTLWIINELDGKNNFIKNFPHFCISIAVIMKNNTEISVIYDPIRNDLFTAVKGQGSQLNGYRIRCNNINSLNYSTIAINLPLKHYAKSLFYLKIYKKLILSGISLRCTGSTLLDLAYVASGRIDCLFDFNPQSINLIAGKLQAREAGCLTSKFTENSEKKSEKGNFCTSNLTSSSKFMRLITEKISQCYSFNN

SEQ ID NO: 74411 - protein, 428 aa, Oryza sativa Japonica Group
MVSAGVFHQQGVVLDRGNEKMVREPQDLRLGERDLLEEMSMNEEVEDGEVKPLGRVESMDETPGEVAKLRCRHGARGAAVVASAWRGSNTGSFVLVRSYITITFRGFRPPRLARLIRSPSSPCSKTCRLITPESIIATISHRSTMNGIELSSEDKAILVETLKNKLQALAEQHVDVLESLAPSVRKRVDVLMEIQSQHDELEVKFFEEKAALEAKYQKLYGPLYSKEKGVPDFWLNAMKNNEILAEEIHESDEEALKYLKDIKWCRIDDPKGFKFEFFFYTNPFFKNQVLTKTYHMIDEDDEPILEKAIGTEIEWHPGYCLTQEVLTKESSESTKPITKTEECESFFNFFSPPQVPDDDAKIDENTAEELQNQMERDYDIASTLRDKIIPHAVSWFTREAVQDEDYGASWVDDEEEDDNNDEYSDEEA

SEQ ID NO: 74412 - protein, 271 aa, Oryza sativa Japonica Group
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGMTINGLYPS

SEQ ID NO: 74413 - protein, 454 aa, Glycine max
  misc_feature (191)..(191): Xaa can be any naturally occurring amino acid
MNMNMGSSSPPDTSKSIKLERYNSYIRRLNSTKLLNASSKLLFRATLLVALILVFLFTFNYPPLSATDSTHRRLHAHSHYFLSSSSFGAWEKQVRHSASPRRPNGLTVLVTGAAGFVGSHCSLALKKRGDGVLGLDNFNNYYDPSLKRARQAMLWKHQVFIVEGDLNDTPLLQKLFDLVPFTHILHLAAQXAGVRYAMQNPQSYVTANIAGFVNLLEAAKSANPQPAIVWASSSSVYGLNTQNPFSELHRTDQPASLYAATKKAGEEIAHTYNHIYGLSLTGLRFFTVYGPWGRPDMAYFFFTKDILHGKTIDVYQTPEGKQVARDFTYIDDIVKGCLGALDSAQKSTGSGGKKRGPAQLRVYNLGNTSPVPVGTLVSILEGLLKTKAKKHVIKMPSNGDVPFTHANVSLAFRDFAYKPTTDLSTGLSKFVKWYLGYYGLQPSLKKDNHLHNIE

SEQ ID NO: 74414 - protein, 522 aa, Monilinia fructicola
MGVLETIAGPLAQEISQRSTGTIIAAGVAAFVVLAVVLNVLNQVLFANPNEPPVVFHWLPIIGSTITYGIDPYRFFFDCRAKYGDVFTFILLGKKTTVYLGRKGNDFILNGKHKDLNAEEIYTVLTTPVFGKDVVYDCPNAKLMEQKKFMKIGLSTEAFRSYVPIIQMEVENFMKRSSAFKGQKGTANIPPAMAEITIYTASHTLQGKEVRDRFDTSFASLYHDLDMGFSPINFMLHWAPLPHNRARDHAQRTVASTYMDIIQKRRAQATEAEFKSDIMWQLMRSSYKDGTPVPDKEIANMMIALLMAGQHSSSSSISWIMLRLAARPDIMEELYQEQIEVLGADLPDLKYEDLSKLTLHQNILKETLRLHTPIHSIMRKVTTPMPVSGTKYVIPTSHTLMASPGCTSRDAEYFPEPLEWDPHRWDIGSGRVIGNDQDEEFQDYGYGMISKGASSPYLPFGAGSHRCIGEQFANVQLITIMATVVRLFKFKNPDGSKDVIGTDYTSLFTGPLEPAVVAWERR

SEQ ID NO: 74415 - protein, 263 aa, Oryza sativa Japonica Group
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTVFRLHTTVLASRLPSSCF

SEQ ID NO: 74416 - protein, 279 aa, Triticum aestivum
  misc_feature (159)..(159): Xaa can be any naturally occurring amino acid
  misc_feature (187)..(187): Xaa can be any naturally occurring amino acid
  misc_feature (199)..(199): Xaa can be any naturally occurring amino acid
  misc_feature (216)..(216): Xaa can be any naturally occurring amino acid
  misc_feature (224)..(224): Xaa can be any naturally occurring amino acid
  misc_feature (231)..(231): Xaa can be any naturally occurring amino acid
  misc_feature (274)..(274): Xaa can be any naturally occurring amino acid
NKFVQKSRLVPVRNSRDIVDPRVRFEELEEESLRDNFVVVYELLDEMMDFGYPQYTEATILSEFIKTDAYRMEVTQRPPMAVTNAVSWRSEGIRYKKNEVFLDVVESVNILVNSNGQIVRSDVVGALKMRTFLSGMPECKLGLNDRVLLEAQGRATKGXKAIDLDDIKFHQCVRLARFENDRTISFXPPDGAFDLMTYXRLTTQVKPPDLGGKPKXEKHPRSRXIEFMVKXARSQFRERSPGTNVEIEVPVPSDATNQYRTTSMGSPAYAPERXSMAWK

SEQ ID NO: 74417 - protein, 268 aa, Oryza sativa Japonica Group
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTVFRLHTTVLASSFWQIRTLKVLW

SEQ ID NO: 74418 - protein, 512 aa, Glycine max
  misc_feature (286)..(286): Xaa can be any naturally occurring amino acid
MVASLSTLVLLLCVISTVAWYSCLYFLKLNNNTQKKTLPPGPPGLPIFGNLLSLDPDLHTYFAGLAQIHGPILKLRLGSKLSIVITSPAMAREVLKENDTVFANRDVPAAGRSATYGGSDIAWTPYGPEWRMLRKVCVLKMLSNATLDSVYDLRRNEMRKTVSYLYGRVGSAVNIGEQVFLTVMNVITNMMWGGAVEGAERESMGAEFRELVAEITQLLGKPNVSDFFPGLARFDLQGGEKQMHALVGRFDGMFERMIDRRTKVEGPDGESREMEDFLEFLVKLKXDEAGDSQTPLTIIHVKGLLMDMGTGGTDTSSNTIEFAMAEMMHNPEIMKRVQEELEVVVGKDNMVEESHIHKLSYLQAVMKETLRLHPVLPLLIPHCPSETTNVGGYRIPKGSQVFLNVWAIHRDPSIWENPLKFDPTRFLDAKWDFSGNDFNYFPFGSGRRICAGIAMAERTVLYFLATLLHLFDWTIPQGEKLDVSEKFGIVLKKKIPLVAIPTPRLSNPDLYN

SEQ ID NO: 74419 - protein, 145 aa, Triticum aestivum
LGSQLSGLKAKVHAFSVCYGPKYFYDCVQGLIDELQSGLNSHDIVSIEDAKGLGYAKSTGDELRFVKDVAAATGIVLDPVYTGKVAYCMVKNMSDNPGRWEGRRVLFVHTGGLLGLYDKVDQLSSLAGGWRRMDLEEPVLHANFN

SEQ ID NO: 74420 - protein, 190 aa, Bordetella pertussis Tohama I
MPINVPIFLTWLRIAMIPLVVGLFYLPESWMSVPMRDTFAAWAFIIAALTDWFDGWLARRWNQTSAFGAFLDPVADKLMVCAALIVLLDLSRVDAFISLIIIGREITISALREWMAKIGASASVAVHRLGKFKTAAQMVAIPCLLYDQPLFGLSSRLIGDVLIVVAAVLTVWSMLYYLQRAWPAIREKSQ

SEQ ID NO: 74421 - protein, 324 aa, Ralstonia metallidurans CH34
MATRNGFIGAVGNTPLIRLGKLSAETGCEILGKAEFLNPGGSVKDRAALYIIADAERRGTLKPGGTVVEGTAGNTGIGLAHICAARGYRCVIVIPETQSKEKMDLLRVLGAEVRTVPAVPYADPNNYQKVAGRLAQELDNAIWANQFDNTVNRQAHYETTGPEIWRDTDGKIDAFVCATGTGGTLAGVARFLKAQNPAVRTVLADPHGSGLYSFVKTGQIRAEGNSITEGIGSSRITANLADTPIDDAVRIDDQRCVTMVYRLLREEGLYVGGSTGINVAAAVQIAQDLGPGHTIVTLLCDRGSLYSARLFNAEWLAQKGLVAG

SEQ ID NO: 74422 - protein, 533 aa, Zea mays
MEAAAELALRLRAAANDRLAHYEPLALVAAPLLALLVARTLHATASAVADRGLIAIAIAAVKLLPGVSGYIAAEKKKVVDKMQSGGAKNNRRAELPTIGLAEQVIEELETLKAKDVDWQGKCSGTVYIAGSESEGHFQLINKAYSMFSHTNPLHQDVFKSVANMEAEVVAMTAALLGSKEKSSGGQICGNMTSGGTESILLAVKTSRDYMRSKKGITRPEMIIAESAHSAYDKAAQYFNIKVRRVPVNKEFLADVKGFKRCINGNTIMMVGSAPGFPHGLIDPIEELGELASRYDICLHVDLCLGGFVLPFAHKLGYPIPPFDFSVKGVTSISSDVHKYGLAPKGTSIVLYRNHEIRKHQFVAVTEWTGGLYVSPTIAGSRPGGLIAGAWAAMMSLGLNGYLDSTSRIMDVSKKIQRGIGEIPGLFVIGKPDMTVVAFGSDVVDIFEVNDIMSSKGWHLNALQRPNSLHICVTLQHTTVYDQFLKDLQDSVNTVKANPGPISGGKAPIYGAAGKMPDRGTVRELLVEFMDSSC

SEQ ID NO: 74423 - protein, 461 aa, Anabaena variabilis ATCC 29413
MATYENILQAIGQTPLVRLNRVTANVQSPIYAKVEYLNPGGSTKDRIALSMIENAEKTGQIQPGGTIIEATAGNTGVGLALIAAVKKYRCIFVMPDKMSQDKINLLKAYGAEVVVTPTSVPPDSPESYNGVAERLAKEIPGAYRPNQFENPNNPLAHYLTTGPEIWADSQGKIDVFVAGMGTGGTISGVAKYLKEQNPNIIIVGADPEGSILSGDSPKSYKVEGIGEDFIPKTFNRQLVDEMIRVSDKESFNMARRLAREEGLLVGGSCGTVVAAALKYAARLSQPKYIVVLLPDTGRNYINKIYSDVWMQENGFWEGKTVKTIKVGEILQQKTDFPSLVAVSPSDTLSQATNLLQKLNISQLPVIDNHHVVGSLNEASLMKFLYDGINFSNQQVLAVMGKPLPILDENVDVSEAYRVLLSGTTGIIITRNNIPAGLITRADLIRYWISQNQEKSKVNNGI

SEQ ID NO: 74424 - protein, 310 aa, Staphylococcus cohnii
GFGRIGRLAFRRIQDVEGIDVVAVNDLTDDEMLAHLLKYDTTQGRFTGEVEVEENGFRVNGLEVKSFSEPDPSKLPWGDLDIDVVLECTGLFTDKEKAEAHINAGAKKVLISAPAKGDLKTIVYNTNHDTLDGSEDVVSGASCTTNSLAPVAKVLNDEFGLIEGFMTTIHAYTGDQSTQDAPHRKGDKRRARAAAENIIPNSTGAAKAIGLVIPEIDGKLDGGAQRVPVATGSLTELTVVLDKNVSIEDVNNAMKNASNESFGYTEDEIVSSDVIGMTYGSLFDATQTRVMTVGDRQLVKVAAWYDNEMS

SEQ ID NO: 74425 - protein, 355 aa, Zea mays
MVSDQEIASCVESVLRGSAGGPGEVSLTAVLQQAEATLGVDLSHKAGFIRDQMDLFFGPRLQPQPLTTPQLAPPPPQAVVAPADAVPQPQPQHQLPAISPVPVVSAPPAMAFYPPPPLAFRYTTGLAGAATGGTVSFQQPAPGAGGTASPTAGTRVAGDNKESASKRKRGGPGGLNKICAISPELQTIVGETAMSRTQIVKQLWAYIRQNNLQDPDDKRKIICNDELRVVFETDTTDMFKMNKLLAKHITPLDPKDQLHEVKRMKAPTVAPQPPPINQPSVVISDALAKFIGTDGTFPQDDALKYLWDYIKANQLEDVINGSILCDSKLQELFGCESIPMSGLSEMLGHHFIKKT

SEQ ID NO: 74426 - protein, 311 aa, Staphylococcus epidermidis
GFGRIGRLAFRRIQDVEGLEVVAVNDLTDDDMLAHLLKYDTMQGRFTGEVEVIEGGFRVNGKEIKSFDEPDAGKLPWGDLDIDVVLECTGFYTDKEKAQAHIDAGAKKVLISAPAKGDVKTIVFNTNHDTLDGSETVVSGASCTTNSLAPVAKVLSDEFGLVEGFMTTIHAYTGDQNTQDAPHRKGDKRRARAAAENIIPNSTGAAKAIGKVIPEIDGKLDGGAQRVPVATGSLTELTVVLDKQDVTVDQVNSAMKQASDESFGYTEDEIVSSDIVGMTYGSLFDATQTRVMTVGDRQLVKVAAWYDNEMS

SEQ ID NO: 74427 - protein, 121 aa, Eubacterium acidaminophilum
MDSILLKEMVFYGYHGVLPEEKRLGQKFIVDVTLHMDLKAAGKSDNLEMTVSYHDVYIRVKDICENERFDLIEALAQRISDRIFNDFYKVEEVEVAIKKPQAPIEGIFDYMQVAIRRNRND

SEQ ID NO: 74428 - protein, 447 aa, Mycobacterium sp. MCS
MSVLLFGVSHRSAPVSVLEQLSTDESDQAKIVDQVLQSSLVTEAMVLSTCNRVEVYAVVDAFHGGLSVIGQVLAEHCGMSLNDLTKYAYVRYAEAAVEHLFAVASGLDSAVIGEQQVLGQVRRAYTSAEANHTVGRTLHELSQRALSVGKRVHSETGIDAAGASVVSVALDIAEAKLGSLAGRTAVVIGAGSMGALSAKHLVRAGIERVHVVNRSLPRARRLAQSLLDQGVTADAHTLDDIAHALADADVVITSTGAVRPVVSLADAHRGLTGRPEHRRLVICDLGMPRDVEPAIAGLPGVNVIDMERIQREPSARAAASDADAARSIVAAEVANYLAGQRMAEVTPTVTALRQRAADVVEAELLRLDNRLPELDAAHRAEVAKTVRRVVDKLLHAPTVRVKQLASAPGGDSYAEALRELFELDQQAVDAVAAGELPLLPIELDKSE

SEQ ID NO: 74429 - protein, 310 aa, Staphylococcus felis
GFGRIGRMVLRIALNREDIEVVAINASYPSETIAHLLKYDTTHGRFNQTVEATETGIKVEGKEIKLVSDRKPENLPWRDLGIDIVVEATGKFNHGDKAIAHIRAGAKKVILTGPSKGGDVQTIVKGVNDNTLDVDKYDIFSNASCTTNCLAPVAKLLNDEFCIKNGLMTTVHAVTNDQNNLDNPHKDLRRARAAFESIIPTSTGAAKALALVLPELEGKLHGMALRVPTKNVSLVDLVVDLNQSVTKDQVNQLFRDNNLDGVINIVDEPLVSISDDFTTDAHSAIIDAPSTIVMNDNKVKVSALVSITKC

SEQ ID NO: 74430 - protein, 353 aa, Kluyveromyces lactis NRRL Y-1140
MFSAVRSVVSSGIKTSIRTMSTIPGVQKVVLIRENGGPEVLKYEEDYPVPKIGATDLLIKNKYAGINFIEVYFRKGIYPSEKPYVLGREAVGEVVAKGDQVDKYNVGDKVAYLSASTFAQFTKYPQNGHLIKLPKDISAEKEKIIAGSLVQGLTPLTFIDEAYNVQKGDFILVYAAAGGVGLIFDQLLKARGARTIAVASTDEKLQLAKEYGAEFLINSTKDDIVEKVKEFTNGEGVAAAFDSIGKDTFETTLQVVKRKGTIVSFGNASGAVPPFSINRLSPKNLKLVRPQLFAYVADPSEWEHYSSELIRLIDSGELKITISKVYPLKDYKEATEDLESRKTVGKLILEIPE

SEQ ID NO: 74431 - protein, 357 aa, Zea mays
MAGGKEAHGWAARDVSGHLSPYHFSRRVQRDDDVTIKVLFCGLCHTDLHVIKNEFGNAKYPVVPGHEIVGVVTDVGSGVTSFKPGDTVGVGYFVDSCRSCNSCSKGYESYCPQLVETSNGVSLDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYVNTAIQRLERNDVRYRFVVDVAGSKIGG

SEQ ID NO: 74432 - protein, 183 aa, Glycine max
  misc_feature (124)..(124): Xaa can be any naturally occurring amino acid
  misc_feature (158)..(158): Xaa can be any naturally occurring amino acid
  misc_feature (171)..(171): Xaa can be any naturally occurring amino acid
MSASTVSITAANPGARRRPVIAIEKKTATNLELLANDVAVSPAVATSGDGATGRDLSHHSVRGEALLDRTPRDLAPAKKVAGGNSSSVPPRRARKLAAKAEKPRWLTLVSIFGKNMVLLVVLAXLVQLICRISDVEGLLKKTAKMIQVQVDVVDKKIXDEVRGLRRGLNEXIEEKGEILKNGL

SEQ ID NO: 74433 - protein, 342 aa, Anaplasma phagocytophilum HZ
MVTEQEVLCVLQDVTDHDTRKKVADIGKLSVTINKSDLGIILHVSEPKSALWEQQFKDNCSTIIKSKIPGISSITVALVMAKQQSNVPKRVKLKGIKNVLLVSSGKGGVGKSTVAAQLALTLSALGYKIALVDADIYGPSIPRLLGIGVLAEVDNDGMMIPVEMHGLQSISIGNIIEDQDKALVWRGPMLTKAINKLIMGTRWAARDYMIIDTPPGTGDVHISLTQGYSITGAVVVSTPHELSVIHAMKTCDMLKSLDVKLLGIVENMSYFLDVDTGKKTHLFGEGGGQEIAERADSTLLGMVSIHPKIHLPSVNKRLSPLDNEFCNAYEKIVANIIRSVSS

SEQ ID NO: 74434 - protein, 591 aa, Zea mays
MGGEAEGGERRLGRVLSFGIPDTALGLVMGYVEDPWDRDAISLVCRHWCRVDALSRKHVTVAMAYSTTPERLFRRFPCLESLKLKAKPRASMFNLISDDWGGSASPWIRQLSATFHFLKKLHLRRMIVSNEDINILVRAKAHMLVALKLDRCSGFSTPSIALVARSCRKLETLFLEESTIDEKENDEWIRELATSNSVLETLNFFLTDLRASPEYLTLLVRNCQRLKTLKISECFMPDLVSLFRTAQTLQEFAGGSFEEQGQPVASRNYENYYFPPSLHHLSLLYMGTNDMQILFPYATALKKLDLQFTFLSTEDHCQIVQRCSNLETLEVRDVIGDRGLQVVAQTCKKLHRLRVERGDDDQGGLEDEQGRISQVGLMAIAQGCPELTYWAIHVSDITNAALEAVGTCSKNLNDFRLVLLDREAHITELPLDNGVRALLRGCTKLRRFAFYVRPGALSDVGLGYVGEFSKSIRYMLLGNVGESDNGIIQLSKGCPSLQKLEVRGCLFSEHALALAALQLKSLRYLWVQGFRSSPTGTDIMAMVRPFWNIEYIVPDQDEPCPEHKRQILAYYSLAGRRTDCPPSVTLLYPAF

SEQ ID NO: 74435 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 74436 - protein, 76 aa, Populus trichocarpa
MSSHNNNSASANDPRQPLAAKPFVAPMVSPQDLPVDYSGFIAVILGVAGVMFRYKLCSACSHILCPISLKHEEYGK

SEQ ID NO: 74437 - protein, 529 aa, Anaplasma phagocytophilum HZ
MLTIAIIDFGSQVTQLIARRVRELGVYSEVFSVDTDFPALLAQGKKIAAFILSGGPNSVSELQNIPKVVSDVLEINLKTGTPIMGICYGFQLLAHSFSSTVESDKAREYGHAQLQIVGESAITKGIWSVGQTACVWMSHSDSVVDNVPQGFNVVARSMNTQAIAFISNEERKIYGLQFHPEVSHTPEGRDILNSFLTTVGCARNWTVSSFLNTQIDDIRRTVGNGVVVAAISGGVDSSVASVLLHRAIGDQLKCVFVDTGLLRKGEVETVREFFVDKLKMSVSIVSAAFLFIERLRGVVDPEEKRKIIGNTFIEVFEQEAKKLGDAQFLMQGTIYPDVIESGASGLGVKIKSHHNVGGLPENMNLSLVEPLRCLFKDEVRALGSELGLPDVILKRHPFPGPGLAVRIIGEVTEEKLQLLQEIDNIYISMLYESGLYHDIWQAFSVLIPARTVGVMGDSRTYGHVCCLRAVTSSDGMTADCFPFGEAKEKQLKFLEFLQKVSVAIVGSLPRVNRVVYDVTSKPPATIEWE

SEQ ID NO: 74438 - protein, 500 aa, Mesorhizobium sp. BNC1
MQTAHTWKADRQQSLRGHTVPTALLIAGEWIERDKSFTVTNPATNEEIARVSDGTAEDALRALEAATASQEAWAAWAPRQRANLFHRAHRLMLERATAFAEVMTLESGKPLAEAKAEFALSADFFLWYAEQIAHLHGTFASGSPGGYRIIATHRPVGPCFLVTPWNFPLLMIARKGGAALAAGCTTIVKSARETPLTAALFAQTLLEAGFPAGTVNLIHTTSSASISEALLADPRLRKVSFTGSTEVGSRLLSGAAQNIVNASMELGGDGPFVVLEDADIDLAVRQAIICKFRNAGQACVAANRIICHAAVVDEFTQKFVDETRKLRVGDGFEPGTDVGPIISSPQLERVDRMVAMLKDAGAELLTGGKRKGVTGNFYEPTVMRIKGSAPACRNEELFAPIAVIYSVDSVAEAIRFANDTIYGLAAYVFTRNVDRAIAVSEKLDFGMVGINRGIMADPAAPFGGIKSSGLGREAGHDGIYEFLEPQYLALTVNEAAGISQ

SEQ ID NO: 74439 - protein, 345 aa, Brassica oleracea
MKKEMIEEVVIVGGLVMVQFVYAGNSLLMSYLMSLGLGPFTIVIFSTFATFLILSPFAILFERKQWPKELSARLIGKLVLISFAGVTLFQSLFLEGIRLTSPAMATAMPNLAPGLIFFIAWIVRLEKMNMKCVYSKLKILGTLLCVFGALTMSLMHSASIIQDEKDNASIFVFDRDRVVGCIYLLGAVFVLSTNVVLQASTLAEFPAPISLSAITALIGVLITMLVQLLQNQSGKVLTRSLISIGNLVGFSLLGGMVSGACVSFNGWAMKKRGPVMVSMFSPFATVISVGFSVLTLGESICLGSVGGMALMFMGLYLVLWAKGKEGFSQIESFECEFDAKKPLLS

SEQ ID NO: 74440 - protein, 117 aa, Oryza sativa
  misc_feature (74)..(74): Xaa can be any naturally occurring amino acid
MPISKIHARSVYDSRGNPTVEVDVVTETGLHRAIVPSGASTGQHEACELRDGDKTKWGGKGVLKAVANVNETIXPAIIKENIDVKDQSKVDEFLIKLDGTPNKTKLGANAILGVSLA

SEQ ID NO: 74441 - protein, 339 aa, Vitis vinifera
MWVRDESNRPLYEESECPYIQPQLTCQEHGRPEKEYQFWRWKPHDCSLPNFNATLMLETLRGKRMMFVGDSLNRGQYVSMVCLLHSLIPEDAKSMETFDSLTIFTAKEYNATIEFYWAPFLLESNSDDAVIHRVSDRIVRKGSINKHGKYWKGVDILVFNTYLWWMTGLKMKILRGSFDDEVKDIVEITTEDAFRMAMKSMLKWVEKNMDPKKTRVFFTSMSPSHAKSIDWGGEAGKNCYNETTMIEDPTYWGSDCRKSVMEVIGEVFSKSKVPITFLNITQLSSYRRDAHTSIYKKQWSPLTPEQLANPVSYADCVHWCLPGLQDTWNELLFTKLFYP

SEQ ID NO: 74442 - protein, 496 aa, Oryza sativa Japonica Group
MDHQLVARGLFKPLLLFVAGLIVLYALRRRRRHRRSSGLRLPPSPFGLPILGHLHLLAPLPHQALHRLAARHGPLLFLRLGSVPCVAACSPDAAREVLKTHEAAFLDRPKPAAVHRLTYGGQDFSFSAYGPYWRFMKRAADGGERVDVDAALMGLTGDIVSRMVMGRRWTGDDNDAEEMRSVVAETAELTGTFNLQDYIGVFKYWDVQGLGKRIDAVHRKFDAMMERILTAREAKRKLRRQAAADGEDDEKDLLDMLFDMHEDEAAEMRLTRDNIKAFMLDIFAAGTDTTTITLEWALSELINNPPVLRKLQAELDAVVGGARLADESDIPSLPYLQAVAKETLRLHPTGPLVVRRSLERATVAGYDVPAGATVFVNVWAIGRDAAWWPEPTAFRPERFVSGGGGGGTAADVRGQHFHLLPFGSGRRICPGASLAMLVVQAALAAMVQCFEWSPVGGAPVDMEEGPGLTLPRKRPLVCTVSPRIHPLPAAASASLT

SEQ ID NO: 74443 - protein, 332 aa, Buchnera aphidicola str. Sg (Schizaphis graminum)
MTIKIGINGFGRIGRVLFRLAQERENIEVVAINDLLDPKYIAYMLKYDSTHGNFKKDIEVKNNNLIINGKKIRITSIKDPEKLMWDKLLIDVVIESTGLFLTKDTAYKHILSGAKKVVITGPSKDDIPMFVRGANFDKYKGEKIVSNASCTTNCLAPLSKVIDDHFGIIEGLMTTVHASTATQKIVDSASKKDWRGGRGALQNIIPSSTGAAVAVGKVLPNLNGKLTGIAFRVPTANVSVVDLTVRYKKTATYNEICEVVKNASEQKMKGILGYTEDEVVSTDFNGKELTSIFDAKAGLSLNKNFAKLISWYDNETGYSSKVLDLVELVALK

SEQ ID NO: 74444 - protein, 315 aa, Pinus pinaster
LYEMIFSAVKPLALKAAVLLNLPDIIATRGNGGPLSAEQIAFHIAAANSSSTGNSHVDVGYLYRILRFLASYGVFAEQEEADQPDDAETKKIKFGLTGISKLLVHGGNGQSRGPVLLLIANNVLLEAFQHLHESVLEGCYTFNKAHGMDLWEYLANNLEFNKIFNEAMATNTRSVMASVAKMYEDGFKSMATLVDVGGGMGSALSIIVKEHSHIRGINLDLPHVIATASITGVEHMEGNMFEHIPSADAVMMKWILHDWADEECVNCREEATTQRSEGKVLVVSSCCGDKSEACRAIGLLYDISMMVTHWWKNER

SEQ ID NO: 74445 - protein, 293 aa, Polaromonas sp. JS666
MFFTKPVILEWRPEIAYRLPLLPLPAAPFLTPVFTSSLSFPPDCHTMYKLVLIRHGESTWNLENRFTGWTDVDLTETGIQQAKDAGKLLKAEGYDFDLAYTSVLKRATRTLWHVLDEMDRTWLPVVNSWRLNERHYGALQGLNKAETAKKYGEDQVLIWRRSYDTPPPPLAANDERCERGDPRYAKLPPEQVPLTECLKDTVARVLPFWNESMAPAIKAGKRVVVAAHGNSIRALVKYLDNISDSDIVGLNIPNGIPLVYELDAQLRPLRHYYLGDSEAAARAVAAVSAQGKA

SEQ ID NO: 74446 - protein, 79 aa, Glycine max
MSEKGRPLPKFGEWDVNDPTSAEGFTVIFNKARDEKKTGGNPDSPGKTATDPHSKPAVEPGKTQTKKWFCCMQNPSAES

SEQ ID NO: 74447 - protein, 484 aa, Oryza sativa Indica Group
MEMTTTKRQQDHQVETMTTKKIDEEDEEVDDDGRAKRRGTVWTAASHIITAVIGSGVLSLAWAIAQLGWVVGPTVMLLFAAVIYFTSNLLADCYRTGDPATGRRNYTYMEAVKANLGGAKVKVCGCIQYLNLLGVAIGYTIAASISMMAIQRSNCFHARGEQDPCHASSNVYMIMFGIVQVFFSQIPDFDQVWWLSILAAVMSFRYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 74448 - protein, 309 aa, Zea mays
  misc_feature (10)..(10): Xaa can be any naturally occurring amino acid
VRKPDCVPGXDPRSFPGIGSGSHGGGITPVTPSHSHGGSTGSPSHGGTTLPSPSHGGSGGDLPSPSHGGTTLPSPSHGGSGSTPTSPSTGGSPSHGGSGSSPTAPSTGGGYGGSPSHGGGAYGGSPSTPGSGGAYGGGSPSPAHGGGAYGSSPTPAYGDAPSHGGIGTSSPTPFDPHSFGSLPGSCDYWRSHPMEIWSAIGGRFPGTSSSMGTMGHFFGAAGRVGGTDVSIQDALANTRSDGAGALLREGAAALLNSMTRSGFPYTTEQVRDTFAAAAAAAAGGSDGAAALEYPSRGPSLRVPSFLYKV

SEQ ID NO: 74449 - protein, 207 aa, Arabidopsis thaliana
MSRSLGIPVKLLHEASGHIVTVELKSGELYRGSMIECEDNWNCQLEDITYTAKDGKVSQLEHVFIRGSKVRCCTCFLVYVIHGIILVNPSCLVIDLRIYLDRFMVIPDILKHAPMFKRLDARIKGKSSSLGVGRGRGAMRGKPAAGPGRGTGGRGAVPPSFCDIQVKAAFLGSVINALENTVKPNKRERYPDALLVLYFGLPRCLNH

SEQ ID NO: 74450 - protein, 578 aa, Schizosaccharomyces pombe 972h-
MQFCFRILILYISLSIDNNYLVTTLISLKENVFLHIFTLTFLFKAFLLKMAKRSVEELKRSADEEASVKRKEKKSKHEHKKHKKDKPSADKDRISKKDKKKSKKGKSKTKEESIEINAEEGAKIAQPAIGSANASNHNDEEAYDRYIKKHNISFADPKSSENLLPILQFDELDVSAKLREGLKNYKEPTPIQAATWPYLLAGRDVVGIAETGSGKTVAFGIPALQYLNGLSDNKSVPRVLVVSPTRELAIQTYENLNSLIQGTNLKAVVVYGGAPKSEQARAAKNASVIIGTPGRLLDLINDGSIDCSQVGYLVLDEADRMLDTGFEQDIRNIISHTPDPTRNGSRQTVFFSATWPESVRALAATFLKDPVKITIGSDELAASQNITQIVEILDDPRSKERMLDNLLRKHLSSGGKDDKILIFVLYKKEAARVEGTLARKYNVVGIHGDMSQGARLQALNDFKSGKCPVLVATDVAARGLDIPKVQLVINVTFPLTIEDYVHRIGRTGRANTKGTAITFFTPQDKSHAGELVNVLRQAKQDIPEGLFKFGTAVKPKLNAYGSRVVDVPVKAATKIVFD

SEQ ID NO: 74451 - protein, 721 aa, Photorhabdus luminescens subsp. laumondii TTO1
MNKKILILPGDGIGQEVCDAALPVFQALNLPVTLEIGDIGWTCWEREGNPVPANTWEKIASVDAVLLGAITSKGKEEAQQALPPHLRVKTRNYVSPVIQLRQRLGLYANIRPVRYVEGDRKPFRCCVIRENSEGLYAGFDFKGIPATATTWLQHPNIDKYGPEEAAWTVRLQTRFGLERLFITAFEYAKENNYSRVTFADKPNVMRESGHFAKGIFDTVAAGYPEIKADIHNVDAIALWMVKKPHEFGVIVSENMFGDILSDLAAGVMGGLGLAPSANIGSDIAYFEPVHGSAPGMAGKNKANPAAMFYTIALLLEHLGFADAAQQINCAVDNVIREGRTVTYDLGGSATTQQMAQAIISTLSKKCTSYSASVITVGDELLSGKYPNTNLQDISEYLTEQGYKVKQHQVCADDINQIATAVVRRLGQDTLIVVCGGLGPTLDDKTREAIAKVAGSPLEIRDNVWVEIQKQLEKLGVYCDHSNRFQAMFPSGAKVIPNVTGTAPGFSLNVDSSKIVVLPGPPSQMRLMLSEEHSIPPVAGMRERNYHWTLIGVSESKVGTMVNAFFDGVECDIHYLWKAPYVVVQVITPADAPLSVRQLVNFGAMFENKLVSDCQMTAMEKLSEQYRINWFTDDDELNTYLHTTYAVNNPSKSLSVNITAFPSISSFLSGEEMLGQMTLTTIDDEGRQHSVDFPCNKLLLQQSIPEYAAWSVLCARASKEEM

SEQ ID NO: 74452 - protein, 1614 aa, Cryptococcus neoformans var. neoformans B-3501A
MSRTPISPRPNSNPRVPPSSAAFLQHLHSDPSSHHITLSGHRVSGLSLSPQSLTGEGDLLDINGTSEPSISPSLHSHLSPVSSGTSSGPSPLGSVGRAPSKRARPKTAPSRNDEWPLGRSYETSPDLPPLIPPQADEHLRSSPVGDLCTNAMTMDEGLVDAMEALSTSGEPKSYLIGRSESLAGTAESHTGPSKPSPASMNWSTFAQAYAHGLFDPNRVPNPPTPNETPTEFQSARSSPGQKYSSLPLNHKYSMPTVPHNRSGSSSENYSSKSSKDSVSTNASSAPSTSSASASGKQMSMAASLAARKKAYELENIRSKPSGLALNTDKLSLPSYSLAAATVRMASTSILNDLAPLSMPSPERELTDPLASVVSFDSSSTKKDSARSDPGSSRFPLHHSVSSAANPYTSSLRLPTIQASPVTTPLEGPHRPKVNSRIPSASAPLEKTAEAESSTDYFGAVAVAAVSPQETDSSSTATDPTPTGPSLELRKTTPLRSNSVVPEPSPRQQKDPLPPLVTPSDLNRIYDQYGWLPAPLPPDEAARRRALYRFSILHSAPDINFNRIAHMTKLVFNPKAVLITLIDSDTQWFKSQSGFTVEQGGRISSFCAHTILPRTDEPFVVLDTSSDWRFENNPNVVGPNSIRFYAGAPLRTADGFNVGALCILDDKPRTEFPPRSRLILKEFAAVTMREMELWRDKLQLRVRDKIQTSMEKFTRECLEMDSASPTSDAETVNKMEHVYSRAAQLVCSTIGLDGCFILDISQIEMVQTNTPTGKKSTYRANPYGAAENTSPVLERSESFGPVNPFPVLAAVPTAKSTRALTPYEHEKLSDFMQNHHDGRIFEGAAPQWIRYMFPQSFRYGMAVPIYGVDQQPFAMICAYTANPEKQFLEGYELQFLRAIGVIILSAVLRRRMALADKTKSILISSVSHELRTPLHGILAAAELLSDTQLDSNQLSFLKTVQTCGNSLIETVNHVLDFTKLSGTQSCKGSPSDLGKVNLAALVEQTVEGCWIGQRARFFMGDSDIGSFYAPPAPTSIVPKSKRALVGEELSHVETVVDIDMREKGWMVRCEKGGLRRVLMNLVGNSFKFTKNGYIQVSLREMPHEPGSKTIPVEMTVVDTGKGIGKDFLKDQLFHPFSQENPLQTGTGLGLAIVNTIVRSDSVNGKVDVWSAEGVGTEIKVTFDVEVVDDDDGQPSISSSSSVVSATSTFGHGLSVSFVGFNPKHQGHMLSCEVFTRYVNYWYFSIEDQQRADILIVNELEELVNHPMAAQKPILLLSVQRGFESTALAEKINRGGGFCQVVYKPVGPSALQKALNAAVHWIEERDSSDKSDILGGNVTGINLEGNSYRPSISRGSSGESHESHSTISELSNARFNQQSSINSRLPLQRRRSEENEQAPRRPSMAPRGMTYHSSRKMQRSSNDSAGSTPSQVPPSPTSSIPTIPLADGGVMLKAATVSAEAPRKEKMGRVMVVEDNVINRRVLGAFLKKRGFEYAEAVDGQAGVELFENAPPNYWDVILMDISMPIMNGHQATRAIRRIEATRRNSLSDIPIVPPPGKPVTISSQKAVQARVKIFALTGLATPDDKREAFWSGVDGYLVKPVSLSSLDIIFKKIGF

SEQ ID NO: 74453 - protein, 429 aa, Streptomyces avermitilis MA-4680
MTTAPILYSTDNIEDFALDPVERAIADIAAGRPVVVVDDEDRENEGDLVIAAEKATPEIVAFMMSECRGLICAPMEGGELDRLQLPQMVDHNTESMRTAFTVSVDASGAHGVTTGISAADRATTLRLLAQGEAGAADFVRPGHIFPLRAKPGGVLVRNGHTEAAVDLARLAGLRPAGAIVEIAGEDGHMLRLPELIPFARKHGLTIISIEDLIAYRQSSEPTVRREAEVHLPTAFGEFTAYGYRSTVDGVEHVALVHGEIGDGEGVLVRVHSECLTGDVFHSLRCDCGPQLEASLERIRSEGRGVVVYLRGHEGRGIGLVSKLRAYELQERGRDTLDANLELGLPADARDYAAGAQILEDLGVRSLRLMTNNPDKTDALLRHGLKVTGREPMPVQAGEHNLRYLTTKRDRMGHDLPWLDTVPVSTCGNQ

SEQ ID NO: 74454 - protein, 442 aa, Brucella melitensis 16M
MLTKTNAPSLDNFWMPFTANRQFKAAPRLLASASGMYYTDVDGNQVLDGTAGLWCCNAGHGRKRITEAVERQISTMDFAPIFQMGHNVAFDFAEKLAAIAPGGAEAKLDRVFFTNSGSESVDTALKIAIAYQRAIGQGTRTMVLGREKGYHGVGFGGISVGGLVNNRCVFPQIPADHLRHTLDIEKNAFSKGLPANGIELADDLERLVQLHGAEKIAAVIVEPMSGSAGVILPPKGYLERIRATADKYGILLIFDEVITGFGRLGTPFAVDYFGVVPDLVTTAKGLTNGAIPMGAVFAARKVYDGLMTGPENAIELFHGYTYSGHPVASAAGLATLEIYAEEGLLTRGAGLADYWQEALHSLKGAPNVIDIRNLGLVGAVELASRKDAPGARAYDIFVECFKKGLLIRVTGDVIALSPPLIIEKEQIDTIISVLGDAIKRAA

SEQ ID NO: 74455 - protein, 247 aa, Triticum aestivum
  misc_feature (216)..(216): Xaa can be any naturally occurring amino acid
MATSALATLSATAADEGARRVLLSRGPASSLSFASRRLMPVGTLRAGPLPRAETRVLSATVSPAATTTIAVRDRFPDATLSYFDAPDGELKMVTVRYLTVGNKVVLFAVPGAYTPNCTQKHLPGFVARAGELIAKGVDTVACVSVNDSFVMRAWNESLGVSNEVLMVTDGNGELTRAMGVELDLSDKPVGLGVRSRLIALLADNGVVKVLSLRGGXALTNSSPEDMLKGAQSALTGTLSRTRKGLSV

SEQ ID NO: 74456 - protein, 161 aa, Streptomyces avermitilis MA-4680
MSGKGAPELSVRNCGDLRVAVIAAQWHEKVMDGLVDGALRALHELGIDEPTLLRVPGSFELPVVAKVLAGRGYDAIVALGVVIRGGTPHFDFVCQGVTQGLTQVSVDTGVPVGFGVLTCDTEEQALDRAGIEGSHEDKGHEAVTAAVATAATLRSVSEPWR

SEQ ID NO: 74457 - protein, 612 aa, Ustilago maydis 521
MQRYISPLFTALLVLSSTWMVFAKTVQHDWTISPLYEAPVLELDQGDDVEISIHNSLPVDITIHWHGILQIGSPEMDGVPGVTQWAIPPLGDYTYKFTPTNQTGLHWYHAHLRGYLDDGVKGLLYIRPSAQRPRPFQLIDPSGDQVAAMQQAEDSPRNLALYDWKHVQEDEALAMFFASGRPTTCVDSVLFNGKGSIYCASAETLNQAAGGRFDAMPFFESKLDARGCLVIPGSGIYSAHTITSPMGCSNSTGQLEIVPTHSEWTLINLANVGGEWTWVFSIDAHDLWVISADGDYIVPEKVQALPVSIGQRYGVMVRTDKPDGGDYYIRANSAGFAQVMGGVGILRYQDAPHQKRRTTEQTSVSVADPWRDMSRSHVKYNATPAEGTSTYDPIKSMPFIADAPPSKVDRTLIFHANQSEPTVFSIASRPLRMVEELNLPVLFSNSSQYTGTRDPDWLIRIAKGDVVDVILQNAQNALFPAPAEPPHPIHLHGHKFWVLGSNEYDDWQFQSAAEAMAHGVQLNLDNPPKRDTFLLPTAGWLVLRFVADNPGAWMLHCHRMGVVFLEGEDEIAAIPDRFQKRPTAHVAHQGWQTDARTKRSLDDSARHPALFV

SEQ ID NO: 74458 - protein, 542 aa, Pediococcus pentosaceus ATCC 25745
MTEKAMSILNNPYLNKGTAFTKEERDQLGLNGLIPPYIQTIDEQVEQVYAQFQTKANDLEKRLFLMQIFNENRVLFYKLFSQHVVEFMPIVYDPTIADTIENYSELYVQSQNATFLSIDDPDMMEEALKNSAAGRDIRLIVVTDAEGILGIGDWGTNGVDISVGKLMVYTAAAGIDPSQVLPVVLDVGTNNQDLLKNPMYLGNRHERIKGDRYYDFVDKFVETAENLFPNMYLHFEDFGRDNAANILNKYKDRYVIFNDDIQGTGIITLAGILGALNISKQKITDQVYLSFGAGTAGAGILGRIYEEMIENGLSEEEAKKHFYMVDKQGLLFDDDETLTPEQKPFARKRSEFDNADELTDLLSVVKAVHPTIMVGTSTQPGSFTEEVVREMAAHTERPIIFPLSNPTKLAEAKAEDLLKWTDGRALIATGIPVGDIEYNGVTYQIGQANNALVYPGLGLGVIASTAKVLNDTMISKAAHSLGGIVDVDQPGAAVLPPVSKLSDFSNTVAKAIAQSAVDQGLTKEKIDNVDQAVEDTRWNPEY

SEQ ID NO: 74459 - protein, 365 aa, Anaplasma phagocytophilum HZ
MTSEFHNAVIVLSDGRYFFGRSLGKRTDCVGEVCFTTGVTGYQYTITDPSFAGQIVTFTFPHIGNVGINSKDFECEQVLAKGIVVREISGASHVSSHIDLNSWIEQNNFTGISGVDTRALAIHLRENGTLGGVIHHFDDIGAVHIQELQNVARTHKKSLATELPHLMDHSHHVDGHSVCVIDFGAKHGIFSALTRIGCAVHVVAAQNDFAARALSLKPRGIVISNGPGDPADISDPVMDQLRVLIDSGIPVLGICLGHQLIAKALGAKTIKMHHGHRGSNHPVYSLETKSVEVTSQNHGYTVDASTLPDNIEVTHISLFDGTVEGIKMTNRPVLSVQYHPEGCPGPNDSHYIFRKFADLITSAHA

SEQ ID NO: 74460 - protein, 353 aa, Polaromonas sp. JS666
MKIVVIGAGAWGTALAVNTAGAVEAAGSDAPRHQVTLWARDAALVKAMQAERANTRYLPGVALPGNLLLQGGGETSLAEAVSGQDLIILATPVSAARGLLQSLQQASVPVVWLSKGFEAPVAAVPHSAPSLASFGLMVHEIRAQVATDLRAGILSGPSFALEVARGQPTALVAASEHAEVRDALVAAFHGTSLRIYASDDIVGVEVGGAVKNVLAIATGLCDGLQLGLNARAALITRGLAEMTRLGVTLGARAETFTGLSGLGDLVLTATGDLSRNRKVGLQLAQGKTLAEAVKSLGHVAEGVYCARTVVQRAAGLGVDMPIAQSVVALLDGKLRPAEAVAALMGRGPTTELA

SEQ ID NO: 74461 - protein, 331 aa, Aspergillus fumigatus
MAIEFTQDTLDEIYAFAVALGRRAGDLLLERIDKQIASDGETAYTYTEKDNAVDIVTQTDEGNPIDTSTPSTKERKKVAKFLGEETYAQGQSRSYLIDAHPTWCIDPLDGTVNFTHLFPTFCVSIGFLVNHRPVIGVIYAPAMNQMFSSCVGRGAWLNDTRGARRLPLRRNPIPPMPATSPRGCIFACEWGKDRRDIPGGNMARKVESFVRMASESGGMVHGVRSLGSAALDLAYTAMGAVDIWWEGGCWEWDVAAGIAILREAGGLVTTANPPANPETDPIEEARLGSRLYLAIRPAGPSETETGRQTQERTVREVWKRVRELDYTRPGA

SEQ ID NO: 74462 - protein, 393 aa, Buchnera aphidicola str. Sg (Schizaphis graminum)
MNRINILVPDLPESVNDAVVVKWYKKIGEQISSEDNIVDIETDKVMLEVSAPCNGILNEILEKEGSIVKSNQILGNIVESKNIESKTKSKLEKSNKYFIKDKNFNISFKEKIYNFPPSIRRIIRIKKNKEIFNELNYIKNQENIIEEKLNDQSFSNEKEKKIYENRIKMTRLRQKIAERLLETKNNTAMLTTFNEVNMQPIISLRKKYGEFFEKKHGVRIGFMPFFVKAVVESLKKFPEINASIDKNDIVYYKNIDVSIAVSTPRGVITPVLRNADNMSMADIEKKIKEFSIKGIENKIKIEELIGGNFTITNGGIFGSLMSTPIINPPQSAILGMHLIKERPMAINGKVKILPMMYLALSYDHRLIDGKESVSFLVTIKNILEDFNRIIINV

SEQ ID NO: 74463 - protein, 230 aa, Buchnera aphidicola str. Sg (Schizaphis graminum)
MKTNKLVLIRHGQSKWNKLNKFTGWHDIELSDNGINEALKAGSLLKKEKFFFDYAHTSMLKRAIHTLRYILDTLDQSWLPVQKSWRLNERHYGALEGLNKDEMISKYGEEQVNLWRRSFEIIPPQIRLNDKRFPGNDIRYSNIDNNELPLGESLELTAKRVIPYWNKFILPQIKKRNRVLIVAHGNSLRALIQFLNKIDNKKILELNIPTATPIILEFNEEYNSIKWYYL

SEQ ID NO: 74464 - protein, 181 aa, Glycine max
  misc_feature (168)..(168): Xaa can be any naturally occurring amino acid
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVDYALAQGLKVIACIGETLEQREAGTTMEVVSAQTKAIAEKTSDWTNVVLAYEXPGWAIGNRAGCFP

SEQ ID NO: 74465 - protein, 126 aa, Oryza sativa Indica Group
MSRSLGIPVKLLHEAAGHVVTVELKTGEVYRGSMVECEDNWNCQLDNITFTAKDGKVSQLEHVFIRGSRVRFMIIPDMLKNAPMFKRLEARIRGKGSAIGVGRGRAVAMRARGVRAKIDNGPYPLF

SEQ ID NO: 74466 - protein, 136 aa, Glycine max
MSSASTGSSSSSKIRRIVRVRQMLLRWRRKVAVDVPAGHVAVCVGPSRRRFIVRATHLNHPIFKMLLVKAEEEYGFCNHGPLAIPCDESLFEHLLRVVARPVPLPGFSSLEDFQTRCHVDFVGGESWPLLRDEPIC

SEQ ID NO: 74467 - protein, 254 aa, Buchnera aphidicola str. Sg (Schizaphis graminum)
MKKKIIAANWKLNGSIKTISYFLTFLKSQISSFLKNNIIIIAPPTVFLERVYKDINSINIHLAAQNIDVNLTGAFTGENSALMMKDIGVKYIIIGHSERRLLHNENNEIIAKKFCLVKNLNLVPILCIGETEAEKKSNKTEKILKEQLNSIFNSFGEKAFRNAVIAYEPIWSIGTGVSADPKNVQLIHKFIKNYIKKYDIVSAENLIVQYGGSVTSLNAGNFLKQPDIDGLLIGSASLKHEEFLKIIKISDSFL

SEQ ID NO: 74468 - protein, 538 aa, Arabidopsis thaliana
MLDSLVSKLPSLSTSDHASVVALNLFVALLCACIVLGHLLEENRWMNESITALLIGLGTSVTILLISKGKSSHLLVFSEDLFFIYLLPPIIFNAGFQVKKKQFFRNFVTIMLFGAVGTIISCTIISLGVTQFFKKLDIGTFDMGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 74469 - protein, 295 aa, Rhizobium leguminosarum bv. viciae 3841
MNETESEMQARLLAKALPFMQRYENKTIVVKYGGHAMGNPELGKAFASDIALLKQSGVNPIVVHGGGPQIGAMLSKMGIESKFEGGLRVTDQKTVEIVEMVLAGSINKEIVALINQTGEWAIGLCGKDGNMVFAEKARKTVKDPDSNIERVLDLGFVGEVVEVDRTLLDLLARSEMIPVIAPVAPGRDGATYNINADTFAGAIAGALNATRLLFLTDVPGVLDKNGQLIKELSVAEAHALIADGTISGGMIPKVETCIDAIKAGVQGVVILNGKTAHSVLLEIFTEHGVGTLIVP

SEQ ID NO: 74470 - protein, 451 aa, Oryza sativa Japonica Group
MAAKAAALSSSPFVSSRRLSSPAASLRARTPRCVMGSEQVRVVVEEEGKTKKRMGVAEPRSAPPAVWTPRAPAQEARLAALRTDGRDSRLKIFSGTANRPLAQEIASYLGVDLGKVLIKRFADGEIYVQLQESVRGCDVFLVQPTCSPVNENLMELFVMIDACRRASARSITVVIPYFGYARADRKAQGREAITAKLSANLLTEAGSDRVIVCDIHSTQALGYFDIPVDHIHGQPVILDYLASKTISKDLVVVSPDVGGVVRARAFAKKLSDAPLAIVDKRRQGHNMSEVMHLIGDVKGKVAIMVDDMIDTAGTITSAAALLKQEGAEAVYACSTHAVFSPPAIERLSGGIFEEVIVTNSILLPEHKCFPQLTVLSMANLVAETIWHVHRDGSSSISTSETHSLPLTKEASDALPGYNQPRGHMTLLPTTKEASDAPTYGGVVILASEAQL

SEQ ID NO: 74471 - protein, 173 aa, Helicobacter pylori 26695
MNLEKLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFENKESAIKVLEKAIKAYQG

SEQ ID NO: 74472 - protein, 421 aa, Arabidopsis thaliana
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVSLEGTNVEQGKRILKESGMKLITADDLDDAAEKAVKALAH

SEQ ID NO: 74473 - protein, 135 aa, Glycine max
  misc_feature (18)..(19): Xaa can be any naturally occurring amino acid
  misc_feature (23)..(23): Xaa can be any naturally occurring amino acid
  misc_feature (25)..(26): Xaa can be any naturally occurring amino acid
  misc_feature (30)..(30): Xaa can be any naturally occurring amino acid
  misc_feature (37)..(37): Xaa can be any naturally occurring amino acid
  misc_feature (55)..(55): Xaa can be any naturally occurring amino acid
  misc_feature (80)..(81): Xaa can be any naturally occurring amino acid
  misc_feature (88)..(88): Xaa can be any naturally occurring amino acid
  misc_feature (94)..(94): Xaa can be any naturally occurring amino acid
DPRDRRAQKHTAERGGGXXGGDXGXXGRGXGGRGRGXDRGRGRRRGPRREEEEKXGPGTKQGRRGKEGRSRSPEQSDRHXXPSKEHQXTDTRGXPTRKDEGRKSTPAQKQTRAGQRTRRKARGGGGDNSGHDRAG

SEQ ID NO: 74474 - protein, 291 aa, Oryza sativa
  misc_feature (150)..(150): Xaa can be any naturally occurring amino acid
  misc_feature (242)..(242): Xaa can be any naturally occurring amino acid
  misc_feature (258)..(258): Xaa can be any naturally occurring amino acid
  misc_feature (268)..(268): Xaa can be any naturally occurring amino acid
MWTSCARANTRGRQLATQPGGAPQNPLLLLPRPRILPSPLLCKSLPPRFPISARSKPLLIPTTTSLLGGIFAAFLYINPSPVYTSTPHSPPPPHTRSSREKTTTKMMDLADPNHRLIAGAALLVATLAFIKLLLSSAGGGKKRLPPTIPXAPLVGGLLRFMRGPIPMIREEYARLGSVFTVPILSRKITFLIGPEVSAHFFKGNEAEMSQQEVYKFNVPTFGPGVVFDVDYSVRQEQFRFFXTEALRAKQLRNYVDQXMVVQAEEYFXSKWGKSGTVDLKYELEHLIILNG

SEQ ID NO: 74475 - protein, 88 aa, Oryza sativa
SWAVLYCSKILIELFCQFSCYFFLLSFELLVLVLQTVVPERVLKMEEAIKSRNFESFARLTCADSNQFHAVCLDTSPPIFYMNDTSHR

SEQ ID NO: 74476 - protein, 492 aa, Arabidopsis thaliana
MQSDNGKLFIGGISWDTNEERLKEYFSSFGEVIEAVILKDRTTGRARGFGFVVFADPAVAEIVITEKHNIDGRLVEAKKAVPRDDQNMVNRSNSSSIQGSPGGPGRTRKIFVGGLPSSVTESDFKTYFEQFGTTTDVVVMYDHNTQRPRGFGFITYDSEEAVEKVLLKTFHELNGKMVEVKRAVPKELSPGPSRSPLGAGYSYGVNRVNNLLNGYAQGFNPAAVGGYGLRMDGRFSPVGAGRSGFANYSSGYGMNVNFDQGLPTGFTGGTNYNGNVDYGRGMSPYYIGNTNRFGPAVGYEGGNGGGNSSFFSSVTRNLWGNNGGLNYNNNNTNSNSNTYMGGSSSGNNTLSGPFGNSGVNWGAPGGGNNAVSNENVKFGYGGNGESGFGLGTGGYAARNPGANKAAPSSSFSSASATNNTGYDTAGLAEFYGNGAVYSDPTWRSPTPETEGPAPFSYGIGGGVPSSDVSARSSSPGYVGSYSVNKRQPNRGN

SEQ ID NO: 74477 - protein, 260 aa, Pseudomonas fluorescens Pf-5
MTVTLKTPEDIAKMRVAGKLAADVLEMIAEHVKPGVTTEELDRICHDYIVNVQGAIPAPLNYKGFPKSICTSINHVVCHGIPNEKPLKDGDTLNIDVTVIKDGYHGDTSRMFHVGTVPVWAERLSQITQECMYKAIELVKPGCRLGDIGEVIQKHAEKNGFSVVREFCGHGIGKVFHEEPQILHYGRAGTGMELKAGMTFTIEPMINQGKADTKVLGDGWTAITKDRKLSAQWEHTLLVTETGYEIFTLRSDDTIARVSA

SEQ ID NO: 74478 - protein, 343 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKSPNGIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMAIFVRRTVGGGGNTQLERNEPGTKPMARVLLLRTCVAEHLSENMGRQTRERERSSDHSLGPCQGQFVGSARKIHR

SEQ ID NO: 74479 - protein, 485 aa, Oryza sativa Japonica Group
MSVQEYLEKHLLSRKIEEAVNAAVRAKAPDPVLFISNHMRRAAPAVITSVRARQILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEVPLYKHIAELVGKSATTLPIPAITVINGGTHAGNSLPIQEIMILPVGAKNFEEAMQMGSETYHHLKDIILEKYGSNSCNIGDDGGFAPNISRQWNYAIQYCWSAVNLMAYINRTTLNHRSRELEQQLECVVCYGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 74480 - protein, 113 aa, Arabidopsis thaliana
MIRTFCFSFVIRLSYKANPSLLYCDNNRRYQDYSCFVLQVLLMVNAIKGVFVSCDIPMTQFIVNMNNSMPPSQKFIIHVLDSTHLFVQPHVEQMIRSAISDFRDQNSYEKPTS

SEQ ID NO: 74481 - protein, 291 aa, Micrococcus luteus
MLQEKLTMNRDFLNLINESLLNKYHPAQSRLHEAINYSLSAGGKRIRPLLVLTTLDSLGGNAHDGLPFGIALEMIHTYSLIHDDLPAMDNDDYRRGKLTNHKRFDEATAILAGDALLTDAFQCILNTQLNAEIKLSLINLLSTASGSNGMVYGQMLDMQGEHKTLTLNELERIHIHKTGELIRAAIVSAGIIMNFNDAQIEQLNIIGKNVGLMFQIKDDILDVEGSFENIGKTVGSDLNNDKSTYVSLLGLEASKQLLNDKLTETYDALKTLQPINDNLKTLITYIVERNK

SEQ ID NO: 74482 - protein, 584 aa, Kluyveromyces lactis NRRL Y-1140
MKEDEYDMSKMDNLLSPSSGDLEMKFSDGIMSKETEIDLDKKEDKNKNIVRRMIDSFKPPLDGSYHSDNLKRKLKSRHLIMIAIGGSIGTGLFVGSGKALATGGPLAMIIGWSIAGSQMVGTIHGLGEITMRFPVVGAFANYSTRLLDPSISFMVSSIYICQWYFVLPIELIASAMTVQFWTTKVDPVVWVAIFYVIVVSVNLFGVKVFGEAEFAFSLVKVITIIGFIILSIILICGGGPDHRFIGTEYWHHPGALANGFKGVASVFVTASYSLGGSEMVCLCSAETDPKELPHAIKQVFWRIVFFFLVSLTLVGFLVPYTNENLLGGSSVNNSPFVIAIKLSGIRVLPSIINAVILISILSVGNSCIFASSRTLCSMAHQGLIPRVFGYVDRAGRPLVGIIVNSLFGLLAFLVKSASMGVVFDWLMAIAGLATCVVWLSINISHIRFRLAMKAQNRSLDELEFKSSVGVYGSIYSATVNILILIAQFYISLWPVGGWTSSQQRTESFFKNYLCALVLVFVFVTHKIYFKCSTGKWFDFKPLAEIDLETDRKNIDIEIVKQEVREREMYLASKPWYIRFYNFWC

SEQ ID NO: 74483 - protein, 358 aa, Persea americana
  misc_feature (94)..(94): Xaa can be any naturally occurring amino acid
MSAFCGKYQDELIANAAYIGTPGKGILAADESTGTIGKRLASINVENVESNRQALRELLFCTPGALECLSGVILFEETLYQKTASGKPFVDVLXERGVLPGIKVDKGTVELAGTNGENTTQGLDGLAQRCQQYYSAGARFAKWRAVLKISPNEPSQLAINENANGLARYAIICQENGLVPIVEPEILVDGSHDIDRCADVTERVLAACYKALNDHHVLLEGTLLKPNMVTPGSDAKKVTPEVIAEYTVRALQRTTPAAVPAIVFLSGGQSEEEATLNLNAMNKLKGKKPWTLSFSFGRALQQSTLKTWAGKEENVKKAQSAFLSRCKANSEATLGTYKGDAAKGEGVSESLHVKDYKY

SEQ ID NO: 74484 - protein, 605 aa, Pediococcus pentosaceus ATCC 25745
MSFSLISRKQDIERLKNETLDLLTIGGGITGAGVAIQASAMGMNNALIEMQDFAEGTSSRSTKLVHGGIRYLKNFDVEVVSDTVKERAVVQGIAPHIPRPDPMLLPIYDEPGSTFDMFSVKIAMNLYDQLAGVTDPKYTNYTISKDEVLQREPQLNPEGLLGGGVYLDFRNNDARLVIENIKKAHENGGLMVSHIKAQHILHDENGRVNGVNVKDLLTGEEFDIHAKLVINTTGPWSDFIREMDDKEEVVPQMRPTKGVHLVVDRSRLNVPQPTYFDSGKQDGRMIFAIPREGKTYFGTTDTDYKGDFLHPRVEQEDVDYLLSIINKHYPEAKITIDDIEASWAGLRPLISSNGSSDYNGGNSGKITSDSFDEVIDIVNKYENKEADRVDVEDVLNNLESTLSEKNPSAVSRGSALDVANDGLITLAGGKITDYRKMAAGAIALITKVLKEDFNETFNEIDSKHLQVSGGDIDPNNVDATLSFFAKQGIESGLSKAEAEQIANLFGSNAARVFSQIGKIEAAPGLTLAETISLHYSMNEEMTLTPVDYLLRRTNHLLFHHDTIDDVKKGVINEMARYFEWSDEEREAQAKKLQETIDEASLTYLK

SEQ ID NO: 74485 - protein, 142 aa, Bacillus halodurans C-125
MGHIRDVMTTDVDYCSPDDNIFEVAVKMERDNVGAVPICEEEQLLGMVTDRDIVIRSVAKKKPNSTPVKEVMSEHLVTATPDMTVQEAAKLMATKQIRRLPVVENNRLVGICSLGDLAVRDSSDHQAGIALSEISEPSNVYH

SEQ ID NO: 74486 - protein, 563 aa, Crocosphaera watsonii WH 8501
MDAIQTIIPQFDSIDAALADIKAGRAIIVVDDENRENEGDIICAAQFATTNLINFMAVEARGLICLAMNGKRLDELDLPLMVTKNTDSNQTAFTVSIDASPHLGVSTGISAEDRARTIQVAINPNTQPEDLTRPGHVFPLRAKAGGVLKRAGHTEAAVDLARLAGLYPAGVICEIQNPDGSMARLPELLEYAKKHNLKLITIADLISYRLRHDRFVYRETVCQLPSQFGTFQLYAYRNVLDETEHVAIVKGDPSEFKDHPVMVRVHSECLTGDGLGSLRCDCRMQLQTALQMIEKEGSGVVVYLRQEGRGIGLINKLKAYSLQDMGLDTVEANEKLGFPADLRDYGMGAQILNDLGVKKIKLVTNNPRKIAGLKGYGLEVVERVPLLIEPNTYNSSYLSTKAQKLGHLFLRTFLITIAIDWEETPVTITERYEKLQQVRELSRSMQLLLQEEARPVAIALFEQPSLIFHLGFEQVKMVDDNWHRNQNHPYGQAIISILDNLAAWDNIKRLEFLISSGDDPMSGLQGQLKRYPFSLDTKPSQCTLPWKRQTIYSFSDEQWAITA

SEQ ID NO: 74487 - protein, 220 aa, Populus trichocarpa
MSLNTENMANNDGEVTGKRAGWPPVLNERILSSMSRRSIAAHPWHDLEIGPGAPSVFNCVIEISKGSKVKYELDKASGLIKVDRVLYSSVVYPHNYGFIPRTLCEDSDPMDVLVLMQEPVLPGSFLRARAIGLMPMIDQGEKDDKIIAVCADDPEFVHYKDIKELPPHRLAEIRRFFEDYKKNENKKVDVEDFLPAASAIDAIKYSMDLYASYIVEGLRQ

SEQ ID NO: 74488 - protein, 304 aa, Populus trichocarpa
MRPNKNQSPINIKIITLSLFFLLFLVLVAWSSFSSPRSNPSPKAENDDLTNPSSSLSTDEEDQPKPSTPACPSLPLTPTCTKTPPSLANALVHYVTTNITPQQTLKEISVTLRVLEKKSPCNFLVFGLGHDSLMWTSLNHGGRTVFLEEDKAWIEQITEKLPSLEAYHVTYDTRVHQADGLMETGMGDECKVVSDPRFSKCQLSLKGFPSDIYDMEWDLIMVDAPTGYHDEAPGRMTAIYTAGLMARNRENGETDVFVHDVDRVVEDKFSKAFLCEGYLTEQEGRLRHFIIPSHRTRSGRPFCP

SEQ ID NO: 74489 - protein, 473 aa, Pediococcus pentosaceus ATCC 25745
MTEKNGKIGLLTLSALVISSSIGSGVFGIMSDLARAAAPGPVLITWFIVGLGVMMLALSLNNLLLKEPELEGIFSYPKKGFGPFMGFISGWGYWLSAWLGSVAFATFLMSTIGYFFPILRSERNLPLILIASIFSWGLTYLVNRGIEGAAIINTIVTVCKLIPLFVFIVFGIILFKGGMFTHAFWNNMNNNFVGGDVIGQVKNCMMVMMWVFVGIEGASILSARAEKKSDAGKATILGLISLLVIYILASVLPYGYLTQEQLATIKQPAMLYIFEKMVGTWGGYFIGIGLIVSILGAWLSWTMLPAETMLLMAKQKLLPEYFGKINDKKAPTFALILTAGLIQIFLFTLFFTTKAYNFAYSLCTAAVIVCYILVAAYQIKYSWTHIHEKGNHQQLVIGVLALLFEVIGILMAGLSHLLLCFIAYIPGIYFYGQARKNNGHEYFLSKGELIVTVFITIGALIGMGLVIMGKIIV

SEQ ID NO: 74490 - protein, 448 aa, Vitis vinifera
MAASLTVESDMEYNWNANIEIFGRRGPAPGVRLGGVLGDSLTRVARKQADALLFAEARKQSLDSLKREDDIFAIEEKRYDATGDNDRIVVNDGNILQWAQVLEPVRELPTNGEIKIRKCIYEVLEKDPSEWVKKRLGALLAGEGVPLKSHSVILAEYRLKYMGSVIQLQSCVGIAARGSRFRKISGEKRRPAPYAERSSVHEGGSQKCLGTEVVRDGHSIWLYYHRVYVPEGQPLKSDIKEPLRVYVSFQHIQKMLPNETVVLAETEDSWFNYLSIDGNSMYDDITGNDLLSDYKCGEPSMLFSVADTLNRAITMPGLGKQLRHGKRYRYVSSHDVVHWARSFMPDLKRACKDHYSKRCWSTGFSLSFRIVALSPSFKNLSLDHFVKTYKRANRRAMFLDHDGTVVLQSSIVKTPGLEDLGTAAEHGYFIKWNQNFNRESSPLLMDFD

SEQ ID NO: 74491 - protein, 333 aa, Pediococcus pentosaceus ATCC 25745
MSFNLRNRSFLTLSDFSTREMEYMLNLAEDLKKAKYAGYEGNRLAGKNIALIFEKDSTRTRCAFEVGAKDEGAHVTYLGPSGSHIGYKESVKDTARVLGGMFDGIEYRGFSQRSAETLAEYSGVPVWNGLTDEDHPTQVLADFLTAKEVLKKEYKDIKFAFVGDGQDNVSNALMLGAAVMGMEYHVVTPKELEPTKDVLDKANAIAAKTGGKIVVENDVKAGVKNMDVIYTDVWVSMGEPDEMWQKRIKLLKPYQVTKEVMEATENPNAIFEHCLPAFHNTDTSIGKKIEEKYGLSEMEVTDEVFESSQSVVFQEAENRMHTIKAVMVATLGD

SEQ ID NO: 74492 - protein, 217 aa, Rhizobium leguminosarum bv. viciae 3841
MPETEKPLFGHPWIFIRGVPSLNFLPPEGPLEVAFAGRSNVGKSSLINALVGQKGLARTSNTPGRTQELNYFVPDGYSGEGGDLPPTAIVDMPGYGYAQAPKEQVDKWTKLVFDYLRGRATLKRVYVLIDSRHGIKKNDDDVLDLLDKAAVSYQIVLTKTDKIKAAGVPKLLAETAEKIRKRPAAYPGVLSTSSEKGDGLDELRQAIAETVGIARWK

SEQ ID NO: 74493 - protein, 112 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWDSLVFEFELEHGFGPWTEP

SEQ ID NO: 74494 - protein, 494 aa, Physcomitrella patens subsp. patens
MASVAERIQNLSVHDDDDKKAQKSTADVIQGTEEALLEHRTSQHSMLAPFTAGWQMKAGTPLVIERGEGVYVWDNKGNKYLDALAGLWCTALGFSEKRLVAAAEKQLSTLPFYHNFWNRTSQPTLDLASELSKLFTASEMSKVFFCNSGSEANDTQVKLVWYYNNAIGRPNKKKFIARQKSYHGSTLISASLTGLPSLQNGFDLPVSFVLHTDCPHYWRYHLPGESEEDFATRLAENLEKLILKEGPETIAAFIGEPVMGAGGVMPPPATYWAKIQPILKKYDILLIADEVVCAFGRLGTMFGCDYYDIKPDLVTVAKEALSSAYVPIAAVLVSQKIFDGIAKLSDGYGAFGHGFTYSGHPVPCAVSLEALKIYKERDICAQVRKIIPPFQDGMRQLAKSPIVGEVRGVGLVLAIEFAANKETCEAYPAKWAVGTHFAGQCAARGMLVRVAGDIIMMSPPLIITPEQIDFMVKTALAAVAETEKYVAEKQSSKD

SEQ ID NO: 74495 - protein, 481 aa, Buchnera aphidicola str. Sg (Schizaphis graminum)
MLNRVRRTKIVATLGPSTDKANNLEKIILSGANVLRLNFSHGSSEEHKKRAKKAKEIMFKLNCHIALLGDLQGPKIRISKFKKNSIFLKVNDVFILDANLNEKNGNNERVGIDYKKLPNDLNVNDILLLDDGRIQLKVIKIEKCAIFTKVIIGGILSNNKGINKLGGGLSADALTEKDKKDIILASEIDVDYLAVSFPRCADDLIKARELLKKSGSNAQIIAKIERAEAVFDQNAIENIILSSDAIMIARGDLGVEIGDAELVGIQKKLIRTARKLNKVAITATQMMESMILNPLPTRAEVMDVANAVLDGSDAVMLSAETASGKYPSETVISMAKVCKGAEKVPSINVSRHRLNVEFQSIEEAIAMSSMYAANHLKGITAIITMTESGKTALMTSRITSGLPIFALSKHKKTLNLTALYRGVIPIYFDSDKDGVEAANEAIILLCKKKFLFNNDLVIVTQGDIMGKIGKTNTSRILRVTY

SEQ ID NO: 74496 - protein, 490 aa, Buchnera aphidicola str. Sg (Schizaphis graminum)
MIIETNQACDLVIFGTKGDLARRKLLPALYKLEKSQKIHPDTRIIGTGRADWNTEDYIKIVKKAIKMFLNEKIDEKIWKKLRSRLNFFYIDVFQDLHFLELKNILNQKKNIIIYYCAVPSNTFNAIFTGLGKVNLNSFPSRIIIEKPLGVSLETSKKINNQIAKYFLESQIFRIDHYLGKESILNLLALRFSNSFFFHSWNNKIIDHIQITVSEEVGIENRWNYFDQMGQTRDMVQNHLLQILTIVSMDKPKNITPEGIRDEKLKILRSLKKIDLNEIHIKTARGQYASGIINGKKVPSYIEENGANKHSKTETFVSIKVDINNDRWFGVPFYLRTGKRLAYKYSEIVIVFKKISKNLFQEFNKNLSPNKLIIRLEPNESIKIYFLNKVPGLSKEYKLKSDKMEFNFNINNTKNFVDAYERLLFESMRGIQSLFVCREEVEEAWKWIDPIINGWKKTNINTVQLYKSGTWGPKSSDEIIMRDGRFWETFN

SEQ ID NO: 74497 - protein, 253 aa, Zea mays
IQKPPAPGQFLDRIATHPISMATSALAALSATAAAAGKRILLSRPASSSSLSFASRRLAAGAPLRGFLGAPIRAVASSASAAPAAAAKTIAVGDRLPDATLSYFDTSSPDGELKTVTVRDLTAGKKVVLFAVPGAFTPTCTQKHLPGFVAKAGELRAKGVDTVACVSVNDAFVMRAWKESLGIGDEVLLLSDGNGELARAMGVELDLSDKPVGLGVRSRRYALLAEDGVVKVINLEEGGAFTNSSAEDMLNAL

SEQ ID NO: 74498 - protein, 450 aa, Bordetella pertussis Tohama I
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFDGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALERGFRVTRYESRFRPMKLTLTQSQEKTLMKLVVDADSQKVLGCHMVGPDAGEIVQGLAVALKAGATKQVFDDTIGIHPTAAEEFVTMRTAT

SEQ ID NO: 74499 - protein, 743 aa, Arabidopsis thaliana
MDKTFFSSNEGKPITCKAAICRKAGEALVIEDIHVDPPQAYEVRIKILCTSLCHTDLTFWKLSFGPISRFPRILGHEAVGVVESIGENVDGFKQGDVVLPVFHPYCEECKDCKSSKTNWCDRYAEDFISNTRRYGMASRFKDSSGEVIHHFLFVSSFSEYTVVDIAHLVKISPEIPVDKAALLSCGVSTGIGAAWKVANVEEGSTIAIFGLGAVGLAVAEGARLRGAAKIIGIDTNSDKFELGKKFGFTDFINPTLCGEKKISEVIKEMTEGGVDYSFECVGLASLLNEAFISTRTGTGKTVMLGMEKHAAPISLGSFDLLRGRVICGSLFGGLKSKLDIPILVDHYLKKIPPSLFTMDKASITEGKPIRCKAAILRKAGEPLVIEEIQVDPPQAYEVRIKILCTSLCHTDVTFWKLDSGPLARFPRILGHEAVGVVESIGEKVDGFKQGDVVLPVFHPQCEECKECISPKSNWCTKYTNDYLSNTRRYGMTSRFKDSRGEDIHHFIFVSSFTEYTVVDIAHLVKISPEIPVDIAALLSCSVATGLGAAWKVADVEEGSTVVIFGLGAVGLAVAEGVRLRGAAKIIGVDLNPAKFEIGKRFGITDFVNPALCGEKTISEVIREMTDVGADYSFECIGLASLMEEAFKSTRPGSGKTIVLGMEQKALPISLGSYDLLRGRTVCGTLFGGLKPKLDIPILVDRYLKKELNLEDLITHELSFEEINKAFHLLAEGNSIRCIIWMDK

SEQ ID NO: 74500 - protein, 513 aa, Zea mays
YKKAGWYRSGIPGIQQGSALLVLRKQQQQASSHHHLKSSPPRSLSLPLPPLPRRPAMAGLLHLQSTLLPSASALRRRAGAPVPCSSRRRCRVEAKIREIFMPALSSTMTEGKIVSWTAAEGDRLSKGDPVVVVESDKADMDVETFHDGFLAAVLVPAGESAPVGSAIALLAESEEEIPVAQSQAASFSSSSPSPPPPQETAQEASPPPPPPPPSAPVAVSAPALPSPATQGGGRVVASPYAKKLAKDLGVDLFSVTGSGPGGRIVAKDVEAALAAPKKAAPVTAARPDVPLGSTVPFTSMQGAVSKNMVESLAVPTFRVGYTITTDALDQLYKKIKSKGVTMTTLLAKATAMALVQHPVVNCSCRDGKSFTYNKSINIAVAVAIDGGLITPVLQDADKLDIYSLSRKWKELVDKARAKQLQPHEYNSGTFTLSNLGMFGVDRFDAILPPGTGAIMAVGASEPTVVGTKDGRIGIKSQMQVNVTADHRVIYGADLAAFLQTLAKIIEDPKDLTF

SEQ ID NO: 74501 - protein, 479 aa, Prochlorococcus marinus str. MIT 9515
MAERFSQKNLRVRPSSDEDKIVTNAKEHFEKTLIKISGELVGSVAALEHPSKNLKLNYGEIFLRDNVPVMIYLITQKRYDIVRKFLSVCLELQSTSYQTRGVFPTSFVEEKGKLIGDYGQRSIGRITSADASLWWPILCWYYVNKSGDYSFGKSQSVQRGIQLLLDLVLHPTFEGTPVLFVPDCAFMIDRPMDVWGAPLEVEVLLHGCLKSCINLMELSREDHVSRLLDQRLILTSQWVEDLRSFLLKHYWVTSQTMQILRRRPTEQYGEDQHFNEFNVQPQVVPSWLQEWLENRGGYLIGNIRTGRPDFRFYSLGNSLACMFGVLPSSEQRALFRLVLHNRQHLIAQMPMRICHPHMDVEEWQNKTGSDPKNWPWSYHNGGHWPSLLWFFGTSVLLHQKRFPTEDVILMEEMRSLIEESYWCQLNQLPKQEWAEYFDGPTGTWVGQQSRTYQTWTIVGFLLMHHFLREENNDLDMFDL

SEQ ID NO: 74502 - protein, 231 aa, Streptococcus pyogenes M1 GAS
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFCDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 74503 - protein, 162 aa, Sulfitobacter sp. EE-36
MTISQGDTLPDATLVQMGPDGPQPVQMADKLKGRKVVVFAVPGAYTPTCDSAHVPSFVRTKDQFDAKGVDEIICVSCNDPFVMAAWGESTGATAAGITMLADANSAFTKAIGMEFSAEPAGLISRSKRYAMLVDDGKVTLFQAEVQPGVCDMSGGEALLDNM

SEQ ID NO: 74504 - protein, 463 aa, Prochlorococcus marinus str. MIT 9515
MNILDKSYKSNLNALKNKVITGQTESISWRIQQISKVAQLLDENKKEIIKALYLDLGKSEIEALSEILLIEEEISLTKKNLKSWIRPKKVKTPIYLFPSFSKVIYEPLGCVLILGPYNYPLLYLLKPLVNIFSAGNTAVIKPSEKCSTISTLIKKLTDKYFQKDTLLTIEGDYKESIKLVEQNFDHIFFTGSTETGKSIMKSASRNLTPLTLELSGTNPVIIFKNANLEIAAKRIVWGKFFNSGQSCMAPNHIFVEKEIETQLVEELKKFITIFYGENPLISKNLSKLQKNQFSKTSELLKRFKKEKLILFGGTSSKKRMKISPTILKVKLQDKNIFQKELFSSLLPVIGIETKESALKKINQASKPLAIYIFGGNKKIHDHISKVTSSGTVCINDVMLPVLIPNLPFGGVGKSGMGKFHGEEGFKNFSNQKSITYKGFLFDLDLRYPPYENVMKIIKFIFKI

SEQ ID NO: 74505 - protein, 185 aa, Erwinia carotovora subsp. atroseptica SCRI1043
MTTVTAQQQAELIKNSIKSIPDYPKPGILFRDVTSLLEDPVAYAASIDMLANRYRNTGVTKVVGTEARGFLFGAPVALALGVGFVPVRKPGKLPRPTISESYELEYGSDTLEIHADAISAGDNVLVIDDLLATGGTLEATVKLIRRLGGTVNDAAFIINLFDLGGEQRLTEMGVTCYSLVDFPGH

SEQ ID NO: 74506 - protein, 193 aa, Zea mays
  misc_feature (113)..(113): Xaa can be any naturally occurring amino acid
MAERGGERGAERGGDRGGFGRGFGGGRGDRGGRGGPRGRGGRRGGRPTEEEKWTPVTKLGRLVQAGKIQKLEQIYLHSLPVKEYQIIDLLVGPTLKDEVMKIMPVQKQTRAGXQRTRFKAFVVVGDTNGHVGLGVKCSKEVATAIRGGIILAKLSVIPVRRGYWGNKIGKPHTVPCRVTGKCGSVTVRMVPAR

SEQ ID NO: 74507 - protein, 274 aa, Zea mays
MAERGGERGGERGGFGRGFGRGGRGDRGGRRGGRRGPRQEEEKWVPVTKLGRLVKENRITKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWSQTKFSMTPFQQYTDLLAKPTKGLVLEAPTETVEA

SEQ ID NO: 74508 - protein, 277 aa, Sulfitobacter sp. EE-36
MTETAVMNEHRGRQTKDGIRIYDPSDFAGMHAAGKLAAQILDDIAEHVFVGQTTGAIDGVITQMIEDAGAKSATIGYKGYQHASCISLNHVVCHGIPGDKKLKDGDILNIDVTVIVDGWYGDNSRMYVAGKLSRKAERLINVTHDALMRGIEVVKPGNTFGDIGHAIQTFAESHRMSVVTDFCGHGLGRVFHAPPNVLHYGRPGTGAVLEPGMFFTIEPMVNLGRAETKVLADDWTAVTRDKSLSAQFEHSIGVTETGYEIFTESPAGMFHPTYRQG

SEQ ID NO: 74509 - protein, 534 aa, Arabidopsis thaliana
MEGVNSSSSISDLDELARLLDRPRVNIERKRSFDERSFSEMGIFDNVNSPGGWETPVSSARNSFEPHPMVAEAWDALRRSLVYFRGQPVGTIAAYDHATEEVLNYDQVFVRDFVPSALAFLMNGEPDIVKNFLLKTIQIQGREKRIDRFKLGEGAMPASFKVIHDPIKETDSINADFGESAIGRVAPVDSGFWWIILLRAYTKSTGDTSLAETSECQKGMRLILSLCLSEGFDTFPTLLCADGCSMIDRRMGVYGYPIEIQALFFMALRSAMSMLKHDAEGKEFMERIVKRLHALSFHMRSYFWLDFQQLNDIYRYKTEEYSHTAVNKFNVIPDSIPEWVFDFMPLRGGYFIGNVSPARMDFRWFALGNCVAILASLATPEQSASIMDLIEERWEELVGEMPVKICHPAIESHEWRIVTGCDPKNTRWSYHNGGSWPVLLWLLTAACIKTGRPQIARRAIDLAEARLLKDGWPEYYDGKSGRFIGKQARKFQTWSIAGYLVAKMLLEDPSHLGMISLEEDKQTKPVIKRSYSWT

SEQ ID NO: 74510 - protein, 128 aa, Populus trichocarpa
MLKFLSKVKIEFNALDPRVASCMEFLAQCNARKAKESNPACQLLVKRRTDDFPPQITVTFVNGVEEAFDATSTPAQAIRTMILEKGQLLETEQMFREAGEKWPVIIPEEELHQFAPGTKPRKAEEKKQ

SEQ ID NO: 74511 - protein, 1507 aa, Candida glabrata
MSSSSEISVAGSDVSFEGRLTQHGRHEETPADQLTKILSGRSHEDADGDDAHSDNRSILSRSRRSSTAELSPEMVGRVQSLADVLSRHTSRSGGNIDLSQLSESDRFDAERIIGSFVRDADEQGIHLRKAGVTLEHVSARGADSTAMEGATFGNVLCLPYTIYKAIRDKSGSKMRTILNDVSGLARAGEMVLVLGRPGAGCSSMLKVTAGEIDQFAGGVEGEIMYDGIPQKEMMKRYKPDVIYNGEQDVHFPHLTVQQTLDFAIACKTPSKRVNDVSREEYIASTRDLHATIFGLRHTYHTKVGNDFVRGVSGGERKRVSIAEALVTKGSIYCWDNATRGLDASTALEYAKAIRITTNLLGSTAFVTIYQASENIYETFDKVTVLYTGRQIYFGPIDEAKDYFYRMGYECPPRQVTAEFLTALTDVNGYHKIRPGYENKVPRTAEEFERYWQESPEYRQLLIDIDQYKKEIDTEKTKEIYDQSMQQEKSKHARKKSYYTVSFWEQIRLCTKRGFQRIYGDKAYTVITICSAIIQSLVSGSLYYNTPSSTSGAFSRGGVLYFCLLYYSLMGLANLSFEHRPILQKHKIYSLYHPAAEALGSTIANFPFRMIGMTCFLIIIYFLSGLNRTASSFFRVYLFLTMCSESINALFELIAAGGDNISQANSISGIVMMSISLYSTYMIQLPSMRPWFKWISYILPIRYAFESMLLAEFHGRHMGCGGTLVPSGPGYENIASENQVCAFVGSKPGQSWVLGDDYLRLQFEYEYKHEWRNFGIMWCFLLGYIALKALITEIKRPVKGGGDALIFKKGTRKYHMKLDEEDGELHEIDTKEKFSSRSGSSTTSEDEIFEELESKGIFIWRNVCYTIPYDGGMRQLLDNVSGFCKPGTLTALMGESGAGKTTLLNTLAQRNVGIITGDMLVNGKPIDISFERRTGYVQQQDIHISELTVRESLQFSARMRRAQNVPEEEKMEHVERIIKVLDMEEYADALVGDVGRGLNVEQRKKLSIGVELVAKPDLLLFLDEPTSGLDSQSSWAIVQLLKKLAKAGQSILCTIHQPSATLFEEFDRLLLLKKGGQTVYFGDIGDNSKTLLSYFERNGARKCSPSENPAEYILEAIGAGATASVTEDWHQIWKNSDEFISTEKEVDHLIDQLSNQKTESEFGDAPTKYATSYAYQFKWVLIRTSMSLWRNLDYIMSKMMLMTVGGLYIGFTFYDPGDSYTGLQNTLFAAFISIILSAPAMNQIQARAIAARELFEVRESKSNMFHWSLLLITQYLSEIPYHFLFSAIFFVSSYFPLRTHFQASASAVYYLNYSIMFQLYYIGFGLCVLYMAPNLQSANVILGLCLSFLIAFCGVVQPVSLMPGFWTFMWKTSPYTYFVQNMVGILLHNKPVICRKKELSIFDPPAGQTCQEFTQAFLDKRGGYIANPNATTACEYCIYEVGDDYLKHISASYSYLWRNFGLYWAYIGFNICAMVAIYYIFHVRGVSFKFDRVFKLFSRITRRGKKSN

SEQ ID NO: 74512 - protein, 552 aa, Aspergillus fumigatus
MWLPSRREIPIRKYTPYLSTSLPKFWHRFCEQIVACKFAVNYIKRSCPNTQCNLKPHRRTPHLLCRLDEKVPSAPYGGEYDSRAKTKAPLCFWWPCQTLTAHKIDLSTYHIMAPKKIIIDTDPLTKCEQGIDDILALLLALSAQSEEVELLLISLTFGNIEVRSLPLLTMKSCLRNVVSMFHILEREMQWRREHGRPEGFGALHACRPVIAVGAEDPLEDQKMLADYFHGTDGLGGIHASETWEHMFDPSADPTVIEPIRTGDSAHRSFIASKRPAHQEILRVLRENDPDTVTLVAVGPLTNLALASAEDAETFLRVKEVVVMGGAVNEPGNLFLWVFFWTNRWQVTPVAEFNAYADAFAAARVFALTSPNPKTTMPSGTTLPSYPAKLSKQLTLRLFPLDITHRHGMTRGLFRQAVAPHLEAGSPLAEWMSAFMAHTFRTIESLHRDQVGDAVDLSLHDPVCVWYALTAEDAGWKPSDASPEDIRVETTGQWTRGACIVDRRPRQRVEGEEESASDHGHWLSTKAGNRIWRMESSPAEKNFGAILLERIFR

SEQ ID NO: 74513 - protein, 483 aa, Rhodobacter sphaeroides 2.4.1
MVSRVIPVDTFDLVIFGGTGDLARRKILPGLYRRFTGGQMPPDSRIIAAARSEMDDAAYRAQVRAALEEFVPAGKRDEGGISAFLERIHYVAIDATGTSGWADLKKMMRPDVVRAFYFSVAPSLFGALAERLHENGIAGPQSRIVVEKPFGRDLESARALNRVLALHFAEEQIYRIDHYLGKETVQNLMAVRFANILFEPLWKAQYIDHVQITVAETVGVGGRGAYYDTSGAMRDMVQNHLMQLLCLIAMEPPYHFDPNAVRDEKLKVIRALDPVPPEDIVRGQYLAGGGQESYVDHAGNPRSRTESYIALKVHIANWRWKGTPFYLRTGKRLRARASEIAITFREPPHSIFDDAEDWRENVLVIRLQPDEGINLKVMIKEPGPGGMRLTQVPLDMSFAEALGPDGEDIPDAYERLIMDVIRGNQTLFMRGDEVEAAWAWADPIIAAWERRGDRPKTYEPGTSGPEDALMLMHRDGRRWREIR

SEQ ID NO: 74514 - protein, 758 aa, Aspergillus fumigatus
MLRPKKVAIIGRFVYLPANKIRDHMRFASPPKNSLFNRRRAVWPRGLWPISRSRKGSDSGSVSKDHGAAGPVNPSMRTNLSRFTVSFSDLAWESVLGGTDVPMFPQAWQVGRYLETYTERYLSDQVVRLGCEVVHAVREVVGGRPRWTVHENEEQGDDTEQRTVETEYYDFLVVASGYFSRPYTPDIPGLAALAERTIHSSALRSLEDLDAIVEKGSDGGRLIVIGGSMSGVEAASSLALHVSSLRYAPGSSVQTDSFPEVYHISSRPFWTVPTYIPHAQKDNGTGTETVSLLPLDLAMYDLARRPPGPVEYAFGPVSAAQVAKVNDYFQSILGEDYTNIGPGDIGFKGGEEETLQPRWVAIGNDYAEFVRSKAIKTVIGRVSAVHASSPGPAKVDIELPGKESMSLDNVAGIVLATGFRPFPSLAFLPEDVLSALEYSPDDSFFPLILDPKGASNANIPDLGFVGFYRGSYWGVMEMQARSLAQTWAGDDTEHGIQFSATELESKAQERQKVREYRSADPNLHRGQFPMGDYTGLMESFARDLGICRAPLTELDERPGPVVPARYVMSGPGTADIRTSLQALQETLQPRRESASPAVAMAVFRALHGSWDFTRSGQDGISSGISTFFPRYPSSPAYEKEYLCEESGQKLSSFAYRLTDSPQDAQITVWSVDSRDKTVVALLHGLRILDQEGASTSRQGEYTIRATSSQWSSNRTYEYVFRFNGVAISSWEYTVRRPLDHGFVLHRTIYRRIQKCDGH

SEQ ID NO: 74515 - protein, 533 aa, Rhodobacter sphaeroides 2.4.1
MKQIWQALKAHQQAVEHRAILDLFTDPRRAETFSTRLGDMLFDWSKTNIDHTARDLLIDLAGAAGVAEKREAMFSGAKINETEGRAVLHTALRNMDRPVRVDGVDVTPALRETHARMQAFVRDLRSGRFTGQGGPITDVVNIGIGGSDLGPAMACLALAPYADGPRCHFVSNVDGAHIHDTLQDLDPATTLVIVASKTFTTIETMTNAETAKRWMAKRVSDPAAQFAAVSTAADKTAAFGIDASRVFGFEDWVGGRYSMWGPIGLALMIAIGPEAFDAFLAGGAEMDRHFREAPFAENLPVLLALVGLWHNQICGHATRAVLPYDQRLARLPAYLQQLEMESNGKRVAMDGHELTHHSGPIVWGEPGTNGQHAFYQLIHQGSRIVPCEFLVAREGHEPDLAHQHLLLVSNCLAQSEALLRGRSVEEARAILGKKGLTGSELERQARHRVFPGNRPSTVLAYEKLTPATLGRIVALYEHRVFVEGVILGINSYDQWGVELGKELALALQPMLEGRAGTEGKDGSTAQLVAYLRR

SEQ ID NO: 74516 - protein, 263 aa, Zea mays
  misc_feature (142)..(142): Xaa can be any naturally occurring amino acid
RHTHERRNPSRPPRTTAPTMDAGAARPSAPSTAAVAGAARAGEPRDARVVRELLRSMGLREGEYEPRVVHQFLDLAYRYVGDVLGDAQVYADHAGKAQIDADDVRLAIQAKVNFSFSQPPPRECLGRWSNALFRHTALKTMXPVLLELARSRNRMPLPKSIAPPGSIPLPPEQDTLLAQNYQLLPPLKPPPQYEEIEDETEEPNPSNPANSNPSYSQDQSSKEQQQQHTPQHGQRVSFQLNAVAAAAAAAKRPRMAIDQLNMG

SEQ ID NO: 74517 - protein, 471 aa, Neorickettsia sennetsu str. Miyayama
MPKLTVAYGDGVGPEIMTSVLEIIFEAGAEIQIDTIEIGQKIYEKGWHSGISDSGWETLKRNKVLLKAPITTPRGGGVRSLNVTLRKKLGLFANIRPCKSHLEWQSPKMDIVIIRENEEDLYSGTEYRQTLDTYNCTKVITESTSERICRYAFEYARKNGRKKVTVMVKDNIMKLTDGIFHKLFKKVALEYPDIESENYIIDIGAARIAKNPEKFDVIVTLNLYGDIISDIAAEISGSVGLGGSINIGEEYAMFEAVHGSAPDIADQDIANPSGLLNAAMYMLSYIGQKEIAQKVYSAWLKTLKSGVHTADIFNPLHSKLKVGTKKFTEHIIHNIDRKSLVAFSCNSLVEGVLLKPRYQSKKEKVLIGVDLFISWDSTNLAALLAALEKIKVDDVIILGSISVKGVLIWPEETAVMPYSDTLCCRFLAEPNKSLATTVICGLISELENSAIEVTKMEKLYSFGDEAGFSNI

SEQ ID NO: 74518 - protein, 637 aa, Neisseria gonorrhoeae FA 1090
MNPSPLLHLIDSPQDLRRLDKKQLPRLAGELRAFLLESVGQTGGHFASNLGAVELTIALHYVYDTPEDKLVWDVGHQSYPHKILTGRKNQMHTMRQYGGLAGFPKRCESEYDAFGVGHSSTSIGAALGMAAADKLLGGDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKEGGAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVATALAVAEKLNATVADMRFVKPIDEELIVRLARSHDRIVTLEENAEQGGAGGAVLEVLAKHGICKPVLLLGVADTVTEHGDPKKLLDDLGLSAEAVERRVREWLPDRDAAN

SEQ ID NO: 74519 - protein, 115 aa, Bordetella pertussis Tohama I
MHYHGSCHCGTIRFDVEGELTGAMSCNCSICRRKGALLWFVPRGHLRLATPDEQIATYTFNRHLIKHRFCPTCGIHTHGEGVDQQGRAMAAINIRCLDDVDLDAVAVHQYDGRAA

SEQ ID NO: 74520 - protein, 570 aa, Salmonella enterica subsp. arizonae serovar 62:z4,z23:--
MSEKHPGPLVVEGKLSDAERMKRESNYLRGTIAEDLNDGLTGGFKGDNFLLIRFHGMYQQDDRDIRAERAEQKLEPRHAMLLRCRLPGGVITTKQWQVIDKFAADNTIYGSIRLTNRQTFQFHGILKKNVKPVHQMLHSVGLDALATANDMNRNVLCTSNPYESQLHSEAYEWAKKISEHLLPRTRAYAEIWLDQEKVATTDEEPILGQTYLPRKFKTTVVIPPQNDIDLHANDMSFVAIAENGKLVGFNLLVGGGLSIEHGNKKTYARTASEFGFLPLEHTLAVAEAVVTTQRDWGNRTDRKNAKTKYTLERVGLETFKAEVERRAGITFEPIRPYEFTGRGDRIGWVKGIDDNWHLTLFIENGRILDYPGRPLKSGLLEIAKIHQGEFRITANQNLIVASVPESQKMKVEKLALDYGLMNAVSPQRENSMACVSFPTCPLAMAEAERFLPSFVDKVEAVMAKHGVGNEHIVLRVTGCPNGCGRAMLAEIGLVGKAPGRYNLHLGGNRIGSRIPRMYKENITEPAILASLDELIGRWAKEREAGEGFGDFTVRAGIIRPVLDPARDFWE

SEQ ID NO: 74521 - protein, 733 aa, Vibrio campbellii AND4
MIYQAETLKVKEVQNGIAELSFCSPKSVNKLDLATLESLDKALDALSAHQGLKGLMLTSDKDAFIVGADITEFLGLFSKTDAELDQWLQFANRTFNKLEDLPVPTISVLKGHTLGGGCECVLATDMRIGDKTTSIGLPETKLGIMPGFGGCVRLPRVVGADSAMEVITQGKACRADEALKIGLLDAVVDGDALYESALKTLTSAINEKLDWQARRQQKTSPLTLSKLESMMSFTMAKGLVAQKAGPHYPAPMTAVVTIEEGARFARNEALDIERKHFVKLAKSEEAKSLIGLFLNDQYIKGIAKKAAKSASKGTQRAAVLGAGIMGGGIAYQSALKGVPVLMKDIAQASLDLGMTEASKLLNKRLSRGRIDGFKMAGILASITPSLHYAGVEESDVIVEAVVENPKVKAAVLTEVEAHVGDDTVITSNTSTIPINLLAKSLKRPENFCGMHFFNPVHRMPLVEIIRGERTSDETINRVVAYAAKMGKSPIVVNDCPGFFVNRVLFPYFGGFSMLLRDGADFTKIDNIMERKFGWPMGPAYLLDVVGIDTAHHAQAVMAQGFPERMSKQGRDAIDALFEANKYGQKNGRGFYSYTLDRKGKPKKTFSEEILPVLANVCADEPFHDKERFDDQTIIQRMMIPMINEVVLCLQEGIIATPQEADMALVYGLGFPPFRGGVFRYLDSIGIAEFVAMAKQYSELGAMYHVPQMLIDMAEKGHPVYGKTFYSAQQQGSI

SEQ ID NO: 74522 - protein, 770 aa, Glycine max
MVDKMNMLIFKSLQISLLLVFSIRNTTAEKKTHHTKHTYIIHMDKFNMPESFNDHLLWFDSSLKSVSDSAEMLYTYKKVAHGFSTRLTTQEAELLSKQPGVLSVIPEVRYDLHTTRTPEFLGLAKYSTLSLASGKQSDVIVGVLDTGVWPELKSFDDTGLGPVPSSWKGECERGKNFNPSNCNKKLVGARFFSRGYEAAFGPIDEKTESKSPRDDDGHGSHTSTTAAGSAVVGASLFGFANGTARGMATQARLATYKVCWLGGCFTSDIAAGIDKAIEDGVNILSMSIGGGLMDYYKDTIAIGTFAATAHGILVSNSAGNGGPSQATLSNVAPWLTTVGAGTIDRDFPAYITLGNGKMYTGVSLYNGKLPPNSPLPIVYAANVSDESQNLCTRGTLIAEKVAGKIVICDRGGNARVEKGLVVKSAGGIGMILSNNEDYGEELVADSYLLPAAALGQKSSNELKKYVFSSPNPTAKLGFGGTQLGVQPSPVVAAFSSRGPNVLTPKILKPDLIAPGVNILAGWTGAVGPTGLTEDTRHVEFNIISGTSMSCPHVTGLAALLKGTHPEWSPAAIRSALMTTAYRTYKNGQTIKDVATGLPATPFDYGAGHVDPVAAFDPGLVYDTSVDDYLSFFCALNYSSYQIKLVARRDFTCSKRNNYRVEDLNYPSFAVPFNTAYGVKGGSRKPATVQYTRTLTNVGAPATYKVSVSQSPSVKIMVQPQTLSFGGLNEKKNYTVTFTSSSKPSGTNSFAYLEWSDGKHKVTSPIAFSWT

SEQ ID NO: 74523 - protein, 275 aa, Vitis vinifera
MSALVGAISKDFTFNPVMEKEENKDGEPTRECDDSEKPDDEGREDDEDDEAEEDGKPKSEKELENKELELGPQVSLKEQLEKDKVYSLSVSMFILKCTPLDDFVFLLLSKDDESLRRWKEQLLGTVDFSAVGESNEPEVRIQSLSILCKDRPDLVFAIPLAANSKDRLFTLKEGSRYHLKFSFVVSNNIVSGLKYIHTVWKTGIKVDNTRIMLGTFSPQQEPYTYELEEETTPSGMFARGSYSARSKISQDIQSWSGHMTQSAAEAKAEVMISKG

SEQ ID NO: 74524 - protein, 416 aa, Kluyveromyces lactis NRRL Y-1140
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNTVIIGGGDTATVAKKYGVVDKISHVSTGGGASLELLEGKELPGVTFLSNKQ

SEQ ID NO: 74525 - protein, 353 aa, Leptospira interrogans serovar Lai str. 56601
MNQDKPVVLIMAGGKGERFWPRSRISTPKQLQKVYSNKTLLRETLERALTITTIDRIYIGTNASLKKSILIQEKNFPEKNFIIEPEGKNTAPIIALASLYFQERYGDPLQVVLSADAWIHPVKEFTKTISKALEYTKEHLVLLGIKPNRPEIGYGYIEAGKSTDACFAVKSFYEKPDVKTALKYIKKKNFYWNPGIFLWRTSIILEEFKTYSPKILDPLKERFPFKKAGELAAAFKIIPSEPVDIAIMEKSSRIKMVEASFGWDDVGSWTSLERVMPGDELGNRHMGKTILFHKSSGNITQTRKEFTAVLGVNDLIVVEEEDVLFISTKSGIGDIKNLVSELRKNKTLQKYTE

SEQ ID NO: 74526 - protein, 292 aa, Physcomitrella patens subsp. patens
MGATTIGMMDAAYFVGRNEILSWVNSTLELSLSKVEEAASGAVYCQLMDVVHPGMVSMHKVSFDAKSEYEMIQNYKVLQDVFNKLKIGRHIEVSKLVKGRPLDNLEFLQWMKRYCDQINNNHVNPTYNAAERRESCKGGKETNRRVVGMSSSGQSSVKSASNANVKTSSGAARRVTTDNSTPNMNGSGRSGGSSEAHVNDHVKQITELKLSVSNLEKERDFYFTKLRDIEILCQAQELSHIPVVKAVQRILYAAEDESSVIAEAQAMMEELDRDILSPGSQNMDDDSKDLLE

SEQ ID NO: 74527 - protein, 370 aa, Brucella melitensis 16M
MASRKLLLLPGDGIGPEAMAEVRKVIAFLNSDLNLGFETEEGLVGGCAYDAHGQAISDADMEKALAADAVLFGAVGGPKWDSVPYEVRPEGGLLRLRKDMQLYANLRPAICYPALAHSSSLKPEVIEGLDILILRELTGGVYFGEPKEIIDLGNGQKRGIDTQVYDTYEIERIADVAFELARTRRNKVTSMEKRNVMKSGVLWNQGVTARHKEKHADVQLEHMLADAGGMQLVRWPKQFDVILTDNLFGDLLSDVAAMLTGSLGMLPSASLGAADSKTGKRKALYEPVHGSAPDIAGKGIANPIAMIASLAMCLRYSFGLVAEADRLEAAIAGVLDDGIRTADIWSEGNTKVGTTEMGDAILAKFKALSA

SEQ ID NO: 74528 - protein, 460 aa, Arabidopsis thaliana
MEGVGLRAVGSHCSLSEMDDLDLTRALDKPRLKIERKRSFDERSMSELSTGYSRHDGIHDSPRGRSVLDTPLSSARNSFEPHPMMAEAWEALRRSMVFFRGQPVGTLAAVDNTTDEVLNYDQVFVRDFVPSALAFLMNGEPDIVKHFLLKTLQLQGWEKRVDRFKLGEGVMPASFKVLHDPIRETDNIVADFGESAIGRVAPVDSGFWWIILLRAYTKSTGDLTLSETPECQKGMKLILSLCLAEGFDTFPTLLCADGCSMIDRRMGVYGYPIEIQALFFMALRSALSMLKPDGDGREVIERIVKRLHALSFHMRNYFWLDHQNLNDIYRFKTEEYSHTAVNKFNVMPDSIPEWVFDFMPLRGGYFVGNVGPAHMDFRWFALGNCVSILSSLATPDQSMAIMDLLEHRWAELVGEMPLKICYPCLEGHEWRIVTGCDPKNTRWSYHNGGSWPGLFSFPGD

SEQ ID NO: 74529 - protein, 271 aa, Glycine max
MRKRERENPCGVCGHYHKYEEGEVCSICGHRIPVGSEKTSIQVSAFPSVVLPEFLYLGSYDNASRSELLKTQGISRILNTVPSCQNLYKNSFTYHCLPDDKTLPFDEAIQFLEQCEKDKERVLVHCMSGKSRSPAIVIAYLMKFKGWRLAQSYQWVKERRPSVELTQGVYQQLQEFEQKIYGPIDSGSSVPPGFLPTAPSISFGFPKINDPAQLPSFSTAGTPSIFARAPLDIAPTEFTFGAGQTQKNVAGNPYNANPANPNGTDIQMDGS

SEQ ID NO: 74530 - protein, 254 aa, Chromobacterium violaceum ATCC 12472
MGQLEGKVAIITGASAGIGYEAAKLFAREGAQVVAVARRARELGQLAAAIRQDGGDVAIVVGDAREESIAKQAVETAQRRYGGLDIAFNNAGATGESAPVHEITPEAWHFALDTNLTSAFLAARQQIPAMLQRGGGSLIFTSTFVGHTAGFPGMGAYAASKAGLIGLTQVIAAEYGARGIRANALLPGGTDTEMGRAAAPTPEARGFVEGLHALKRLARPEEIARAALFLASDAASFVTGSAMLADGGVSIQRT

SEQ ID NO: 74531 - protein, 454 aa, Bacillus halodurans C-125
MDVIAQVTATNQQFLSQQEKRESSARSYPRRLPLAIQKAEGICVTDMNGKQFIDCLAGAGTLALGHNHPVIRQAIEGVLASYVPLHSLDLTTPVKEAFVDEVFASLPESFAKKAKIHFCGPTGADAVEAAVKLVKTATGNRAMLSFQGGYHGSTHGALSLTGTTDPKKRIHALIPDTHFLPYPYEYRCPFGIGKDGHRVNSTYLESLLDDPESGLVKPAGIIVEVVQGEGGSIPAPVEWLKELRRMTSERNIPLIIDEVQTGIGRTGKMFAFEHAGIEPDVLVLSKAIGGSLPLSVVLYDRKLDQWEPGAHIGTFRGNQMAMATGRATLQYIKENQVPKHVHELGQYVKDQLSSIQSSMRSIGDVRGRGLMIGVEIIDPRKQPNAIGSYPAYGELAKAIQRHCFERGLILEVGGRFSSVIRFLPPLIITREQLDDVLERFYDATVQAEIEFGIR

SEQ ID NO: 74532 - protein, 256 aa, Neorickettsia sennetsu str. Miyayama
MTVKKKLQKASRLIRETLKENLSLFPSEDKLFQAIRYSLLAESSHIRGFLVLELGTLFNIPYVDTIEVAAAIEMIHSFSLIHDDLPALDNSDERRNQPACHIAFQESTAILAGDALLVLAYQMLSRYGTPLVQCTSKYVLEMITGQVHDVIGSSTLTADEINKMKSGSLFALSCSSVGHLANSGQSELTVLEAFGYEIGIIFQAVDDIKDGDAKNDPQRSITVSLKKIKRIIDTTFLLEKKTLIDELITLIINGSL

SEQ ID NO: 74533 - protein, 145 aa, Pediococcus pentosaceus ATCC 25745
MSTEKSLILVKPDGVQCGHIGHVISRIENRRYEIKALKMVNATEEQLRQHYSQLVDKPYYADIEKFMTSGPIVAIIAEGNEIIDTFRKMAGPTNPSEAMAGTIRGDFARAWGPGPIKNVVHSSDSVESAEKEIKIWFPERINTEN

SEQ ID NO: 74534 - protein, 425 aa, Wolbachia endosymbiont strain TRS of Brugia malayi
MSNKIGFLAVFALVISSQIGSGIFMLPISLAPYSTYSLISWAISGFGAVSLALVFATLCAKFPETGGPHVYVKHAFGPTAAFFVGWTYWVISWVSTTALIVVGVGYLTPFLHEEIKNIHLFLELLLFTIITLINLRGVATAGRVEFLLTVIKIAVLLAIPVMALFFFNRNNFIISKEMSSLTISQILARSTLLTLWCFVGVELATAPAGSVNNPAKTIPRAVVLGTICVAIIYFINNFAIMGLINGNDLANSRAPYVDAIKIMFSGNWHLIISIVAFVFCVGSLNAWVLSSGQVAFGLAKDRLMPQLFAKRNEHGSPFWGITTSSSGTAILLILTSNNNFAQQITSIIDFSVVSFLFVYLACSLAFLKVVIKERNYHKLLTGSIATTFCCWVILETSINTLLIASLFTTSGIPLYLFWYRRASAQ

SEQ ID NO: 74535 - protein, 411 aa, Wolbachia endosymbiont strain TRS of Brugia malayi
MISSQIGSGIFMLPISLAPYGTYSLISWAVSGLGAILLALVFALLCAKFPETGGPHVYVKHAFGPTAAFFVGWTYWASSWVSSTAVIVASIGYLAPLFHNNIQNIRLFLEIALILAIMLINLRGITTVGHVELLLMTVKITVLFAVPIAALLLFDRNNFVVSEEISNLTISQAFARSTLLTLWCFIGLEIVTASAGSVENPSKTIPRAIVFGTVFVAIIYFINSLAIMGLINGNHLANSKAPYADVIKIILPGNWYLIISIVAFIVSVSSLNAWFLADGQVALGLAKDKLMPQFFAKRNKYGAPFCGIIINTLGILALLVLISSKNFAKQVTSIIDVSVVSFLFVYLTCCLAFLKVIIQEKNYYKFLIGGMAVLFCCWIIYETPMNTLLIASLFPLSGTPTYLLWYRKPTK

SEQ ID NO: 74536 - protein, 314 aa, Brassica napus
ENMIGKGGHAEVYKGVLPDGEIVAIKRLTRHANEAEERVSDFLSELGMIAHVNHPNAAKPRGFSCDRGLHFVLEYAPHGSLASLLFGSSEEECLDWKKRYRVALGVADGLSYLHNDCPRRIIHRDIKASNILLSQDYEAQISDFGLAKWLPENWPHHILFPIEGTFGYLAPEYFMHGIVDEKTDVFAFGVLLLEIITGRRAVDTASRQSIVMWAKPLLEKSSVEEIVDPKLGNEFDETEMKRVMQTASMCIHHVAAMRPGMNRVGQLLRGGGDDRLAETQQISRRKSLDGCDLQDHTSSSYLNDLTRHRQLLME

SEQ ID NO: 74537 - protein, 244 aa, Arabidopsis thaliana
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNNSNRKQS

SEQ ID NO: 74538 - protein, 290 aa, Hordeum vulgare
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRAVLYIIAQCLGAICGVGLVKGFQSAFYVRYGGGANELSAGYSKGTGLAAEIIGTFVLVYTVFSATDPKRSARDSHVPVLAPLPIGFAVFMVHLATIPITGTGINPARSFGAAVIYNNEKAWDDHWMFWVGPFIGAAIAALYHQYVLRASATKFGSSASFGSR

SEQ ID NO: 74539 - protein, 540 aa, Pediococcus pentosaceus ATCC 25745
MITVNDMSMQFSDRKLYSDVNLKFTPGNCYGIIGANGAGKSTFLKILEGKLQPTSGNVSISPNERMSSLNQDHYAFEEFTVMNTVIQGYKKLYEVMQAKDALYAKADFTEEDGMKAANLEAEFAEMDGWNAEAEASQLLQQLGIDESLHDSKMSELTEGQRIKVLLGQALFGKPDILILDEPTNGLDPKSISWLEDFLADFPNTVIVVSHDRHFLNSVCTMMCDVDFGKIELFVGNYDFWMESSALAKRLRENANAKKEEQIKELQEFVARFSANASKSKQATSRKKQLDKITLDDIKPSSRKYPFIRFEPARELGNDLVRVDKVSKSIDGVKILDNITFTVRPGEKAAILSQNDLATTVLMQILAGEMEPDSGSVTWGQTTERSYIPRDINSYFEDDRFDILEWLRQYAPKEESDNTFLRGFLGKMLFSGEDVLKNVTKLSGGEKVRCMISKTMLSKANVLILDDPTNHLDLESITALNEGLTSYKSSIIMTSHDHEFIQTIADHIIEVSDKGSVDRAETTYDEFLNHDAIQEQVSKLY

SEQ ID NO: 74540 - protein, 452 aa, Zea mays
MASGATLSWVKTPFDTRRFHDLSNLSFRCRNPFGSIQPWWLQTDQDSSLIKVRVAADYSDSMPDSKYTRDRGYHPLEEVKERPKKKDLLLTDIETARTVVEANSKGLLVFPARVHNEPHGHVSWSEFQYVVDEYGDIFFEVPDSENILEDDTANNPVTVLIGMDGPIIGESSVAISDFSDYMDGENFMDVPDEHHTKIDTEITDILIEWGMPATMRAIHPIYFAKCLTKAIHNNNGEKMDSPSNGLSIVGYLRPAFIEEESYLRSMFHGDNGGYSSDWKVNETDEYNRETRPVSGTNRLIDDDKSRFDFNHAETRTDSMIYKLEIMTIELFSMYGKQFKIDPQDFQDSEPDILANSASSIIERIKENSDQCAAALRSLCRRKKGLTVEEASLIGVDSLGIDVRAFSGLEVKTVRFSFNAQSLSERSAEKKIRRMLFPRYQRKNVKASTEDES

SEQ ID NO: 74541 - protein, 211 aa, Brassica napus
MSSINLSSSSPSTISLSRSRLSQSSSTPIHRVSLPSNHQPSFSIKTTGKVKASVISREDDLLSYTNGNAPIQDPLQADSVSLGTLAPSDSANAPPNGFVAEDDDYELDLPTPGFSSIPEAIQDIRQGKLVVVVDDEDRENEGDLVMAAQLATPEAMAFIVKHGTGIVCVSMKEDDLERLNLPLMVNQKENEEKLCTAFTVTVDAKHGTTTG

SEQ ID NO: 74542 - protein, 273 aa, Helicobacter pylori 26695
MIKKCLFPAAGYGTRFLPITKTIPKEMLPIVDKPLIQYAVEEAMEAGCEVMAIVTGRNKRSLEDYFDTSYEIEHQIQGTNKENALKSIRNIIEKCCFSYVRQKQMKGLGHAILTGEALIGNEPFAVILADDLCISHDHPSVLKQMTSLYQKYQCSIVAIEEVALEEVSKYGVIRGEWLEEGVYEIKDMVEKPNQEDAPSNLAVIGRYILTPDIFEILSETKPGKNNEIQITDALRTQAKRKRIIAYQFKGKRYDCGSVEGYIEASNAYYKKRL

SEQ ID NO: 74543 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVEDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLRWDPKY

SEQ ID NO: 74544 - protein, 619 aa, Clostridium perfringens str. 13
MSEVLQRITDPKEIKDLDEKELEILAEDLREFLIESVSNTGGHFASNLGVIDLTVALFKNFDFSEDRIIWDVGHQSYAYKILTGRKDKFNTLRQYGGLCGFPKRTESEYDFFATGHSSTSLSSAAGMARAQRLLGKDNKVIAVIGDGALTGGMALEALNDIGYRKDNLIIILNDNQMSICKNVGGLATYLNKLRMGVGYNKLKSDIGSTLDTTSLGKRVKNSLSKLKDGIKKIVVPSMYFEDIGLKYFGIVDGHNIRELNEVLSIAKNIKGPVIIHTVTKKGKGYELAEKNPNKYHGVSPFDLGEGVISKFSSRNYSSTFGEEMIKLAKNDDKVVAITAAMPDGTGLKDFREEFPDRFFDVGIAEQHAVTLAAGMAAEGLKPFFAVYSTFLQRAYDQVLHDVCIQKLPVTLCLDRAGLVGEDGETHQGIFDISFLSPMPNMTIVAPKCIDEMEVILKWASNFNAPLAIRYPRGGDIDVNLKPLSKIEYGKWEKVQEGEKIAIVATGKMVQHAMIAAQKIKEEKNIDILIINATFIKPIDKELLNSLSKDGFKIVTIEDNIKKGGFGEGVLEYLNEIGHKEKIVTLAFNDKFIEHGKPDILYKINGLDAEGIKNTLIELL

SEQ ID NO: 74545 - protein, 473 aa, Ralstonia metallidurans CH34
MTTESQAQCPFQTAKSPPPAGSPLPHPYGTWPPGPAAGLTGWHLLRRMSRDLLGTLGEWQQTYGDVVHLRMWPEHAVVVTDPQLVRELLVTHHDSLIRWERGTRVFSRVHGHSVLTAEGDAWSRKRQALQPGFMPKAVHGFVPGIVEIVDKGLATWPTRVADWPVESALTSLTMDVIVRMMFSDEIGEDARVAECAVRAISEAANADFYWPASLPDWVPWKRARRRALHTLRDLIERHLQARLRMRTDTWPDDLLSRLLCLHRDDATAWPLQAVRDECMTTFLAGHETTAATLTWWAWCMASNPSAQDAARAEVTHVLRGQAPTADSRQALRQVVQTITESMRLYPVAPVLISRRAVRPITLGPWRLPARTLFMLPLQLMHHDPRLFPEPERFQPDRFSTGSPQAPRGAYMPFGTGPRVCLGQHLATAEMTVIAAMLLQRYKLSVPEGAAHPRPLLNVTLRPDQPLWLAVTPI

SEQ ID NO: 74546 - protein, 377 aa, Neisseria gonorrhoeae FA 1090
MNTPALLVLADGSVFHGTSIGYEGSASGEVVFNTSMTGYQEILTDPSYCKQIVTLTYPHIGNTGTNAEDEESRSVYAAGLIIRDLPLLHSSFRASESLHDYLVRNETVAIADIDTRRLTMLLREKGAQGGAILTGADATVEKAQELIAAFGSMVGKDLAKEVSCTETYEWTEGEWELGKGFVTPDKQPYHVVAYDFGVKTNILRMLASRGCRLTVVPAQTSAEDVLALNPDGVFLSNGPGDPEPCTYAIEAVQKLMESGKPIFGICLGHQLISLAIGAKTLKMRFSHHGANHPVQDLDSGKVVITSQNHGFAVDADTLPANARITHKSLFDNTLQGIELTDKPVFCFQGHPEASPGPQDVGYLFDKFIGNMKAAKQA

SEQ ID NO: 74547 - protein, 301 aa, Clostridium perfringens str. 13
MKKRKTLEDTAMNINSLKEEVDQSLKAYFNKDREYNKVLYDSMAYSINVGGKRIRPILMLLSYYIYKSDYKKILTPAMAIEMIHTYSLIHDDLPCMDNDDLRRGKPTNHKVFGEAIAVLAGDALLNEAMKILVDYSLEEGKSALKATKIIADAAGSDGMIGGQIVDIINEDKEEISLKELDYMHLKKTGELIKASIMSGAVLAEASEGDIKKLEGFGYKLGLAFQIKDDILDVVGNAKDLGKNVHKDQESNKNNYITIFGLEECKKKCVNITEECIEILSSIKGNTEPLKVLTMKLLERKF

SEQ ID NO: 74548 - protein, 573 aa, Staphylococcus carnosus
MAKQIKGIAASDGVAIAKAYLLVEPDLSFDNESVTDTDAEVAKFNGALNKSKVELTKIRNNAEKQLGADKAAIFDAHLLVLEDPELIQPIEDKIKNESVNAAQALTDVSNQFITIFESMDNEYMAERAADIRDVSKRVLAHILGVELPNPSIVDESVVIIGNDLTPSDTAQLNKEYVQGFVTNIGGRTSHSAIMSRSLEIPAVVGTKSITEEVEAGDTIVVDGMTGDVLINPSDEVIAEYQEKRENFFKDKQELQKLRDAESVTADGHHVELAANIGTPNDLPGVIENGAEGIGLYRTEFLYMGRDQMPTEEEQFEAYKAVLEAMKGKRVVVRTLDIGGDKELPYLDLPEEMNPFLGYRAIRLCLDQPEIFRPQLRALLRASVFGKLNIMFPMVATIQEFRDAKALLEEERANLKNEGYEVADDIELGIMVEIPSTAALADIFAKEVDFFSIGTNDLIQYTMAADRMSERVSYLYQPYNPAILRLVKQVIEASHAEGKWTGMCGEMAGDQTAIPLLLGLGLDEFSMSATSILKARRLIRSLNESEMKELSERAVQCATSEEVVDLVEEYTKNA

SEQ ID NO: 74549 - protein, 540 aa, Lactococcus lactis subsp. lactis
MRAHEILNNPFLNKGTAFTMKERQELGLIGLLPPTVQTIEEQAVQTYEQYLTKPSDLEKRHFLMEIFNTNRTLFYYLFNKHIVEFNPVVYDPTIADTIENYSHLFVDPQYAAYLDINHPENITETLKKAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKSADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 74550 - protein, 514 aa, Photobacterium sp. SKA34
MDITKNNSATPLLDIIVIGGGINGAGIAADAAGRGLNVALYEANDFASATSSASSKLIHGGLRYLEHYEFRLVSEALAEREVILKKAPHVAEPMRFRLPHRPFLRPAWMIRCGLFLYDNLGKRTTLPASKKINLAQSGLLKPEMKVGFEYSDCWVDDARLVLLNIMAIEENGGEVANYCKVENAVREGDIWRVTMVDQRTGEHFERRTKALVNAAGPWVKQFFDNGLETPSPRNIRLIKGSHIVVPKIHNEEQAYILQNKDNRIVFVIPYLDDFSIIGTTDLEYKGDPRHVAIDETEIDYLIDIVNQHFVDQLGREDVVWTFSGVRPLCDDESNSPQAITRDYTLELEQELDQAPLLSIFGGKLTTYRKLSESAMKHLEPFFPQMGKSWTANQALPGGNFSCSRKQLAESLQSRYPWLSDKQALRYVKQFGSYCYKMLADVTCIDDMGIQFADAVYQKEIDYVIAHEHVKTVEDFLWRRTKLGLYLTDEQQLQVKEYIDANAPSNNIVSFHKVG

SEQ ID NO: 74551 - protein, 521 aa, Ustilago maydis 521
MDSSHGTTSRSPEPVTISTPTGNQWQVPSGIFINNSFHASVSGKTFDSINPATGEKLCTLALGGAADIEAAVKAARTAFKTTWGKKSTPTQRSQLLLKFADLVDKNLDELAELESMDNGKPVWMASSFDVPDSAACLRYYGGLADKIEGKTIEQTEGEKIAYTRIEPLGICGQIIPWNYPIQMAAWKLGPALAAGNCVILKPAEQTPLTALKLAQLSVQAGFPAGVISVVNGYGAEVGEAISRHMDIQKVAFTGSTATGKRIMKAAAESNMKKVTLELGGKSPVVVFESADIQQAVRWVCLGILFNQGQDCTAGSRLFVQDRIYESFMEQLVAAFKAHKVGDPFHQLTFQGPQVSQQQQEKILDMIESGKRQGAKVEVGGQAWKSADSKFNKGFFVEPTIFSGCRKGMRIVDEEIFGPVLAVAKFSTEEEAIRLANETVYGLGAGVFSENASQIQRMVSAIDAGTVWVNNYVALSNSVPFGGMKASGFGRELGVDAIKAYCDVKAIHWNYGEKLDWPLPKL

SEQ ID NO: 74552 - protein, 563 aa, Bordetella pertussis Tohama I
MPHSVACLDLRVIALLEAKRAGLLRRAHWLPNIVSGLIVGVVALPLAMAFAIASGAKPEQGLYTAIVAGLLVSLCGGSRVQIAGPTGAFIVILAGITAQHGVAGLQLATLMAGCILLALGAARLGAIIKYIPAPVIVGFTAGIGVIIWVGQWKDFFGLPSPAGTHFHEKLWQLVHSLPQLHLATTALAALSLALLLLNNRLPYLRRVPGPLVALVVATTLQAALGLDGVATIGSAFGGIPQGLPSWQWPEITVSRVIELIGPAFAIAMLGAIESLLSAVVADGMAGTRHDSNQELVGQGLANIVAPLFGGFAATGAIARTATNIRNGGTSPLAGVVHCITLLLMVLLLAPLAENVPLAALAAILFVVAWNMSDAPHFVRMIKRAPRADVAILLVTFVLTVFADLVVAVNIGVVIAILHFLRRMASSVQVQAQSPAELGDELGHRGYGPLPDDVLVYAVEGPLFFGAAENFERALAATHTDPRTLIIRLRWVPFIDITGLQALEEVITDLQRRGVRVILSGANPRVKAKLHRAGLVGLAGADNVFDRFEDAVLSCRAPAAPATA

SEQ ID NO: 74553 - protein, 472 aa, Pseudomonas syringae pv. syringae B728a
MFTPVILAGGSGSRLWPLSRQSFPKQFLALDGQDQGTMFQRTLARLKGLEHAPAVVVSNENHRFIVAEQLRVAKMGSRRVILEPLARNTAPAIALAALEATADGTDPILLVLAADHHIHDEEAFRQAVAVAQVHAEAGRLVTFGITPTHAETGFGYIHCGESIAQGGFAIEAFKEKPSPEMAAEYLSSGAYLWNSGMFMFRASVFLAELKKHRSDILSACRVALADSDADSYFLHVSAEKFALCADESVDYAVMEHTDLGLVVPLDAGWNDLGSWAAIWDVGPHDENVNRLEGDVMAIDTRNCLVQSHHRLVATVGVEDLIVIETKDAVLVANKHNSQQVKDVVKRLQAEERPEFVTHPLVNRPWGHYDTIDLGERYQVKRISVLPGECLSLQMHYHRAEHWIVVSGTAKVICDDKELILSENQSTYIPLGVKHSLANPGKVPLELIEVQSGSYLGEDDIVRFEDRYGRLKK

SEQ ID NO: 74554 - protein, 134 aa, Oryza sativa
KHYKTRLDHGEFSKELQDLLLEYGIDSIAEVLVEGLSRVKRCTDEGRALMSLDLQVLINGLLHIVSANVRPKLQIVDTFIKAYYLPETEYVHWARSHPEYSKSQVVGLVNLVATMKGWKRKTRLETIERIEAGP

SEQ ID NO: 74555 - protein, 280 aa, Debaryomyces hansenii CBS767
YRGIIAPLDTIKIRLQLQIQGYDTYKGASKTFVSICKNEGVKALWKGNVPAEILYILYGAIQFTSYSALSKALSEFEKNNRNLFTISNSTHSLIAGSGSGLASTFFTYPFDLLRTRLAANSEAHFLSMLSTIKLIYEMHGIGGFCKGLTPGLLSVASSTGLMFWSYELAREFSNNYKDVIPFLEGFCGFIAGATAKGLTFPLDTLRKRIQMLSKTRDIDQNSIKAIQLCKTILKNEGIFGFYKGFSISILKSAPTSAISLFTYEYSLSAIKEFTSKHKKL

SEQ ID NO: 74556 - protein, 63 aa, Glycine max
  misc_feature (11)..(11): Xaa can be any naturally occurring amino acid
  misc_feature (15)..(15): Xaa can be any naturally occurring amino acid
MKFNIANPTTXTSEXLLIEDDLKLPAFWEQIISQEDTGQALCDAFNGNVIIITGGYDKQGSPM

SEQ ID NO: 74557 - protein, 303 aa, Vitis vinifera
MAELQPPESTVNAGPVGVAIAPAVPAAVENLSTSLAPKRQRRPSVRLGEIGDQPAATLSYDSQARRVKPWRFHKDYGQASKASKTRPLTNLVNGGECHETLETEERSFAGDGNLDSAVFGNRKAKRRGATKRVRSNWATKFDDGAEGDEKFSGREDDEEEYRDFDPEGSESLLKEQSPVHSVDNVALDLWHGHRRPVRARVSESREHDAVELDAMPDSDSRDRKCRTSADRNLTANRLLDDGVRTWLFGLGLGRYAPVFEIHEVDFEVLPLLTLEDLKDMGINAVGSRRKIYTAIQNLRKGFT

SEQ ID NO: 74558 - protein, 293 aa, Oryza sativa Japonica Group
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGDAKKASPRTLQQNGVSNCPLRDAAAFCLDGHRP

SEQ ID NO: 74559 - protein, 366 aa, Pseudomonas syringae pv. syringae B728a
MGFNCGIVGLPNVGKSTLFNALTKSGIAAENFPFCTIEPNSGIVPMPDPRLAALAAIVNPKRILPTTMEFVDIAGLVAGASKGEGLGNKFLANIRETDAIAHVVRCFEDENVIHVSNSVDPKRDIEIIDLELIFADLDSCEKQLQKVTRNAKGGDKDAVVQKGLLEQLIAHFSEGKPARSLMKSMSNDEKATIRGFHLLTTKPVMYIANVAEDGFENNPLLDVVRAIAEEEGAMLVPVCNKIEAEIAELDDGEEKDMFLEALGLEEPGLNRVIRAGYEMLHLQTYFTAGVEEVRAWTVRVGATAPQAAGVIHTDFEKGFIRAEVVAYDDFIQFKGESGAKEAGKWRLEGKEYIVKDGDVMHFRFNV

SEQ ID NO: 74560 - protein, 434 aa, Coccidioides immitis RS
MEDYDPSVTEEQEEEISEEKVINEEYKTWKKNAPFLYDMILSTALEWPTLTTQWLPDKQEVPDKPYSTHRLLIGTHTSNDAQNYLQIAHVQLPNPKAPDVEDYDDDRGEIGGYGSSGSQRTPMEVKFHIVQKIDHKGEVNKARYQPQNPNVIATMCTDGRVMIWDRSKHPSLPTGTVNPELELLGHTKEGFGLSWSPHSAGHLATGSEDKTVRLWDLTQYTKGNKALKPVRTYTHHSSIVNDVQYHPLHSSLIGTVSDDITLQILDIRESDTGRSAASAKGQHKDAINSIAFNPAAETVLATGSADKSVGLWDLRNLKSKLHALECHQDSVTSLAWHPSEEAVLASSSYDRRIMFWDLSRAGEEQTQEDSQDGPPELLFVHGGHTNRISDFSWNLNDPWVLCSAAEDNLLQVWKVADAIVGKDMEDVPTEELET

SEQ ID NO: 74561 - protein, 313 aa, Pseudomonas syringae pv. syringae B728a
MSKMMVFTGNANPDLARRVVRQLHIPLGDVSVGKFSDGEISTEINENVRGKDVFIIQPTCAPTNDNLMELVVMADAFRRSSASRITAVIPYFGYARQDRRPRSARVAISAKVVADMLTVVGIDRVLTVDLHADQIQGFFDIPVDNIYGSPVLVDDIEDQRFENLMIVSPDIGGVVRARAVAKSLGVDLGIIDKRREKANHSEVMHIIGDVEGRTCILVDDMVDTAGTLCHAAKALKEHGAAKVFAYCTHPVLSGRAIENIENSVLDELVVTNTIPLSAAAQACGRIRQLDIAPVVAEAVRRISNEESISAMFR

SEQ ID NO: 74562 - protein, 146 aa, Leptospira interrogans serovar Lai str. 56601
MYIKQILAKKDRRVLSVEPETLVMDVVKFMTKYDIGSVIILGEGKLKGIFTERDVLHLSAELGLDLFKKSVSEVMTTSITTMTPEDDVDELLSIMLKKRIRHMPILENDTLIGIISIGDAVKAKIEKTEEENKNLKQYMYSENGFI

SEQ ID NO: 74563 - protein, 308 aa, Bacillus halodurans C-125
MWKQDETLEQIVLECKKYTEEGTVASYIPALAKADVSTLGIAIYRGGDEQVIAGDADEKFTLQSISKVIALALALLDVGEEAVFSKVGMEPTGDPFNSISKLETSVPSKPLNPMINAGALAVTNMIIGETTEQSLGRLLSFIHELTKNPTITYNLEVAQSEFDTAFLNRSLSYFLKQHGVIQADVEQLLDLYTKQCAIEMCCSDLARIGYVFANEGRDPDTGQRIVPLHVARIIKTFMVTCGMYNASGEFAIRVGIPAKSGVSGAILALVPNKYGIAVYSPALDEKGNSLAGIKLLETLSCREEWSIF

SEQ ID NO: 74564 - protein, 202 aa, Kluyveromyces lactis NRRL Y-1140
MSSNSKRRIETDVMKLLMSDHDVELVEDKMQEFHIKFHGPKDTPYEKGVWRLHVELPDNYPYKSPSIGFVNKIFHPNIDAASGSICLDVINSTWSPLYDLLNIVEWMIPGLLKEPNGSDPLNNEAATLQLKDKDMYEQKIHEYINKYATKEKYIQQFGKWNSSDDTDDEDEDADMDESDDEQAHDDNDSMELSDIEVSDDDD

SEQ ID NO: 74565 - protein, 267 aa, Bacillus halodurans C-125
MTRENKWIDIGEVAKAWVVEAAQQIKQALEGTFNVEAKSNPDDLVTDVDRSTERFFYEKVTSHFPKHHFLGEEGTAEKLDRLDGTVWIIDPIDGTMNFVHSQYHFAISVGVFHDGVGKVGIIYDVMNDEMFYAVQGEGAYVRDTKLKTITTSSVNESVVGVNARWLVEQRAPFRGELERLVRDVRGVRSFGSAALELAYVAAGRLDGYVSLKLSPWDYAAGKVLLAEVGGTITTLQGEELSLLEPSTLLAANSSLHSAIVDQYIKGE

SEQ ID NO: 74566 - protein, 465 aa, Sulfitobacter sp. EE-36
MDGTFSENDISRVVEADRAHIWHHLSQHKAYETTDPRIIVEGKGMRVWDQKGKEHLDAVSGGVWTVNVGYGRESIANAVRDQLIKLNYFAGSAGSIPGSHFAEKLIDKMPGMSRLYYCNSGSEANEKAFKMIRQIAHKRYGGKKHKILYRDRDYHGTTIACLSAGGQEERNAQYGPFTDGFVRVPHCLEYRKFEQDGAPEDNYGVWAADQIEKIILAEGPDTVGGLCLEPVTAGGGVITPPDGYWERVQEICRKYDVLLHIDEVVCGIGRTGEWFGYQHFGIQPDMVTMAKGVASGYAAIACLVTTEEVFNLFKDDASDPLNYFRDISTFGGCTAGPTAAIENMAIIERENLLQNTRDMGQYMLEELEELSDKYDVIGQVRGKGLFLGAELVQDRSTRVPVIEAQIQAVVADCMAQGVIIGATNRSVPGKNNTLCFSPALIAKKDDIDQIIAAVDGAMGRVFGSK

SEQ ID NO: 74567 - protein, 423 aa, Neorickettsia sennetsu str. Miyayama
MQNLVQRRLGNNLPVFVDSISGHYSVSIKVWVRAGSECETQENGGLAHFLEHMIFKGTSTRNAAQIAEDFDRLGGYFNACTSRGYTVYYVRLLEEHLDKGMEILSDVINNSIFPEEELEREKLVVLEEISQTEDAPDDIIFDRFFESIYPNQAYGRPILGSRENVKRFTRNDIASFISQHYYSENMMLIASGKVDAERFISLAEKYFGGIKSISRRAANRLPAKYVPVEYREERKLEQTHIILGLPCVSYSDGISQVYSAKVLAILFGGGMSSRLFQEVREKRGLAYSISAFHAPSETSAIMGVYSSTDPKRLKELVAVVLGELAKLRNTLTIEEVESAKQQIKSSILMSLESNESRASHIGRSIHYFGRYIDGAELIEVIDAVEVDDVASITEFMLRGKRLSLALIGAKDVLDERGVLAEAL

SEQ ID NO: 74568 - protein, 485 aa, Aspergillus fumigatus
MAENMSTSGSSTLPPPPPQASSASGQQYDSSQGNGQANPSHMPPPPRPPVVIPQNTNPIPTAITSPMSGNMMSPTSAGGYVRRAAPEPNKRALYVGGLDPRVTEDILKQIFETTGHVQSVKIIPDKNFNSKGYNYGFVEFDDPGAAERAMQTLNGRRIHQSEIRVNWAYQSNSANKEDTSSHFHIFVGDLSNEVNDEILLQAFSAFGSVSEARVMWDMKTGRSRGYGFVAFRERADAEKALNAMDGEWLGSRAIRCNWANQKGQPSISQQQAMAAMGMTPTTPFGHHHFPTHGVQSYDMVVQQTPQWQTTCYVGNLTPYTTQNDLVPLFHNFGYVLETRLQADRGFAFIKMDTHENAAMAICQLNGYNVNGRPLKCSWGKDRPPTGQFDNFSGQQPNSPFNSNPATYFPQYGGPGAPITPQGTFHILSPSPTPAGRGWEQGGMTGQGYGQAPQNAGFGRGQATPNSGWNQPNNGNFGNGFGGYQA

SEQ ID NO: 74569 - protein, 540 aa, Lactococcus lactis subsp. lactis
MRAHEILNNPFLNKGTAFTMKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKSADYKDAGDMTDLLNVVKTVKPTILVGTSTNPGAFTKEVVEAMCANTERPVIFPISNPTKKMEATAEQVIEWSDGKAFVATGVPSGTINYKGVDYQIGQANNSLIYPGLGLGMMASEAKLLTDEMIGAAAHSLSGLVDPGKPGAPVLPPFEFVADVSIKVAEAVAKKAQEQGLTESKETDMAKAVRDLKWYPEY

SEQ ID NO: 74570 - protein, 388 aa, Zea mays
LQDANGLGLKAVTGEDYCRVVIQYPSDTVSKWRDPITHKAESLSFEFNLCEAVASWEHVRNSTTVLTKEYIDALPNGWEEYAWRRINKGILLNKCQNRSLCMEKLSLVLPETSPYVPRHFGRCAVVGNSGDLLKTKFGDEIDSYDAVFRENGAPTQNYTEYVGRKSTFRLLNRGSAKALDKVVELDETKKEALIVKTTIHDIMNQMIRELPITNPVYLMLGTSFGSSAKGTGLKALEFALSICDSVDMYGFTVDPGYKEWTRYFSEVRKGHTPLHGRAYYQMMECLGLVKIHSPMRGDPGRTVRWLPTKATIEAARVASEKLLKRPGAGSDDPLGTCTMIKKRRKGKAPNRSGLRDAAMKHLEDMKGAARYPLERNAGGGYLCMINDR

SEQ ID NO: 74571 - protein, 280 aa, Francisella tularensis subsp. tularensis SCHU S4
MIKVSFQGEHGAYSEQAITNFLEQQNIKDFQTVTCWSFSDAIEHTISGKSNFVMIPVENSLAGSVVPAYDELIKSNLKVKAEVVLKIKHCLMGLNDVEISEIESVISHPQALSQCANSLKKLKLTPEAFVDTAGAAKYIFEKNKRNHLAIAGELAAKTYRLKIFQHELEDEQFNYTRFLLMGYDDIKVNSADNKYKTTIIFSVEDKSNALVNTLNVFSKYNINLTKIESRPSRNRAWNYLFFIDFEGSDDDFNVQQALLEVLKKSTFLKVLGSYKSYHFS

SEQ ID NO: 74572 - protein, 363 aa, Neisseria gonorrhoeae FA 1090
MSLKCGIVGLPNVGKSTLFNALTQSGIEAANYPFCTIEPNVGIVEVPDPRMAELAKIVNPQKMQPAIVEFVDIAGLVAGASKGEGLGNRFLANIRETDAIVNVVRCFDDDNIVHVSGKVDPIADIETIGTELALADLASVEKAIVREEKRARSGDKDAQKLVDLCKKLLPHLDEGKPVRSFGLDAEERALLKPLFLLTAKPAMYVGNVAEDGFENNPHLDRLKELAAKENAPVVAVCAAMESEIAELEDGEKAEFLAEMGLEEPGLNRLIRAGYDLLGLQTYFTAGVKEVRAWTIHKGDTAPQAAGVIHTDFERGFIRAQVIAYDDFVSLGGEAKAKEAGKMRVEGKEYVVQDGDVMHFLFNV

SEQ ID NO: 74573 - protein, 407 aa, Francisella tularensis subsp. tularensis SCHU S4
MYDVNKIRQDFPFLAQKINNKSVLFFDTGASAQKPQAVIECVAEAYAYNYANVHRGVYSLSQEASEKYENVRQIVQKFLNSKSADEIVITKGTTEAINLVASSIGKGIIRSDDEIVVTEMEHHANFVPWQMLCEDKNLDFKVAAVKDNGELDVDNLLALVTAKTKILAITLCSNVLGTINPVKEIIKQVREINPNIIVLVDGAQAVIHTKVDVQDLDCDFFVFSGHKLYGPTGVGILYGKYELLKQLPPYNYGGDMVDEVTIAKTTFALPPYRFEAGTPNIVEAIGLGRAIEYVDSIGMINIEKHEQKLLEYATAELNKIDGLTIFGQAKHKAGVITFDIQGCNAGDIGELLAIKGICVRTGKHCAHPLMYRMGVTSTVRMSFGMYNTFEEIDLFIIALKKVISQLK

SEQ ID NO: 74574 - protein, 457 aa, Escherichia coli K12
MTTRLTRWLTTLDNFEAKMAQLPAVRRYGRLTRATGLVLEATGLQLPLGATCVIERQNGSETHEVESEVVGFNGQRLFLMPLEEVEGVLPGARVYAKNISAEGLQSGKQLPLGPALLGRVLDGSGKPLDGLPSPDTTETGALITPPFNPLQRTPIEHVLDTGVRPINALLTVGRGQRMGLFAGSGVGKSVLLGMMARYTRADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGISGGGSITAFYTVLTEGDDQQDPIADSARAILDGHIVLSRRLAEAGHYPAIDIEASISRAMTALISEQHYARVRTFKQLLSSFQRNRDLVSVGAYAKGSDPMLDKAIALWPQLEGYLQQGIFERADWEASLQGLERIFPTVS

SEQ ID NO: 74575 - protein, 191 aa, Mesorhizobium loti MAFF303099
MNAQHLQPTGSAYFIAKETERPEIHTLSVLVDNEPGVLARVIGLFSGRGYNIESLTVSETEHEKHLSRITIVTRGTPHVMEQIKNQLERIVPVHRVVDLTVRSHELGQERPLERELALVKVAGSGEARVEALRLADAFRASVIDANTEHFIFEITGKGSKLDQFIAIMKPLGLVEICRTGVAAMNRGPQGM

SEQ ID NO: 74576 - protein, 337 aa, Pseudomonas sp. ATCC29598
KEVENQQKLANVVILATGGTIAGAGASAANSATYQAAKVGVDKLIAGVPELADLANVRGEQVMQIASESITNDDLLKLGKRVAELADSNDVDGIVITHGTDTLEETAYFLDLTLNTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRLTPALQTLRKTGTQIIRSSHVNQGGFVLRNAEQPDDKNDWVVAHDLNPEKARILVELAMVKTQDSKELQRIFWEY

SEQ ID NO: 74577 - protein, 507 aa, Streptomyces avermitilis MA-4680
MAARAAGRRPCLTRTTPQEAIVPDLFIDGEWRAALDGRTREIRCPADGSLVGVVDEAGGKDTAEAIAAARRAFDEGPWPWLPAADRGDLLLRVADLLVRDRAKLARAESLDTGKRFVESEYDIDDIVNCFRYFGRLAAAESGRVIDTGSASTDSRVVYEPVGVCALITPWNYPLLQTAWKVAPALAAGNTFVLKPSELTPHTAIHLMRLLQEAELPPGVANLVLGAGPEAGAPLADHPDVDLVSFTGGLHTGRRLMAAAAGTVKKVALELGGKNPNIVFADADFDTAVDMALTAVFLHSGQVCSAGARLLVEDSLHDRFVDEVVRRAAEIRLGGPFDERAQTGALISAAHRAKVEAYVAKGLDEGAVLRCGGRRPEGLDEGFFYLPTVLDECTSGMSVIQDESFGPVLTVERFTGEAEAVRLANDTVYGLAGAVWTTDEAKAQRVVSRLRIGTVWINDYHPYVPQAEWGGYKQSGFGRELGPSGLAEYREAKHIWRNTDPSPQGWFA

SEQ ID NO: 74578 - protein, 506 aa, Bordetella pertussis Tohama I
MDLSDLKKLGLDVAYPFKEQYENYIGGQWVAPAGGEYFDNLSPITGQPFCRVPRSGAADVELALDAAHRACAAWARTSPAERANILLRIADRIEGQLPMLAVAESIDNGKPLRETTAADLPLAIDHFRYFAGCIRAQEGAISEIDANTVAYHFHEPIGVVGQIIPWNFPLLMVAWKLAPALAAGCVVVLKPAEQTPASILVLAELIGDLLPPGVLNVVNGYGKEAGQALATSKRIAKIAFTGSTPVGKHILHAAADNLIPATVELGGKSPNIFFDDVMDHDDEFLDKALEGLAMFALNQGEVCTCPSRILIQESIYERFIEKAIARVQSIKTGHPLDAGTMVGAQVSQVQMDKILSYIDIGRQEGAQCLTGGARNDMLPGGLDQGFYVQPTMLLGKNSMRIFQEEIFGPVAAVATFKDEEEAIAMANDTFYGLGAGVWSRDGARAYRVGRGIEAGRVWTNCYHLYPAHAAFGGYKQSGIGREAALSNYQQTKCLLVSYSAKALGFF

SEQ ID NO: 74579 - protein, 509 aa, Solanum tuberosum
MTLRISELFAAAIIYIIVHIIISKLIATVRERGRRLPPGPTGWPVIGALSLLGSMPHVALAKMAKNYGPIMYLKVGTCGMVVASTPNAAKAFLKTLDINFSNRPPNAGATHLAYNAQDMVFAPYGPRWKLLRKLSNLQMLGGKALENWANVRANELGHMIKSMFDASHVGECVVIADMLTFAMANMIGQVMLSKRVFVEKGAEVNEFKNMVVELMTVAGYFNIGDFIPKLAWMDLQGIEKGMKSLHKKFDDLLTKMFDEHEATTYERKENPDFLDVVMANKDNSEGERLSTTNIKALLLNLFTAGTDTSSSVIEWALAEMMKNPKIFKKAQEEMDQVIGKNRRLIESDIPNLPYLRAICKETFRKHPSTPLNLPRVSTEPCTVDGYYIPKNTRLSVNIWAIGRDPDVWENPLEFNPERFLSGKNAKIEPRGNDFELIPFGAGRRICAGTRMGIVMVEYILGTLVHSFDWKLPNDVIDINMEESFGLALQKAVPLEAMVTPRLSLDVYCC

SEQ ID NO: 74580 - protein, 363 aa, Streptomyces avermitilis MA-4680
MVVPHEVRAVVAVKKGAPVEVQTIVVPDPGPGEVLVAVQACGVCHTDLHYREGAITDDFPFLLGHEAAGTVEAVGAGVTDLAPGDYVVLAWRAPCGSCRSCRRGRPWYCFDSRNATQPMTLLDGTPLSNALGIGAFAEKTLVAAGQAVKIDPAARPEAAGLIGCGVMAGYGAAVNTGKVGRGDTVAVIGCGGVGNAAIAGACLNGAMKVIAVDIDDKKLDQAEKFGATHTVNSRGTDPVEAVRALTDGFGVDIAIDAVGRPETYKQAFYMRDHAGTLVQVGVPDPEMKIDLPLIDLFSRGGALKSSWYGDCLPSRDFPFLIDQYLYGLLDLNAFVSETISLEQVEEAFAKMHRGEVLRSVVVL

SEQ ID NO: 74581 - protein, 158 aa, Physcomitrella patens subsp. patens
MAEQRVKLRSSDDEMFEVDEAVAFESQAVKNMIEDTGKDAVIPLPNVSSKILAKVIEYCKYHVDNQKGATDDKPAASEDDIKAWDADFVKVDQATLFDLILAANYLNIKNLLDLTCQTVADMIKGKTPEEIRKTFNIKNDFTPEEEEEVRRENQWAFE

SEQ ID NO: 74582 - protein, 216 aa, Cryptococcus neoformans var. neoformans B-3501A
MSVMELNGGSVVAMIGKDCVAIASDLRLGNQQVGIAANFDKVFPINDKLYCGLPGLATDVYTLREHLRFRVNMYRMKEEREITPKTFTHLLSSTLYEKRFGPFFLEPVVAGLPTPTSLEPHPRPYISTMDTIGCITTPKDFAVAGTAADKLYGIAEGLWEPDLEPEDLFETISQTLLSAVDRDALSGWGAVVNIINYSDTQSENGLRKLGEEVQVQ

SEQ ID NO: 74583 - protein, 330 aa, Lactobacillus helveticus
MKVLVIGGAGYIGSHAVRELVKEGNDVLVLDALYTGHRKAVDPKAKFYQGDIEDTFLVSKILRDEKIDAVMHFAAYSLVPESVKKPLKYYDNNVTGMISLLQAMNDANVKYLVFSSSAATYGIPKKLPITEDTPLNPINPYGETKMMMEKIMAWADKADGIKYTALRYFNVAGASSDGSIGEDHAPETHLIPNILKSAISGDGKFTIFGDDYDTKDGTNVRDYVQVEDLIDAHILALKHMMKTNKSDVFNLGTAHGYSNLEILESAKKVTGIDIPYTMGPRRGGDPDSLVADSTKARTVLGWKPKHENVDDVIATAWKWHKSHPKGYEDK

SEQ ID NO: 74584 - protein, 340 aa, Brucella melitensis 16M
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEEVDILGEYFVK

SEQ ID NO: 74585 - protein, 543 aa, Oryza sativa Japonica Group
MLNPIEKKLKMRARRVLAKLAEKKKSAAEYARAERSLDGIDMTCKIVDFGNACWADKQFTDFIQTRQYRAPEVILGSGYSFPVDMWSFACIAFELATGEMLFTPKEGQGYSEDEDHLALMMEILGKIPKKIATMGTKSKEYFDRHGDLKRIRRLKFSSIERVLVDKYKISESDAREFAEFLCPLFDFAPEKRPTAAQCLQHKWLQYSDGKNYGTLNISDVKNASVTCSPGTTASSDSKSIDVTRNIGDKPDSYAERADAKCNTSKKSIINSNSENSNVQPNTASVGNRNSKIDDVNSNTGSITNKDSKNTVIKPSIGSFVNRNAETVDVKPNIGSITSRGDSSSDTKSNIGSVASKDAKTIDAKPSTSSITSQDSKIGDGRSNIDGIANRDAKTADVKHNIRSVVNTYLRNFDVKHNTGNIVDGGVKHSDLKPGTVSAANVDSKSISAKPSTGSFENSDAKSISAKTSTGSFDNSDARNIMKANTGIVANNDIKDTDVQTNTESVTSGDDLNDIDRKPNIGRVAASIQRLESSIGKVQSGKYR

SEQ ID NO: 74586 - protein, 635 aa, Dechloromonas aromatica RCB
MIALRQVTFARAGRPLVIDASVQLHPGWKVGVVGANGCGKSSLFALLANELHAESGNVEIPASWHIARVAQETPALPDSALDFVLDGDIELRRIERELVEAEAKGDGLAIGHLHARYGEIGGYSAKARVAEVLHGLGFTDADFSRAVSEFSGGWRVRLNLARALSCRADLLLLDEPTNHLDLDAVFWLENWLKNTPATLLLISHDRDFLDAVVGQIIAIDLQRLTLTSGGYSDYERARAARLATQQSAFEAQQREIAHLSSFIERFKAKATKARQAQSRIKTLERMEMVAAAHVDSPFHFSFREPTALPDPLLSIEKASAGYADHRIIDNVTLTLRPGCRIGLLGRNGAGKSTLIKLLANAIPQQGGERKEAKALNIGYFAQHQLEQLRPDESPLQHLVRLDPTATEQELRDYIGGFDFRGDMATRAIEPFSGGEKSRLALALMIRNKPNLLLLDEPTNHLDLEMREALTFALQDFEGGVVFVSHDRHLLRTCADELLLVADGKVTEFDGDLDDYAAWLAAQRNAEKAPEPNAAAEKNERLAQRADAKANRQALLAQRRPLVKEIEQLERKLAKWNEEKAALDTQFADPNFYTTVDRIKSEEMHKQAGLLGEQIDEAEMRWLEVHEALEALPPTD

SEQ ID NO: 74587 - protein, 522 aa, Sulfitobacter sp. EE-36
MTQQQNASWQITKPATRSRKGIVASQSRVAAQVGADVMAQGGNAVDAAIATSFALGAAEPWMSGMGGGGFMVVRMAGETTAKVIEFGMKSPKGLDVADYPIVGGKAGDLFPWPSVLEDRNVFGAKAIAIPGQVAGMGLAHESFATKPWADLLAPAIKLADDGLPVDWYTQLILGGSAKDLAPFPASAETFLDADGFPKSSGWTALGETKCDLGRLAASLRTVAKDGPRAFYEGALAQSIVADLQAAGGHHTAEDLAQYQATLVDAMHYAYRGHEVIATPTLTAGPTMRRALDLMTAWQPGTDAPDAEAFIAYDRAIRQANQERYDTMGDIEHEPDPSCTTHFSVVDAAGNMVAVTQTLLSIFGSRMMLPRSGILMNNGIMWFDPEQGKPNSLGPDKRCLANMCPTLLERADGAQFALGASGGRKIMPAVVELTSLLLDYGMDLETAFHAPRTDMSLADVTIVDQALPPQVIATLQDTLDNVVLAPRTIFPYHFACPSAVGRAGDENTGVTEVMSAWGDAVSA

SEQ ID NO: 74588 - protein, 246 aa, Lactarius quieticolor
DPRVKVLAVNDPFIDLQYMVYMFKYDSVHGRFKGTIEIKDGKLVIDGHSITVFQERDPANIKWGSVGADYVVESSGVFTTVDKASAHLKGGAKKVIISAPSADAPMFVVGVNLDAYDPKYTVISNASCTTNCLAPLAKVINDKFGIIEGLMSTIHATTATQKTVDGPSNKDWRGGRAVNGNIIPSSTGAAKAVGKVIPALNGKLTGLAFRVPTNDVSVVDLVVRLEKEATYDEIKHAVKEAADGPL

SEQ ID NO: 74589 - protein, 173 aa, Arabidopsis thaliana
MDHDKTGCQSPPEGPKLCTNNCGFFGSAATMNMCSKCHKDMLFQQEQGTKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKAEKLDKI

SEQ ID NO: 74590 - protein, 184 aa, Physcomitrella patens subsp. patens
GESMWNDLKLFTGDVDIPLTEKGVEEALAGGRAVSEIDFDIIFTSRLVRAKQTALIAMTQSKFKRVPALETAACRMVPVYADPALNERCYGDLQGLNKAAAIAEFGEETVTRWRRSYDTRPPNGESLQDTYVRSVGFFNSTIEPRLKEGHNVFLVAHGNVLRCLISHLGGYSDLEMLRLQVISP

SEQ ID NO: 74591 - protein, 286 aa, Oryza sativa
  misc_feature (186)..(186): Xaa can be any naturally occurring amino acid
MAAASVLLLLPSPFLRPSSPAHRARCGIATTTTTSTSGRRGLFLFASRCRPGPRRRAASAAVPPEHGLSQPQPQARAVGSYEAALGDAKDALYAALEGMNRGIFGMTSEKRSEIHALVELLESKNPTPEPTDKLQDKVDGCWRLVYSTISILGKKRTKLGLRDFISLGDFFQMIDVKEHHLLYTQXEKAVNVIKFSARALKILSGQLTIEASYKITTKTKVDITLDSSTITPDQLMNIFQKNYDMLLAIFNPEGWLEITYVDESLRIGRDDKANIFVLERADPSEV

SEQ ID NO: 74592 - protein, 220 aa, Nostoc punctiforme PCC 73102
MDISPIKAVQAPYYGDSSYRTPPPDLPSLLLKERIVYIGMPLVPAVTELIVAELLFLQSDDPEKPIKIYINSTGTSGYSGEPIGFETEAFAIYDTMRYIKPPIHTICVGSAMGMSAMLLSAGTKGCRASLPHSSIILHQPKSYAQGQATDIQIRAREVLVNKGALVDILHQTTGQPREKITKDMDRLLYLTPYEAKEYGLIDRVFEKEELANPPLPASVL

SEQ ID NO: 74593 - protein, 409 aa, Chromobacterium violaceum ATCC 12472
MLIEVKVPQLPESVSEARLMSWHKKVGEFVKRDENLIDLETDKVVLELPAPQAGVVVEIIEQDGATVTSGQLIAKIDTAAKAGDAAPAAAAAAPVQAAPAAGAAAMPSAAKLAAETGVDLSKVAGSGRDGRVLKEDVQAAAKSAAPSQAGPVLAPASAGAALSATPAAVNVAGILSGRAEQRVPMSRLRQRVAERLVMSQQTNAILTTFNEVNMKPVMDLRAKYKDRFEKEHGIKLGFMGFFVKAVVAALKKYPIVNASVDGNDIVYHGYFDVGVAVGSPRGLVVPVIRNADQLSLAEIEKQIADFGKRAQEGKLTVEELTGGTYTISNGGTFGSMMSTPIINPPQSAILGMHATKERAVVENGQVVVRPMMYLAQSYDHRIIDGREAVLSLVAIKDAIEDPARLLLDL

SEQ ID NO: 74594 - protein, 1286 aa, Nakaseomyces delphensis
ISVGFHGDGAEQLARTGISFVNFEKLLRGSVSSSASTLFGTEGATDLIINLSQCSDELVKSAPNDVAVYNISEYKRGLLSEILERAPQSVSRITLLQGSVPNNTTSTLEFEPFLLDFFGDFDLLVERNIKQLLLTKIGNEVADFEQTLSQIIENLRSQEPVNNLFVGESAVTNKDEVEKYHQSVQKILHLEDAYIKVLKQLLKDNLSIINEYTSPSITVNSPEYGYGHYLYEKQIRNAVVDEVKKSLDPELFHSQDSGEFVQKLSKWVSFHNSALDEQQLNEANKIGREVYQYLSENAHSQTAIKIIETAGNNLDAFLFKSNWLIGSDAWSYDLGNSGVHQVLTSNDNINILIIDSEPYENRKASKDRKKDVGLYAMNFHNVYVASVAVYSSYTQLLTAFIEAAKYNGPSVVLAYLPYKSERDTPLDILKETKIGVESGYWPLYRYNPLKEDTKESPAFYLDSSVIRKQLQSFLERENKLTLLAKRDPELARNLAQSASDAITKKQNKRAEAALDDLLNGLSGPPLHIYFASDGGNASNLAKRLHGRATSRGLKATVLSMDDIILEDLPGEENAVFITSTGGQGEFPQDGKTFWDALKASTDLDLSSLKVSVFGLGDSQYWPRKEDKKYYNKPSQDLFKRFSTLGAQFLAPLGLGDDQDDDGYQTAYNEWEPKIWEALGVSGVEVEDEPKPVTNEDIKMQSDFLRGTIASDLIDESTGTVQYSNEQLMKFHGIYTQEDRDVREIRKSEGLEPAYQFMARARLPGGKCSGSQWLGLDKLSDDSGNGTLKLTTRATFQIHGVLKKNLKHTIRGMNAVLIDTLAAAGDVNRNVMVTSLPARAKVHEQVSDMGAKISEHFLPKTTAYHEIWLDGPEDQDYEDNWNKRFDSRNEGPRKKKTLVSGNALVDIEPIYGPAYMPRKFKFNLTVPPYNDVDVFSADIGLIAIVDDKTDIVEGYNTYVGGGMGTTHGNKKTYPRIASSFGFVKTEKILPALEALFIIQRDYGNRQDRKQARVKYTVDTLGVEGYKEKAEEIWGDKFEPERPYEFTSNIDYFGWVKDEFNKNHFTAYIENGRVLDTPEVPHKTGLRKIAEYMQKTGVGHFRLTGNQHLVISDIEDGHLDNIKALLAEHKLDNADYTGLRLSSSACVGLPTCGLAFAESERYLPDVITQLEDTLEEYGLRHDNIIMRMTGCPNGCSRPWLAELALVGKAPHVYNLYLGGGYYGQRLNKLYRANLNDTDIVDVIKPLIKRYALEKNEGERFGDFVLRVGIVKPTLEGRLFHEDIAEDAY

SEQ ID NO: 74595 - protein, 477 aa, Chromobacterium violaceum ATCC 12472
MSQQFDVVVIGGGPGGYVAAIRAAQLGFSAACVDAFKNPEGKPSLGGTCLNVGCIPSKALLQSSENFHAVQHDFAKHGISVSGAKMDVGQMLSRKTDIINKNAAGIGFLFKKNKVANIHGLAAFKGRQGEKWVIEVTDGGKVVDTLEAVHVIVATGSSPRALPGLATDNQLVLDNEGALALTAVPKRLGVIGAGVIGLEMGSVWKRLGAEVTILEAAPTFLAAADQQIAKEAFKTLTKDTGLDIKLGVKIGEVKAGKKSVSVSYELNGEAVKAEFDKLIVSIGRVPNTQGLGAETVGLALDERGFVAVDDHCHTNLPNVWAIGDVVRGPMLAHKASEEGVAVAERIAGQKPHVDFGVIPWVIYTSPEIAWVGKTEEQLKAEGVEYKKGTSGFGANGRALGLGQAQGTVKILADAKTDRILGLHMIGPMVSELVSEGVVSMEFKAASEDLARIVHAHPSLSEVIHEAALAADKRALHG

SEQ ID NO: 74596 - protein, 317 aa, Streptococcus pneumoniae TIGR4
MDREPVTVRSYANIAIIKYWGKKKEKEMVPATSSISLTLENMYTETTLSPLPANVTADEFYINGQLQNEVEHAKMSKIIDRYRPAGEGFVRIDTQNNMPTAAGLSSSSSGLSALVKACNAYFKLGLDRSQLAQEAKFASGSSSRSFYGPLGAWDKDSGEIYPVETDLKLAMIMLVLEDKKKPISSRDGMKLCVETSTTFDDWVRQSEKDYQDMLIYLKENDFAKIGELTEKNALAMHATTKTASPAFSYLTDASYEAMAFVRQLREKGEACYFTMDAGPNVKVFCQEKDLEHLSEIFGHRYRLIVSKTKDLSQDDCC

SEQ ID NO: 74597 - protein, 356 aa, Clostridium tetani E88
MNKLLMTPGPTNVPQRVLEKMSENMLHHRTSQYSKLFEEFNERLKYVFQTKNSVLTFPSSGTGGLESAIINPFSKGDKILAVSIGDFGNRFINIAKIHSLKVDEIVIPWGKAVTLEDIKKNLRPDHKGLIITHNETSTAVVNPIEEIGNFLKDKDVLYIVDAVSSLGGIDIKMDEWNIDILISASQKALMSPPGLAFVGVSEKALYRCTQSNISKYYFDYLLAKKYLDKVEPQNPYTPAISLILAANESLKIIEKEGLQNVFLRHQKLANKFRDGIKSMNLKLYAQNHCYSNTVTAISFEEEGLASRIKDKLDKEYNIIISGGQGFTRGKLIRVGHMGCVNDEMIDKTLYAIQKSL

SEQ ID NO: 74598 - protein, 309 aa, Nostoc punctiforme PCC 73102
MTNSKSVAILGAGAWGASLANLAAANGHQVRVWSRQGSQTLQTVLEDAQIILSAISMIGVRDVASQIQSFSLSPETIFVTATKGLDPQTTCTPSQIWQTVFANHAVVVLSGPNLSKEIQLELPAATVVASNIPTAAEVVQLVFSSHRFRVYTNPDPLGVELGGTLKNVIAIAAGVCDGLHLGTNAKAALVTRGLTEMVRIGNDWGAKTETFYGLSGLGDLLATCNSPLSRNYQVGYQLAGGKTLKETLANLQGTAEGVNTCQVLMQRAKQQNIPVPITEQVYRLLQGEVTPRQALDELMLRDIKPEYNY

SEQ ID NO: 74599 - protein, 390 aa, Helicobacter pylori 26695
MLYSSKIQSLSESATIAISTLAKELKSQGKDILSFSAGEPDFDTPQAIKDAAIKALNDGFTKYTPVAGIPELLKAIAFKLKKENNLDYEPNEILVSNGAKQSLFNAIQALIEEGDEVIIPVPFWVTYPELVKYSGGVSQFIQTDEKSHFKITPKQLKDALSPKTKMLILTTPSNPTGMLYSKAELEVLGEVLKDTKVWVLSDEIYEKLVYKGEFVSCAAVSEEMKKRTITISGLSKSVAMTGWRMGYAASKDKKLVKLMNNLQSQCTSNINSITQMASIVALEGLVDKEIETMRQAFERRCDLAHAKINAIGGLNALKPDGAFYLFIHIGSLCGGDSMRFCHELLEKEGVALVPGKAFGLEGYVRLSFACSEEQIEKGIERIARFVKSKG

SEQ ID NO: 74600 - protein, 451 aa, Vibrio campbellii AND4
MATHFDYICIGGGSGGIASANRAAMYGAKVALIEAQDLGGTCVNVGCVPKKVMWHGAQVAEAMNLYAEDYGFDVDVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVIGAGYIAVEIAGVLHALGTETHLFVRKESPLRSFDPMIIETLVEVMDAEGPTLHTHSVPKEVVKEADGSLTLHLENGESKNVDTLIWAIGRHPATDAINLASTGVATNDRGYIKVDEYQETNVKGIYCVGDIMEGGIELTPVAVKAGRQLSERLFNNKPNAKMDYDLVPTVVFSHPPIGTIGLTTQEAEEKYGKDNIKVYTSGFTAMYTAVTKHRQPCKMKLVCAGEEETVVGLHGIGFTVDEMIQGFGVAMKMGATKADFDSVVAIHPTGSEEFVTMR

SEQ ID NO: 74601 - protein, 424 aa, Bordetella pertussis Tohama I
MSNTTPAWMAQGYPHIWLPYAQMKTAAPPLPVVRSHGSLLELADGRTLIDGVAAWWTACHGYNHPHIAQAVREQLDRMPHVMFGGLAHEPALNLASRLSALLGPGLERVFYTDSGSVAVEVAMKMAVQFWLNQGERGRTRFVAFRGGYHGDTFGTMAVCDPDEGMHAMFRGLLPEHDVLALPRDEAALAALQAHLERHAGRIAGMLVEPLVQGAGGMLLHDPQVLARLRELADRYGILLIFDEIFTGFGRTGTMFAFEQAGVRPDIVTLSKALTGGTLPLAATVASARVFEGFWSDDPGHALMHGPTFMGCALACAAANASLDLFEREPRLRQVAALEQALRAGLEPCRDLPWVRDVRVLGAIGVIELDGIGARDDLRRRLVEAGVWVRPFGNIVYLTPAFTIAEDELQALLEAVRQVVAERRP

SEQ ID NO: 74602 - protein, 529 aa, Debaryomyces hansenii CBS767
LLPLVKINKLLSMFNNSTRQLFKQSSIRLQTINRHLSSSMAPLQAIRKYDYLVIGGGSGGVASARRAASYGAKVLLIELKFNKMGGTCVNVGCVPKKVMWYAGDLAEKRHHLKSYGLSTTDDKVKYGDFDWSTFKDKRDAYVKRLNGIYERNLKNEGVDYIYGFAHFANSNGDVEVTLTGDQELSFLEEGKEFKKDEKLVFAGSKTLIATGGYAINPPNVEGHELGTTSDGFFELQKQPKSVAVVGAGYIGVELSGIFKALGSETHLVIRGDTVLRSFDESIQNSITDYYTDKLGVNIIKQSGSVSKVEKIDGDRKKITLGNGQVLEVDELIWTMGRKSLINIGLDKVGVTLNDKQQVDVDQFQQTANPNIFSLGDVIGKVELTPVAIAAGRRLSNRLFSGDKAFENDHLDYSNVPSVIFSHPEAGSIGLSCKEAKEKYGEDQIKIYKSKFNAMYYAMMEDDSLKSPTSYKVVCAGEDEKVVGLHIVGDSSAEILQGFGVAIKMGATKKDFDSCVAIHPTSAEELVTMK

SEQ ID NO: 74603 - protein, 256 aa, Brucella melitensis 16M
MTKFWIGTSWKMNKTLAEARLFAEALKAADAGRSPDIQRFVIPPFTAVREVKEILSGTSVKVGAQNMHWADQGTWTGEISPLMLKDCNLDIVELGHSERREHFGETNETVGLKVEAAVRHGLIPLICIGETLEDCESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 74604 - protein, 125 aa, Glycine max
  misc_feature (60)..(60): Xaa can be any naturally occurring amino acid
  misc_feature (67)..(67): Xaa can be any naturally occurring amino acid
  misc_feature (105)..(105): Xaa can be any naturally occurring amino acid
GPYFNLCVPMGVLATGPAIGGGVLDQPGIENVTPGRESECDVPNSRSSAPTYRVILHNDXYNIRDYXLQVLMKVIPGMTLDNAVNLMQEAHYIGSSVVIMCDQCXAEDHCMHLRCIGLLMSIEPA

SEQ ID NO: 74605 - protein, 300 aa, Leptospira interrogans serovar Lai str. 56601
MKKLNFPFHYFSKTILFFFLLIHLESCASLFYQPTNQKYWKPDTFGFQYKEEIFKTFDGESIRYWRIFPKDSKPKGVVLQFHGNGENRTSHFMSLVWMVNYGYELVTLDYRGYLDSTGVPERETIHKDSVDFISRELEYSNKRNIPMIIYGQSLGGAIALRATSELKNKSGILLVVADGTFASYRKVFRQIVRKILFFPIDWIAGIFMSDSLSPHETISALSAIPLLVIHGTEDEIVPYQNGIELFGLAGEPKWFWEVRGGGHVNWMNLGASKDSKNFLSFLDNLIEKSKLNPDFFRQIF

SEQ ID NO: 74606 - protein, 246 aa, Lactarius semisanguifluus
DPRVKVLAVNDPFIDLQYMVYMFKYDSVHGRFKGTIEIKDGKLVIDGHPITVFQERDPANIQWGSVGADYVVESSGVFTTVDKASAHLKGGAKKVIISAPSADAPMFVVGVNLDAYDSKYTVISNASCTTNCLAPLAKVINDKFGIVEGLMSTIHATTATQKTVDGPSNKBWRGGRAVNGNIIPSSTGAAKAVGKVIPALNGKLTGLAFRVPTNDVSVVDLVVRLEKEATYDEIKHAVKEAADGPL

SEQ ID NO: 74607 - protein, 502 aa, Brucella melitensis 16M
MAEPETCDLFVIGGGINGAGVARDAAGRGLKVVLAEKDDLAQGTSSRSGKLVHGGLRYLEYYEFRLVREALIEREVLLNAAPHIIWPMRFVLPHSPQDRPAWLVRLGLFLYDHLGGRKKLPGTRTLDLKRDPEGTPILDQYTKGFEYSDCWVDDARLVALNAVGAAEKGATILTRTPVVSARRENGGWIVETRNSDTGETHTFRARCIVNCAGPWVTDVIHNVAASTSSRNVRLVKGSHIIVPKFWSGANAYLVQNHDKRVIFINPYEGDKALIGTTDIAYEGRAEDVAADEKEIDYLITAVNRYFKEKLRREDVLHSFSGVRPLFDDGKGNPSAVTRDYVFDLDETGGAPLLNVFGGKITTFRELAERGVHRLKHIFPQMGGDWTHDAPLPGGEIANADYETFANTLRDTYPWMPRTLVHHYGRLYGARTKDVVAGAQNLEGLGRHFGGDFHEAEVRYLVAREWAKTAEDILYRRTKHYLHLTEAERAAFVEWFDNANLVA

SEQ ID NO: 74608 - protein, 452 aa, Pseudomonas putida KT2440
MPQPLYEFTDSPLLQRQQQQESNARSYPRRIPLALRRARGIHVEDVEGRQFIDCLAGAGTLALGHNHPVVVEAIQRVLADELPLHTLDLTTPVKDRFVQDLFGILPEALRREAKVQFCGPTGTDAVEAALKLVRTATGRSTVLAFQGAYHGMSQGALNLMGSHGPKQPLGALLGNGVQFMPYPYDYRCPFGLGGEAGVKANLHYLENLLLDPESGVPLPAAVILEVVQGEGGVVPADIEWLKGVRRITEQAGVALIVDEIQSGFARTGRMFAFEHAGIVPDVVTLSKAIGGSLPLAVVVYRDWLDTWKPGAHAGTFRGNQMAMAAGSAVINYLVEHRLAEHAEAMGQRLRGHLQRLQRDYPQLGDIRGRGLMLGVELVDPQGQPDALGHPPANRDLAPKVQRECLKRGLILELGGRHGAVVRFLPPLIISAEQIDEVAQRFSAAVAAAVGSV

SEQ ID NO: 74609 - protein, 510 aa, Phormidium laminosum
MTSTVPAETSLNKFEKLKSEKDGLAVKSELEDFARLGWEAMDETDRDHRLRWMGVFFRPVSQGKFMLRMRIPNGILTSGQIRVLAEVVERYGEDGNADITTRPNLQLRGIRLEDIPDIFRRFEQAGLTSIQSGMDNVRNITGSPVAGIDADELIDTRGLVRKVQDMITNNGEGNPSFSNLPRKFNIAIAGCRDNSVHAEINDIAFVPAYKDGKLGFNVLVGGFFSAKRCEAAVPLNAWVDPRDVVALCEAILIVYRITGCGANRQKSRLMWLIDEWGMDKFRAEVEQQLGHPLQTAAPKDEILWDKRDHIGIHAQKKPGLNYVGLLVPVGRLYAPMFDLARIAEVYGDGEMRLTVERKRDHSRTCPMSSVASLLKEPLLEKFSVSPGLLVRSLVSCTGAQFCNFALIETKNRAMALIRELESELELARPVRIHWTGCPNSCGQPQVADIGLMGTKVRKDGKATEGVDLYMGGKVGKHAELGTCVQKGIPCDDLKPILRNLLIEHFGARPK

SEQ ID NO: 74610 - protein, 750 aa, Leptospira interrogans serovar Lai str. 56601
MTKQEFVPTMPPNMKKISLFYIFLIFLFILSLGFILQSGKNLELEKENFHSSQVLLSKKYLDNTPNESSKINFPRPGFLDLEAIVKIFSGHLKQPISRLLLQLIVIILAARFCGKLATILGQPSVIGEILAGILLGPSLLGLIFPEGFQLLFPKESLSTLQILSQLGLLLFMFVVGMELDLKILRNQAESAIVISHSSIMFPFLLGAGLAYLIYVPLAPEGVDFIAFCLFMGIGMSITAFPVLARIILEKGLTKTTLGSLALTAAAADDVTAWCVLAIVVTIVNAGSFSSGILMIVMSLTYMFVMWKGILPLMKRAGNLYTTKESMTKSITAFFFLFIFISAWITEAIGIHALFGAFLAGVVMPDKKELRNNLVEKIEDFSLTVLLPLFFAFTGLRTKFGLLSSSGLWPVFFLILFVAVLGKLGGSAIASRLSGKSWMDSFSIGILMNTRGLMELIVLNIGYDLGVLSEEIFSMMVLMALTTTVMTGPGLKLIELFFTKRDTIVKPTLNSGILISFAQHTRGLELLKIAYGLFPEKKKERNVTAVHLSPDSNISESHAEKYESLSFTPLKELSKDLNVNLSTIYKTSTNITKDIVRIVNEGNYKLLLIGAARSFFSDDILGGKIRTILNETNCNTGILFSSQLQDIKNIHILFGREKDLELLQIAKRLAANYNSRLSIVDLNGSTNQPQIKQSLKKEKVKILTPVDWKQFDLILCDLDIWENHSEFRVDELPQGGGLLLIRSTDGFIIEA

SEQ ID NO: 74611 - protein, 359 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLFEELKLACKNIYAEDLFIRMERHILDTLDWDISIPTPASYIPVLDPIFFLVLDASMFVPNLFKFPASKIACSVMNIVNEHVGSFLLTHPSMESYRKDDNFLWPEDLDTVTSYMENMSKRYANEECTDLLFSSLGRISSILAKKYPEQCAMAAWCNMTEKDTERTL

SEQ ID NO: 74612 - protein, 378 aa, Solanum tuberosum subsp. andigena
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 74613 - protein, 390 aa, Chromobacterium violaceum ATCC 12472
MNLHEYQAKELLSRYGLPVQQGILAKSPEEAAAAYDKLGGKFAVVKAQVHAGGRGKAGGVKVVKSREEAAEVAKTLIGTNLVTYQTDAAGQPVNSVLVCEDMYPVQRELYLGAVVDRGSQRVVFMVSTEGGVEIEKVAEETPEKIIKIEVDPLVGMQPFQARDAAFALGLSGAQVAAFSKLMLGSYQAFIENDFALFEVNPLALRENGELACVDGKINLDSNALYRHPELLAQRDKSQENEREVKASEFDLNYVALEGNIGCMVNGAGLAMATMDIIKLKGGQPANFLDVGGGATKERVIEAFKLILADTSVQGVLINIFGGIVRCDMIAEAIIAAVKEVNVTVPVVVRLEGNNAELGAKILDESGLKLTSAQGLNDAAEKIVAAVKAVA

SEQ ID NO: 74614 - protein, 263 aa, Acidovorax sp. JS42
MSQTLTTSTISFGHHGRVCIVTGGAQGIGEACVRRLARDGAKVVIADMDDARGRALADAVPQAAYIHCDVGNKSEVDALVGQTMALHGRIDVLVNNAGIFRAADFLDVTEEDFDAVLRVNLKGAFLMGQAVAREMVRSGGGSIVNMSSVNGVLAIPNIASYNVSKGGINQLTRVMALALADRGIRVNAVAPGTIATELAAKAVLTSDEARLKILSRTPMKRLGEPSEVADVVAWLASDAASYVTGEIVTVDGGRMTLNYTVPV

SEQ ID NO: 74615 - protein, 375 aa, Solanum tuberosum subsp. andigena
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 74616 - protein, 346 aa, Glycine max
MEQRLANTWRMPLNDNKFIETALLSDLRVDGRRPSDYRKLTIKLAKQDGSAEVHLGQTHVITFVTAQLVRPYRDRPNEGSLSIFTEFSPMADPSFEPGRPTDAAVELGRVVDRGLRESRAIDTESLCVLSGKLVWAIRVDIHILDNAGNLVDAANIAALVSLLTFRRPECSLTGENGRDVVVHPPEERDPIPLIIHHLPIAVTFGFFSNENLLVIDPTHHEECVMTGRMTPTLNSNGDVCAIQKPGGESVSQSVIMHCLKLAHVKATDITTKIKDAVEIHNNERMLRKIKRHSSSAAVDVCGATAGFGGKQNPLDGDDLECRATPSGQQHSKDGASKNFTGGPSSW

SEQ ID NO: 74617 - protein, 453 aa, Dechloromonas aromatica RCB
MNSKEDLARLQQELEAKGVKYCIGAYVDIHGVPKAKVVPIHHLLHMAKGSERYTGYALDGLGQAPNDDELTSIPDFSRLIQLPWEPKIAWIPSDNHFQGKPYPLNTRVALQNQLAEAAKLGFGMNLGIECEIFLLRQNADGSLSVPDPEDKLAKACYDVRGFTNNFSWLDKVATAINDLGWDLYSFDHEDANGQFEFDFQYADALTTCDRLTFFRYMAKHYAREEGLLATMMPKPFADKTGNGAHFNMSLYDLQDGRNLFACDPKDDPNGIGLTKLGYHFVAGILKHGRALCAVFAPTVNSYKRLVRRGAMNYFSWAPVFNSYGSNNRTNSVRIPSGGGRCESRNADGAVNPYLVATLVLAAGLEGIREGLDPGKPNEDNLYAISEAERHARGIEFLPQTLQEAVAAFAADPLVEQTLGKELRDEFIRYKSEEWEAYHLTVSQWEIDRYSYMF

SEQ ID NO: 74618 - protein, 552 aa, Enterobacter cloacae
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQAHADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELCKQHVHAGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEACNNA

SEQ ID NO: 74619 - protein, 308 aa, Rhizobium leguminosarum bv. viciae 3841
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPDLGDDCEALHFGAISLIPSPCGETYEALLDREAARRVISLDPNIRPGFIKDKPSHMARIKRMAAKADIVKFSDEDLEWFGLQGDHDALAAHWLNHGAKLVVITKGAEGASGYTKERKVTVPSERVTVVDTVGAGDTFDAGILASLKMDNLLTKAQVASLDEKALRNALTLGAKAAAVTVSRAGANPPWAREIGL

SEQ ID NO: 74620 - protein, 464 aa, Francisella tularensis subsp. tularensis SCHU S4
MIDFQYTYSQLSEQFYSRQAVYKYPNAKLLILNDCLVTELGLDLANKSEQQLLEFLLGYSSKKPISQAYAGHQFGNFTMLGDGRAILIGEYKKPNGELVDFHLKGAGLTKFSRGGDGKAALAPMLREYIVSEAMYNLGIPTSRILAVITTGENIQRNQLKQDAIAVRVASSHIRVGTFQYAAMLGESYSQELLDYTITRHNIPHNDNKALSLLDYVIAKQTSLITEWERVGFIHSVMNTDNMTISGETIDYGPCAFMDSYDPDTVFSSIDRHGRYAFANQASIAGWNIARLAESLLKLISADEEEAIKLAQDKLQSYSETYKNKWQKMFLAKLGLSINKAHNDEMISDLLIEMFKFKLDYTNTFYNLTYKNFGALKDCGLGEWLEKYITKNEINFANMKKINPVIIPRNHQVEKALKSAEDTKFGNLYNLVAALKTPYEFNILTEKYITEPVEEEKVRFTFCGT

SEQ ID NO: 74621 - protein, 560 aa, Rhizobium leguminosarum bv. viciae 3841
MRVRKRIVSATFPPPKEPPMNAIVEQLKSTADATKATDIRAAFAADSQRFSRFSVSLDDLLMDFSKTAVNDDILKLLVKLAEEGGVEKKREEMFSGKAINFTEDRAVLHTALRNRSNAPVLVDGKDVMPDVNAVLAAMGKFADDVRSGTLKGATGKAITDVVNIGIGGSDLGPVMATLALAPFHDGPRAHFVSNIDGAHIADILKLVQPETTLFIVASKTFTTVETMTNAQTARNFIAKALGEAAVQHHFAAVSTALDKVAAFGIDSARVFGFWDWVGGRYSIWSAIGLPLMIAVGPENFGKFLDGAHAVDNHFRKAPITENLPILLGLIGFYHRNVLGYPTRAILPYDQRLSRFPAYLQQLDMESNGKGVTIDGTPVEGNSGPVVWGEPGTNGQHAFYQLIHQGTSIIPAEFMIAANAFEPELRHQHQLLISNVLAQSEALMKGRTFAEAKKQLTDKGMDDKKADFIAPHRVFTGNRPSITFVYDKLTPYALGRLIALYEHRVFVEGVLFRINSFDQWGVELGKELATGLLPVVEGKESAASHDSSTQGLVAALAKLAK

SEQ ID NO: 74622 - protein, 381 aa, Bacillus cereus E33L
MERIYLDHAATSPTHPEVVEKMIPYMTEIFGNPSSIHFYGRQTRHAVDEARRACARSIHANPNEIIFTSGGTEADNLALIGVARANRHKGNHIITTQIEHHAILHTCELLEREGFEVTYLPVDETGRVQVSDIQKALTEETILVSVMFGNNEVGAMQPIAEIGKLLKEHQAYFHTDAVQAYGLVEINVKEFGIDLLSISAHKINGPKGVGFLYAGANVKFEPLLIGGEQERKRRAGTENVPSIVGLQHAILLAEKTREQKNAQYEEFKDIMVSVFQNEDITFEVNGNLEYRLPHVLNISFTGMNIEPFLVNLDLAGIAVSSGSACTAGSIDPSHVLVAMFGKDSDQIRSSVRFSFGLGNTKEQIEKAAYETVKIVKRLTQN

SEQ ID NO: 74623 - protein, 255 aa, Zea mays
  misc_feature (62)..(62): Xaa can be any naturally occurring amino acid
  misc_feature (248)..(248): Xaa can be any naturally occurring amino acid
MAAVPASAPAAAEAAELVPTLSSLEPVYGAGAQLDESRLRFARLGDRFHAVYGARPALFARXPRGRVSLIGEHIDYEGYSVLPMAIRQDMIVAIRRANGAQVRVANVDDKYPLCVYPADPDKEIDVKNHKWGHYFMCGYRGVYEYCRSKGIDLGKPVALDVVVDGTVPQGSGLSSSAAFVCSATIAIMGILDKNFPKKEVAQFTCLSERHIGTQSGGMDQAISIMAKPGFAELIDFNPIHATDVQLPXGGTFVIA

SEQ ID NO: 74624 - protein, 219 aa, Clostridium perfringens str. 13
MDIKENLTKFTEKIPSNVQLIAVSKTRTIEEMEEAYEFGIRKFGENKVQEIIRKFDEFHQDVEWHLIGHLQTNKVKYIVDKVHLIQSLDSIKLLKEIEKVYGKHNKIANTLIQVNIGREEQKYGILEEELDELIEAIEACNNVNVLGIMTIIPKGTEEECRKYFSKTHKLFCELKEKKFKNIKMDILSMGMSGDYEIATEEGSNMVRIGQGIFGKRLYK

SEQ ID NO: 74625 - protein, 496 aa, Escherichia coli CFT073
MITTFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMLTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 74626 - protein, 339 aa, Pseudomonas viridiflava
MSTANQNPAAAPAVKKKLTTSAMIASIASEGQATRSAPFGHALAALADQRSDIVGLSADLSKYTDLHIFAKAHPERFYQMGMAEQLLMSAAAGMAREGCVPFATTYAVFASRRAYDFICMAIAEENLNVKIVCGLPGLTTGYGPSHQATDDLAIFRAMPNLMIVDPCDALEIEQAVPAIAAHQGPVYMRLLRGNVPLVLDEYGYQFEIGKAKTLRTGNDVLIISTGLMTMRSLEAAKELQADGVDVAVLHVPTIKPLDEQTILAEARKPGRLVVTAENHSIIGGLGEAVATVLLRNGVTPTFRQIALPDAFLDAGALPTLHDRYGISTPAVCAQIKAWL

SEQ ID NO: 74627 - protein, 396 aa, Moritella sp. PE36
MFEKIVTAAADPILGLTEEFAKDPRAEKINLGVGIYKDETGQTPILKSVKLAEQKLINEEKSKSYLSIEGHKSYASAVQKLLFGADSEVVTQQRAITAQAPGGTGALRTAADFIKSHLTSDRIWVSNPTWANHGNVFNTAGLEVKQYAYYNAETRDLDFNAMLASLAEAEAGDVVLFHGCCHNPTGIDPTLEQWTTLAQLCANKKLLPLFDFAYQGFATGVEEDAAGLRVFTEHCEELLVANSFSKNFGLYNERVGGLTLVAKDKDVAAAAFSQIKSGIRANYSNPPAHGAAVVAIILDDEVLRKQWIAEVAEMRVRIHEMRELFVATLAEMGVTGDYSFITRQNGMFSFSGLTKEQVATLKDEHAVYIVGSGRISVAGMTKNNMQPLCKALAAVL

SEQ ID NO: 74628 - protein, 124 aa, Brassica napus
MDPRVPATSVFRWSRSRRKIHIRRRKTQVVRLGGKNNVVSRGGFSLKKMVRRMKLKWLRLHYVRLVKKMKGFYCNLVKEFVDAGVELEAIQTQMAVEAAAFAVPGLGLSFSSLSAHDRARYFLV

SEQ ID NO: 74629 - protein, 246 aa, Lactarius subpurpureus
DPRVKVLAVNDPFIDLQYMVYMFKYDSVHGRFKGTVETRDGKLIIDGHSITVFQERDPANIQWGSVGADYVVESSGVFTTIDKASAHLKGGAKKVIISAPSADAPMFVVGVNLDAYDPKYTVISNASCTTNCLAPLAKVINDKFGIVEGLMSTIHATTATQKTVDGPSNKDWRGGRAVNGNIIPSSTGAAKAVGKVIPALNGKLTGLAFRVPTNDVSVVDLVVRLEKAATYDEIKHAVKEAADGPL

SEQ ID NO: 74630 - protein, 532 aa, Vitis vinifera
MAVASGSAASFAAFKSGLRCNASVSYPPGRISVRPGKTAGLGAVRCSVGSDDLAKAELRASSVSALELLKTSAADRYTKERSSIIVIGLNFHTAPVEVREKLAIPEANWPQAIVELCALNHIEEAAVLSTCNRMEIYVVALSQHRGVKEVTEWMSKTSGVSVSEICQHRFTLYNEDATRHLFEVSSGLDSLVLGEGQILAQVRQVVKTGQGVPGFDRKISGLFKHAITVGKRVRTETNISAGSVSVSSAAVELALLKLAESSYATVRPLVIGAGKMGKLVIKHLVAKGSTKIVVVNRSEERVAAIRKELKDVEIIYKPLSEMLACTAEADVVFTSTASENSLFLKEHVEALPPVSQEIGGLRLFIDISVPRNVGPCVSDLETVRVYNVDDLKEVVAANKEDRLRKAMEAQGIIAEELKQFKSWKDSLETVPTIKKLRAYAERIRASELDKCLSKMGDGISKKQKAALYDLSMGIVNKLLHGPIQHLRCNENENRTLNETLENMHALNRIFDLETDTSLLEEKIRAKVKQSQP

SEQ ID NO: 74631 - protein, 204 aa, Chromobacterium violaceum ATCC 12472
MSTPFIIGVAGGSGSGKTTVTNKVLETIGSEMAAVIIQDYYYRDQSHLTFEQRLGTNYDHPQAFDWPLLISHIDDLRNGRAIEMPVYDFANHTRSDQTVTVQPAPVIVIEGLFPLYDAALREMMSLKIFVDTDSDVRFIRRLKRDIAERGRTMESVIEQYLSTVRPMHNQFIEPTKRFADVILPHGANDPAVDIITTKVASLMV

SEQ ID NO: 74632 - protein, 337 aa, Phaeosphaeria avenaria f. sp. triticae
MVVKVGINGFGRIGRIVFRNAIEHNDVEIVAVNDPFIEPHYAAYMLKYDSQHGQFKGDIKVDGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAIKAAADGPLNGILGYTEDEIVSTDLNGDTRSSIFDAKAGISLNKNFVKLVSWYDNEWGYSRRVLDLLVYIAKVDGNA

SEQ ID NO: 74633 - protein, 167 aa, Nakaseomyces delphensis
MAEIPENANITILNRNEKKAREMISKLGLKKVPGIIRVTFRKKDNQIYAIEKPEVFRSVGGNYVVFGEAKVDNFTERLAAAQQQTAQQQATKTPEDIQADLQAAADANESGKPADASADDENVDAGDLNEDDIELVVQQTNASKNEAIKALKEHKGDIVNAIMSLSK

SEQ ID NO: 74634 - protein, 430 aa, Salmonella typhimurium
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRHQLEHILNEEHIAHEPRALQLLSRAADGSLRDALSLTDQASSSGDGQVSTQAVSAMLGTLDDDQALSLVEAVVDANGERVMSLINEAAARGIEWEALLVEMLSLLHRIAMVQLSPAALGSDMAAIEQRMRELCRTVPPGDLQLYHQTLLIGRKEFPWAPDRRMGVEMTLLRALAFHPRMPLPEPETPRQSFAPVAPTAVMTPPQLQQPSAPAPQTSPAPLPASTSQVLAARNQLQRAQGVTKTKKE

SEQ ID NO: 74635 - protein, 642 aa, Salmonella typhimurium
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRHQLEHILNEEHIAHEPRALQLLSRAADGSLRDALSLTDQASSSGDGQVSTQAVSAMLGTLDDDQALSLVEAVVDANGERVMSLINEAAARGIEWEALLVEMLSLLHRIAMVQLSPAALGSDMAAIEQRMRELCRTVPPGDLQLYHQTLLIGRKEFPWAPDRRMGVEMTLLRALAFHPRMPLPEPETPRQSFAPVAPTAVMTPPQLQQPSAPAPQTSPAPLPASTSQVLAARNQLQRAQGVTKTKKSEPAAASRARPVNNSALERLASVSERVQARPAPSALETAPVKKEAYRWKATTPVVQTKEVVATPKALKKALEHEKTPELAAKLAAEAIERDPWAAQVSQLSLPKLVEQVALNAWKEQNGNAVCLHLRSTQRHLNSSGAQQKLAQALSDLTGTTVELTIVEDDNPAVRTPLEWRQAIYEEKLAQARESIIADNNIQTLRRFFDAELDEESIRPI

SEQ ID NO: 74636 - protein, 417 aa, Rhizobium leguminosarum bv. viciae 3841
MATSATTRPPAGNGMKMTATAPWTIEKPTALLVLADGTVIEGKGIGATGKVPAEVVFNTALTGYEEILTDPSYLGQIVTFTFPHIGNIGTNDEDIEDLTPAARHGAVGVIFKADITEPSNYRAAKHLDQWLKARGVIGLCGIDTRALTAWIRENGAPNAVIAHDPNGVFDIETLKAEAKAWSGLEGLDLAKIASSGQSSQWTETPWVWNEGYGELKATDAKYHVVCLDYGVKRNILRLFAGLDCKVTVVPAATSAEDVLAMQPDGIFLSNGPGDPAATGDYAVPVIKTLIKTDIPVFGICLGHQMLGLALGAKTEKMHQGHHGANHPVKDHTTGKVEIVSMNHGFAVDSKSLPDGVEETHISLFDGTNCGLRVLGKQVFSVQHHPEASPGPQDSHYLFRRFINMVREKKGEPALAER

SEQ ID NO: 74637 - protein, 351 aa, Acidovorax sp. JS42
MPSSIAHSPWRMSVAPMMDWTDRHCRYLHRLLSRHTLLYTEMVTTGALAHGDVQRHLRFDAAEHPVALQLGGSEPTDLAHCARLGEQWGYDEINLNCGCPSERVQRGAFGACLMNEPQLVADCVKAMVDVVQVPVTVKHRIGIDQNEDYGFVRDFVGVVADAGCRVFIVHARNAWLKGLSPKENREIPPLRYDVAARLKADFPQLTIAINGGFQTDAAVLQELARVDGVMVGREAYHNPWWLARWDEQFFGAAPAALTREQVEEDMVAYMEREATAHGTHWYAVARHMLGLRNGLPGARRWRQVWSDHRLKHLPAREVMALARTKPGATAPDALRASAVQAGALPTEPLSL

SEQ ID NO: 74638 - protein, 443 aa, Nakaseomyces delphensis
MSKALELLVHPLELKAALKLKFIRQPLFTTNDTTATAGLIRCYELLTLTSRSFAAVIMELHPELRNVIMVFYLVLRALDTVEDDMTIQPQLKVKTLREFDSKLDTDDWSFDGNDLKEKDRVVLTEFPVILAEYHKLKPEYQRVIKRITGLMGNGMADYILDDNFNLNGVQTIKDYDIYCHYVAGLVGDGLTELIVLAGFGSDDLYNGKNSFQLYESMGLFLQKTNIIRDYAEDLNDGRSFWPKEVWSLYADKLTDFKDPKNTQNGVNCINHLVLNALTHVIDVLTFLSSVHEQSTFQFCAIPQVMAVATLAKVFNNPDVLKKNVKIRKGTTCYLILNSRTLKGTIEIFQYYLRDMKQRLPVQDPNYLKFNIQVARIEQFIEEMYQDNLPKGVKPRETLAYLKTVERSKWDEQVVPRAQEEEYKFNMALSVVLSLLLSFYFFTH

SEQ ID NO: 74639 - protein, 481 aa, Sulfitobacter sp. EE-36
MKRTRNVKVVATLGPASDTHETISALFHAGADVFRLNMSHGSHDEIRIKHQIIRQIEEETGSTIGILADLQGPKLRVGVFSGDSELLVEGASFRLDLDEAEGNARRVCLPHPEIFQALEPGASLLVNDGKIRLKVKECGPDFAECEVMIGGVISNRKGVNVPDVVLPLAALSEKDRADLEFVCELGVDWLALSFVQRPEDVTEARDLAKGRAALLSKIEKPSAVDRFEDILAVSDGIMVARGDLGVELPVQNVPPIQKRLVRKCRAAAKPVIVATQMLESMIESPIPTRAEVSDVATAIYEGADAVMLSAESAAGAYPVEAVRTMDNVATEVEQDPTYTQIIESSRKVDRMTVADGIVAAAREIAETANIKAICCFTQSGTTALLTARERPRVPIIALSPLVKTARRLALTWGVNCVQTGTLERFKMAVVSAARVARDEGYAGPEDMIVVTAGVPFNVEGSTNILRVAPCDERLIFNTDPE

SEQ ID NO: 74640 - protein, 223 aa, Triticum aestivum
  misc_feature (83)..(84): Xaa can be any naturally occurring amino acid
  misc_feature (128)..(128): Xaa can be any naturally occurring amino acid
  misc_feature (135)..(135): Xaa can be any naturally occurring amino acid
  misc_feature (141)..(142): Xaa can be any naturally occurring amino acid
  misc_feature (147)..(148): Xaa can be any naturally occurring amino acid
  misc_feature (159)..(159): Xaa can be any naturally occurring amino acid
  misc_feature (163)..(163): Xaa can be any naturally occurring amino acid
  misc_feature (184)..(184): Xaa can be any naturally occurring amino acid
  misc_feature (200)..(200): Xaa can be any naturally occurring amino acid
  misc_feature (205)..(205): Xaa can be any naturally occurring amino acid
MVGGGRRGGAADEAKLNTGNVFAALETLKKKKKGDKAKGGSSKGGKQGDEPTPQQQKELFWAPAPLNTKSWADVEDDDDDDYXXTTAPPAPIWGNDHAAAKTAKEEEEDEVDAVHPALPEEIESEDEXIDDEAEXGAEDEXXARKWXXADPDVKKGAAXPKEXERQLSKKELKKKELAELDAVXAELGISENTSDAAQDXNNNAXKKGASQAGDGEERCEPSW

SEQ ID NO: 74641 - protein, 127 aa, Chromobacterium violaceum ATCC 12472
MAYSEKVLDHYENPRNVGSFDKGDDSIGTGMVGAPACGDVMKLQIKVGADGVIEDAKFKTYGCGSAIASSSLVTEWVKGKSLDEALAIKNTAIAEELALPPVKIHCSILAEDAIKAAVEDYKQKHGK

SEQ ID NO: 74642 - protein, 652 aa, Phytophthora parasitica
MMLNSCIAKLIAQSETLSRLGDSTGWDAVTEPAKIVPMFGDEGRRASVLVTRERDRNGSGISYTSSECSNNHAEPDIPAEEIRAARQDLLIDDEEEAKPAVHDVQATARVTPVSVSEELLSPTVAGYCCSPEFPSNESSNSQELDTDNNATDEKESNNQEDNQGDDDSEEDSIAGDLATQSSVAPYKSAVLAGRGTSTYHSMGMEGGVSTYQRMGLEDEYTKASSRSAVAAVNGPRPLPRAAFGATSSSSGLFPMMRPQTHSFNANGQVFTLDTRYQLVKPIGNGAYGAVIAVKDVVNGGDNLAVKKITNIFEDLVDAKRILREVRLLGHFNHKNITRLHDLSPPPSRKQFDDMYIITELMETDLHQVIYSMQPMSDDHVKYFLYQMLCALHHIHSAGVLHRDMKPSNILLNANCDLKVCDFGLARGGVGSSSSLQQELPQLGELTEYVVTRWYRAPEIMLNCLHYTTAIDVWAVGCIFAEMLLREPLFPGNDYLHQLKLIIKFLGTPKQEDIGFVKNTKALRFLTKLAISKPKKWRDVFATSGAENVVSAEAIDLLSKMLLFNPDKRISVDAALRHPYLATFFDENDLILSKPFDFSFDLPDDQLSKDALINLLCEDIEHFHPPVPLSVTPMPLSTAASRFFRMGMTASAS

SEQ ID NO: 74643 - protein, 405 aa, Chromobacterium violaceum ATCC 12472
MSQPKLPIYLDYSATTPVDPRVAEKMIPYLTGKFGNPASRSHSFGWEAEEAVENARAEVAKLIGADPKEIVWTSGATESDNLAIKGAAQFYKSKGKHIITVKTEHKAVLDTCRELERQGFEVTYMDVLENGLLDIEAFKAAIRPDTILVSVMYVNNEIGVIQDIPLIGEICREKGIIFHVDATQAPGKVKIDLNTLKVDLMSLSAHKAYGPKGIGALYVRRKPRVRLEAQMHGGGHERGFRSGTLATHQIVGMGEAFRIAREEMDSECERIRMLRDRLWHGIQDMEEVYINGDADQRVPHNLNVSFNFVEGESLIMAIKDLAVSSGSACTSASLEPSYVLRALGRNDEMAHSSIRFTLGRFTTEEEIDYAIALLKSKIGKLRELSPLWEMYKDGVDLNSVQWAAH

SEQ ID NO: 74644 - protein, 400 aa, Chlamydomonas reinhardtii
MRPKQQAQVTAAEDTASEPEPEPKPVDRKSRLRSFRVRTISSVLLIGGFIGIIWAGHVPLMFFILLLQFLVARELFRIAYIAEKSKRSLPLLRTQQWYFFFTAVFWLYLRFIKNNLLVEVTSDMTLARLFVWAVKHHSLISYSLYMAGFVGFVLSLKKGLYLHQFAHYAWTHMIILITTVPTSFFVSNVFSGILWYVLPAFLIVANDICAYLAGFFFGRTPLIKLSPKKTWEGFVGGFLGTLVIAFYLSAYMSKYKWMTCPRKDLTVFKGLDCTPDDVFIPATYTLADAAAADFTFTVAPIQLHALSLAAFASIAAPFGGFFASGFKRAFHMKDFGDTIPGHGGVTDRFDCQIVMAVFAYTYYWSYISKPEVTLGDVLNSATKLNDHDQILLVGKMANLL

SEQ ID NO: 74645 - protein, 355 aa, Nakaseomyces delphensis
MAFVDWRVRNRYWTAYIVPLIVLGIIGYGTWAYAHKLCYNQIYRELGHRSTCIGLICICCILDVLLIIIWCETVMVGPGKLPRVPPYMIIEAGSTQDTTIAPQTYVSDPNGYPVWCSSCRSLKVGRTRHSSRNGYCVPRFDHYCLWIGGAVGYSNYRLFLLFTFYFAVLLTIVWITICCYIREIVTVHHRRLNGNLVALLVITGIGWILTWGLFVSYVYYMSQNMTSIEVMEYKKRKKTPELAMQRFVCHYDPETELRYVVKIGNEYKQGSLYKKRGVFANIAEFMGGNWPLWLVPLPRTTSYGKKEGRGRLEATLTSPYSETFGPYALEYIQMKIASGDYIHAFSPAKEEEIDI

SEQ ID NO: 74646 - protein, 365 aa, Phytophthora parasitica
MGEEVEKHVLRKYELLQKLGKGAYGIVWKAIDKNNRQVVALKKCFDAFRNATDAQRTFREVMYLQELNGHSNIIRLLNVVKADNDRDIYLVFDFMETDLHAVIRANILEEIHKKYIIYQLLKSLKYMHTAELLHRDIKPSNLLLNSDCHTKLCDFGLCRSVAEISGPNPILTDYVATRWYRAPEILLGSTKYAKSVDMWAVGCIVAEMATGRPAFPGTSTMNQLERILDVTGPPSQEDIESIKSPFANTMLESLPAPKKKPLEELFPKASPEALDLIKQCFWFDPSKRISVIDALKHPYVAQFHNEKDEPSAPAPLQIVVNDNTKYSAADYRDRLYREIIKKKKEVRRKAGEQDGATAAAATTAQ

SEQ ID NO: 74647 - protein, 458 aa, Chlamydomonas reinhardtii
MRPKQQAQVTAAEDTASEPEPEPKPVDRKSRLRSFRVRTISSVLLIGGFIGIIWAGHVPLMFFILLLQFLVARELFRIAYIAEKSKRSLPLLRTQQWYFFFTAVFWLYLRFIKNNLLVEVTSDMTLARLFVWAVKHHSLISYSLYMAGFVGFVLSLKKGLYLHQFAHYAWTHMIILITTVPTSFFVSNVFSGILWYVLPAFLIVANDICAYLAGFFFGRTPLIKLSPKKTWEGFVGGFLGTLVIAFYLSAYMSKYKWMTCPRKVRDLTVFKGLDCTPDDVFIPATYTLADVNDLLPPAAAEYLRLAADRLPVPPALKAAAADFTFTVAPIQLHALSLAAFASIAAPFGGFFASGFKRAFHMKDFGDTIPGHGGVTDRFDCQIVMAVFAYTYYWSYISKPEVTLGDVLNSATKLNDHDQILLVGKMANLLAAEGLIPGSIVDALRKHLGNRFTWEVPDS

SEQ ID NO: 74648 - protein, 82 aa, Physcomitrella patens subsp. patens
SSSGAPPKGTGGSGLRRRRTTSTGSGGGSGSYRSGNSNMLRFYTDDAPGLKITPTVVLVMSLCFIGFVTCLHVIGKLYNYRS

SEQ ID NO: 74649 - protein, 506 aa, Phytophthora parasitica
MGEDDDVNMSEEGERSGCSTPIQGGRTPRHRKSFDRLQELHKETGQNRRVSERYSLAASDVPGGFELVEADGVDQQDKTSASEEEEMYTFTVASTKFRVYRRYQLIRAIGHGAYGVVIAASDQVTGNSVAIKNIPRTFDDLVDAKRIVREIRLMRHLRHPHVVSVLDVMRPPLLATFEDTYIVTDLMETDLHRVINSPEPLSSDHIAFITYQLLCGLRYVHSAHIIHRDVKPSNVLINRDCLVKLCDFGLARGIDIRPVTPSSVDGNTTPSSQDGEPALDEALTEYVVTRWYRAPELLLASRYSTAIDLWAVGCILAEMFTRKALFPGHDHVHQLHLILQLVGSPPPDDMGFVTNMKAKRWMARQQQHEAKPLNSVCPNAPTEALDLMTKLLQFDPRKRISVDEAIAHPFLAPCRADGVEMDSERLADSAFDFSFERENKGNLDKNTLRRLIFEDVCHFHPEATAELEQFKQEQERLKRLEEEKWRKEEAQAKAKARTGKSWAVSV

SEQ ID NO: 74650 - protein, 312 aa, Glycine max
MGTWVLQQVTSIDWNWNHESYPDFRDFSVIPFFALFFPSLRFLLDTFLFEQVARRLIFGKGHKKMDFQTLERKKKISKFKESAWKCVYFLSAEIFALAVTYDEPWFTDTRYFWVGPGNQIWPDQKIKLKLKVLYMYAAGFYTYSILALVFWETKRSDFVVSMGHHVITVILIVLSYIFRFVRVGSVVLALHDASDVFIETGKMSKYSGAETTASIAFILFVLCFTVTRIIYYPFWILRSTSYEVVHALKMDLVDGPLYYYVFNSLLYFLQVLHIYWWVLMLRMLVKQIQEKGKVSEDIRSDSEDEDEHKHEE

SEQ ID NO: 74651 - protein, 683 aa, Phytophthora parasitica
MPNLSRKFSFMTSVASSAASAASSAVGVGTSSNNSTPVVDPFSTGTPRNAGDESYLPTHPVWNRVLELPFSHVIGTCSLVVDVKDHSKNGVESQLGFATLNVAKYLMAADGTERTKKREEAAMAADSKWYSISNAKGEYCGKVQLGITCQRKKIMEEGDGVQPRLKKSQSVVIDRKNPPSSNMLQWDATPAHSQALLGAATPALKKGMTLDEFQMGGSEHARRHGWANVKLSPEDTARTQSAGAIVSSKEDDDESVHKRFPEGSAALPAATDAVICKENADMHTFMVCGAPFTIPRHYQLIKVCGRGAYGIVIAATNLRTGGNVAIKKVIDCIWHPHQLKQILRECRLIRHMAHENVLSLLDLIPPPSYTDFRDVYMTVDLMEMDLHRIIYSKEVLRDDHIRYFLYQMLSGLHHMHRAGVLHRDLKPSNLLINSDCQLKICDLGLARSKEADDVGMTEYVVTRWYRAPELLLGSAYGEGVDLWAAGCIFAEMLGRKPLFPGETYVHQLQLIMNVLGVPEEHSFKENPLANKLKGRQLLSRTQAVAGIDTSTMFPNANPEGLDLLWKMLVFDVEKRITVEEALRHPYLAMYYDEERENAPVEKFQSFDLDDLDETDLKELMFKEICHFHPEEMVKRAQQQKEHPEAVEKLPPGWVKRESRSVPGKFYYSNPKRGISTWIKEEMD

SEQ ID NO: 74652 - protein, 255 aa, Myxococcus xanthus DK 1622
MMEDVAVAPARILLVDDEESLRITLAANLELEGHTVLEAANGEEALRLLEKQSVDVVLTDIRMPGLHGVELLRRIKQERPDMPVVLMTAFTAEELVDDALAEGAFTVLPKPFDVTHALDTVLRAAAAPQVLVVDDTEQVARGMVRALSTVGLRARAVYSGEEALASLRSGEYDVCVLDLVMPEMSGPELVSKVRAANLSVAIIAVSGHVVPEMLRRVAAQGAVVCMTKPVPLRELVQAIARVRGRPQQGLQGARI

SEQ ID NO: 74653 - protein, 337 aa, Zea mays
  misc_feature (59)..(59): Xaa can be any naturally occurring amino acid
  misc_feature (85)..(85): Xaa can be any naturally occurring amino acid
  misc_feature (112)..(112): Xaa can be any naturally occurring amino acid
MGLLGRRPWLLLLALASAAVAVAVAVEASEGDADPLYRACVEGCQKTGSLKEASIKHCXVPTDGLPADQYFYAHKRSHLYKHCLXQLQKPKPYRGGSTIPKHMYASKASSPXKEALSAALSALTLVVQFNGWLSFFLLLYYKLPLRPETHKTYYEYTGLWHIYGLLAMNSWFWSAIYHSCDTIWTEKLYFSSDAAFLGYSLILAILRTLNLRDEASRVMVAAPILAFVTTHILYLNFYELDKGLNMKVCTVIIIAQCLLWALWAVMTRHPSRLKIIFVAIGGAAAVLLEASDIPPRWGYVDGRAICLAVAIPLSYLWWSFAKEDAEMRTSAILKKAR

SEQ ID NO: 74654 - protein, 1194 aa, Debaryomyces hansenii CBS767
IRYKFGASSVRARLQDFATIILCRDNATRGLDSATALEFIRALKTSATILDATPLIAIYQCSQDAYDLFDNVVVLYEGHQIFYGKANKAKEYFINMGWDCPKRQTTADFLTSLTNPAERVPRPGYEDKLPYTPVEFEEYWKKSPQYKKLIEDIEEYLKQKEGSDRDLYHQAHVARQSNHISQKSSFTVSFFMQTRYIMSRNILRTKGDPSIALQSIALQVVMGLIIGSTYYNLETTTGSLFYREAVLFFAILFNSFSSILEIMSLFEARPIVEKHKQYALYRPSADALAGIITELPTKFFMSMGFNFFVYFLSNMRRDAGRFFFYWLMNALCTLVMSHFFRSLGAVSTSFPGAMTPATVVLLAMVIFSGYCIPPPNMLGWSRWIGYINPVSYVFEALMINEFNDREFTCSAFVPAGPSYMDISSDQSICSVTGSRPGLSFVNGSDHIAVTYEYYNSHKWGCFGIIVGFIVFFLVLYVILSEFNKGSMQKGEVTLFLKSSLKEHKKQAAKGAATTKDIENSNISNEKISHKDQLDANKEENNNNNNALPSSKDIFHWRDLTYQVKIKSEDRVILNHVDGWVKPGQLTALMGSSGAGKTTLLNCLSERVTSGIISDGTRMINGQELGSSFQRSIGYVQQQDLHLPTSTVREALRFSAQLRQPNSVSIQEKNEYVEYIIHLLDMNLYADALVGVAGEGLNVEQRKRLTIGVELVAKPKLLIFLDEPTSGLDSQTAWSICKLMRKLADHGQAILCTIHQPSAILLQEFDRLLFLQKGGKTVYFGDLGENCHTLIDYFEKYGAHHCPEEANPSEWMLEVVGAAPGSHANQDYHEVWKNSAEYQMVKDHLTEMETELVKIPRDESQEAKRSFAAPIWKQYLIVTKRIFEQNWRSPSYIYSKLILVISSSLFNGFAFFKADRSLQGLQNQMISIIQFLVPFMTLVQQMMPYYIKQRDIYEVREAPSKTFSWFAFITAQITSEIPYQVVIGTLGFFCWYYPVGLYDNAVPTDSVDSRGVLMWLYITAFYVYTSTMGQLCISFIEVPENAANLAVNLFTVCLIFCGVLAPYDFLPGFWTFMYRCSPMTYFVQGMGSTGLSNVEAVCSESELLRFEPRSGQTCGSYMADYIKQTGGYLVDGNATSKCEYCTTKSTNDYLASVDSLFSERWRNWGIVICFIAFNIIFTVFFYWIARVPKSNRQKK

SEQ ID NO: 74655 - protein, 404 aa, Pseudomonas viridiflava
MKLPIYLDYSATTPVDPRVAQKMIDCLTVEGNFGNPASRSHVFGWKAEEAVENARRQVADLVNADPREIVWTSGATESNNLAIKGVAHFYASKGKHIITSKVEHKAVLDTTRQLEREGFEVTYIEPGEDGLITPAMIEAALRDDTIVVSIMHVNNEIGTINDIAAIGELTRSRGVLFHVDGAQSTGKVEIDLASLKVDLMSFSAHKTYGPKGIGALYVSRKPRVRLEAAMHGGGHERGMRSGTLATHQIVGMGEAFRIAKEEMAAENVRIKALSDRFYKQVENLEELYVNGSLTARVPHNLNLSFNYVEGESLIMALKDLAVSSGSACTSASLEPSYVLRALGRNDELAHSSIRFTFGRFTTEEEIDYAAQKVCEAVTKLRTLSPLWDMFKDGVDISKIEWAAH

SEQ ID NO: 74656 - protein, 508 aa, Bifidobacterium longum NCC2705
MQLFRTKSVEQTIAETGEEGRKLKRNLTWWDLSIMGVAVAVGAGIFSVGAQAAAFHAGPAVIISFLIAGIVCGAAVMCYAEFASMIPVAGSAYTFTYTTVGEIMAWIIGWDLILEMLMAGSVISKYWGVYLNDFMRLMGWNANTNLTFGSFHIDIAPIIIVAFFTTLLVFGTKIGARVDGAMTVLKIAIVFFVVIVGFFYVKASNFTPFIPPSQPASTVEGSSAVTGVMTQPLWQFATGMTPSVYGVPGILSGAALVFFAFIGFDVVATASEETKNPHKNVPLGIGVGMLLIIVMYMLVAVVTTGMVSYADLAKQDSPSLATAFELVGADWAAKIISFGIVLGLATVVMVLLLGLTRIVFAMSRDGLLPRGLSKTGKHGTPAALQIVVGAVVALVAAFFDIGVLSDMVNIGTLSAFTLVAISIPIMRKKRPDLPRAFKMPGSPWIPILIAVANFWLMLNLSVLTWIRFVVWLVVGFAIYFGYGYWHARLGKGDLTETLSAETDKAVNG

SEQ ID NO: 74657 - protein, 633 aa, Arabidopsis thaliana
MSGPLDRFARPCFEGFLSSDEKKERKSDFENSEDERRTRIGSLKKKAINASTKFKHSLKKKSGRRKSDGRVSSVSIEDVRDVEELQAVDAFRQSLLMDELLPDRHDDYHMMLRFLKARKFDVEKAKQMWADMIQWRKEFGTDTIIQDFDFEEINEVLKHYPQCYHGVDKEGRPIYIERLGKVDPNRLMQVTSMDRYVRYHVKEFERSFMIKFPSCTISAKRHIDSSTTILDVQGVGLKNFNKSARDLITRLQKIDGDNYPETLHQMFIINAGPGFRLLWNTVKSFLDPKTSAKIHVLGYKYLSKLLEVIDVNELPEFLGGACTCADQGGCMLSDKGPWKNPEIVKMVLHGGAHRARQVVKVLNSEGKVIAYAKPSYTWIKGSDTSTAESGSDAEDIGSPKAIKSFSHLRLTPVREEAKIAGETSLAGSFPGYDEYVPMVDKAVDATWKVKPAIQRVASRGALMSPTVPKDHEGIKARVLVMFMAFLMAVFTFFRTVTKKLPATTTSSPAETQGNAIELGSNGEGVKEECRPPSPVPDLTETDLLNCVTKKLTELEGKIGTLQSKPNEMPYEKEELLNAAVCRVDALEAELIATKKALYEALMRQEELLAYIDRQEEAQFQKMKKKKKKHLFCF

SEQ ID NO: 74658 - protein, 262 aa, Pseudomonas viridiflava
MFERLREDIQSVFHRDPAARNAFDVLTCYPGMHAIWLHRFAHILWGKGWKWPARVVSNFGRWMTGIEIHPGARIGRRFFIDHGMGIVIGETAEIGNDVTLYQGVTLGGTSWNAGKRHPTLEDGVVVGAGAKVLGPFTVGAGAKIGSNAVVTKAVPAGATAVGIPGRIIVKSDDETEAKRKAMAEKLGFDAYGVSADMPDPVARAIGQLLDHLQAVDGRLEDMCGALSRLGSDYCAKDLPELRDEVFDCVKDKREETLENKIG

SEQ ID NO: 74659 - protein, 365 aa, Clostridium perfringens str. 13
MKLGMVGLPNVGKSTLFNAITKAGAESANYPFCTIEPNVGVVSVPDKRLDVLEKIYNTKKKVYTAIEFYDIAGLVKGASKGEGLGNKFLSHIREVAAIVHVVRCFDDENVVHVEGSVDPIRDIETINLELIFADLDVLERRMEKTMKLVRSGDKTAKFEYDVMERLKAHLEANKPARTLEATEDEEAFVKSLFLITSKPVLYACNISEDDMMEGNLDNEYVQKVRAYAETENSGIMVVCAKLEEELSGLDEEEKAEMLSEYGLEESGLDKLIQASYKLLGLMSYLTAGVQEVRAWTIKQGTKAPQAAGKIHSDIERGFIRAEVVSYDDLVECGSEAAAKEKGVYRLEGKEYVMKDGDIVNFRFNV

SEQ ID NO: 74660 - protein, 280 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNIAGFGLIFLLTLFAFQGETRVVSLGWICVGFSVCVFVAPLSIIGRVIKTKSVEYMPFSLSLTLTLSAIVWFLYGLLIKDKYVALPNILGFTFGMIQMVLYMFYMNATPVVSDLKEGKEGLKMPAEEHVVVINVGKTEKSSGAVVRPVTEMVTTPSPADALLRRRHQGNK

SEQ ID NO: 74661 - protein, 213 aa, Brassica napus
  misc_feature (167)..(167): Xaa can be any naturally occurring amino acid
  misc_feature (183)..(183): Xaa can be any naturally occurring amino acid
  misc_feature (191)..(192): Xaa can be any naturally occurring amino acid
  misc_feature (195)..(200): Xaa can be any naturally occurring amino acid
  misc_feature (206)..(206): Xaa can be any naturally occurring amino acid
  misc_feature (208)..(209): Xaa can be any naturally occurring amino acid
MADLFPPLVTAQIDGKQPKVDEKVDYSNLPCPVPYDELHREAYMSLKSETFEGLRFDFSKGLNQRFSLSHSVMMGPTEVPSQSPDTTIKIPTAHYEFGANYFDPKLMLVGRVMTDGRLNARVKADLSDKLILKANAQLTGEPHMSHAVFNFDYMGKDYRAQLQLGNXALVGATYIQSVTPAIXGGGGKIFXXWGXXXXXXKGYPAXNXXPLSC

SEQ ID NO: 74662 - protein, 272 aa, Arabidopsis thaliana
MATMISNLPRDLMEEILSRVPLKSMRAVRLTCKNWHTLSITISESLAKMYISKTTRESREGESTIITLMNYKLCLTSLVVDVDPYIEHKGKLTCFNLEHQVKISQVFYYEDDTITTRLVVWNPYWGQTRQIKTRYSHHAFSGRDSTYMFNYSLGYENKNSCRSHKLLRFIDYHWNYRGLHQFFWYEIYDFDSDLWTTLDVTPHWFIVISQSGVSLKGNTYWCARKRSGGYSDHIICFDFTRERFGPLLPLPFSFIDRHHSCVILSCVSEEKL

SEQ ID NO: 74663 - protein, 308 aa, Erwinia carotovora subsp. atroseptica SCRI1043
MKTGKLVVLGSINADHILNLEQFPRPGETVIGEQYSVAFGGKGANQAVAAGRSGANIAFIACVGEDDIGSRICQQLSKDNIDVSAVEAISGETTGVALIFVNAEAENMIAINAGANAAVTPDYLHRHQQHIIDASALLMQLESPLETVIAAARLAHEHQTKVILNPAPARELPDELLSLVDMITPNETEAQLLTEITVETEEDAARAAQVLHDKGIETVLITLGSRGVWLSESGQGQRIPGYRVKAVDTIAAGDTFNGALVTALLENQPMSSAVKFAHAAAAISVTRRGAQPSVPWREEIDAFLQAQE

SEQ ID NO: 74664 - protein, 217 aa, Triticum aestivum
  misc_feature (33)..(33): Xaa can be any naturally occurring amino acid
MSQDKAAGDKAAAEPKRQTPRLNERILSSLSRXRSVAAHPWHDLEIGPGAPAVFNVVVEITKGSKVKYELDKKTGMIKVDRILYSSVVYPHNYGFVPRTLCEDNDPIDVLVLMQEPVLPGTFLRARAIGLMPMIDQGEKDDKIIAVCADDPEYHNLNHLSELSPHRLQEIRRFFEDYKKNENKEVAVNDFLPADDARAAIQHSMDLYAEYIMHSLRQ

SEQ ID NO: 74665 - protein, 535 aa, Dechloromonas aromatica RCB
MTVLKTQLNPRSADFQANADAMRTVVADLHEKVDKIALGGPEAARQKHLARGKLLPRERVSGLLDPGTPFLEIGQFAAYGMYGGDVPAASVIAGIGRVHGVECMVVANDATVKGGTYYPLTVKKHLRAQEIALENHLPCVYLVDSGGAFLPMQDEVFPDKEHFGRIFFNQANLSAKGIPQIAAVMGSCTAGGAYVPAMCDESIIVKNQGTIFLGGPPLVKAATGEVVSAEDLGGADVHTRISGVVDHLAENDAHALAIARRIIKDLNWKKQPPVTLTAPAEPLYSAEELYGVIPTDSKKPFDVREIIGRIVDGSDFDEFKARYGTTLVCGFARIYGYPVGIVANNGILFSESALKGAHFIELCAQRGIPLVFLQNITGFMVGRKYENGGIARDGAKMVTAVATAKVPKFTVVIGGSFGAGNYGMCGRAYSPRFLWMWPNARISVMGGEQAAGVLATVKRDGMEATGKTWSAEEEAAFKAPIREQYETQGHPYYASARLWDDGIIDPADTRRVLGLGLSASMNAPAEETKFGIFRM

SEQ ID NO: 74666 - protein, 404 aa, Acidovorax sp. JS42
MNPLLSLLQPYPFERLRQLFAGVTPSAAHRAISLGIGEPRHATPPFIQEALAANLAGLASYPSTAGDPSLREACAGWMQRRYHIPVNPATQVLPVNGSREALFAFAQTVVDPTRAGATVVCPNPFYQIYEGATLLAGATPYYAPSDPARNFAVDWDSVPEEVWQRTQLLFVCSPGNPTGAVMPLPEWEKLFALSDRYGFVIASDECYSEIYFRDEPPLGGMEAAAKLGRSDYRNLIAFTSLSKRSNVPGLRSGFVAGDAALIKAFLLYRTYHGSAMGPAVQAASVAAWNDEVHVEENRALYRQKFAQVTPMLAEVMDVRLPDAGFYLWAKVPDALGMSDAEFAQALLAQYNVTVLPGSYLARDSGGANPGAQRLRMALVAETAECAEAASRIVQFIQSRTLFHP

SEQ ID NO: 74667 - protein, 224 aa, Oryza sativa Indica Group
MGMIYPVPLDSSWFSECKGQLALVHCECKSVLLRMESSKTQSQGSTSVPKNPAMSSCRKKKSDDATFREDLKDHIDEFIHASMDEHKHCFKNTIQKMFGMSKVVAERSAEAKEAEVESALPLQTSVSQLRMESSKTQSQGSASVPKNPAMSSCRKKKSDDATFLEDLKDHIDEFIHASMDEHKHCFKNTIQKMFGMSKVVAERSAEAKEAEVESALPLQTSVSQ

SEQ ID NO: 74668 - protein, 333 aa, Geobacter sulfurreducens PCA
MGLMDQIRAKARNNLQTIVLPESYDDRMYAAAQQIVEQGLAKVVMLGNADTIARKAADLGATISGVELIDPATSPKLNEYADAFVELRKSKGLSKDDALKLLTAADNLYYAGMMVRQGDAGGEVAGATGTTGDVLRAAFQTVGPAKGIKTVSSFFFMVTKTPSFGENGIIFFADCAVNPNPDAQALADIAVATARNCKAFLDVDARVAMLSFSTKGSASHADVDKVLKAMELAKAIDPALQIDGELQADAALLPKVGERKAPGSTVAGKANVLIFPDLDAGNIAYKLVERVAGAEAIGPIIQGLAKPVNDLSRGCSVEDIVNVAAITAVQAQG

SEQ ID NO: 74669 - protein, 656 aa, Acidovorax sp. JS42
MITLKNVTLRRSAKVLLDGVSVTINPGEHVGLVGRNGAGKSTLFALLNGSLHEDGGDFFLPAAWRMAQVAQNMPETDESATAFVLDGDTRLTELRQALHTAEQAGDGMAIAQAHSDLADAGAHDATARAQALILGLGFQVAELERPVNSFSGGWRMRLQLARALMCPSDLLLLDEPTNHLDLDALVWLEAWLQRYNGTLVVISHDREFLDAVTQVTLHIDNARLTRYGGNYSKFEELRAQQLELQQSAYERQQDKIAHLQKFIDRFKAKATKAKQAQSRVKALERMEKIAPVLASADFTFEFKEPANLPNPMLAITDASFGYRAEDGSETTILRHVNRSVLAGQRIGILGANGQGKSTLVKTIARTMAPLSGTLTEGKGLSIGYFAQQELDVLRPGDNPLEHMVRLARELGAQAQEPSREQDLRNFLGSFNFSGDMVHQAVGTMSGGEKARLVLAMIVWQRPNLLLLDEPTNHLDLATREALSMALNEFEGTVMLVSHDRALLRAVCDEFWLVGRGAVAPFDGDLDDYQRYLLEESKRLRELARAAEQVVVAEAASPTATAAPPLRDAREQRRQEAQARQQLAEKTRPLKRELEKIDQRLEALNREKAQLEERLMQPLPPAEIAECGRRLKDCTEEVTALEEKWLDVSSALEELAR

SEQ ID NO: 74670 - protein, 203 aa, Isochrysis galbana
GEGTYGVVYKAQDTEDPQGATVALKKIWLDDRDEGVPVTTLREVALLRNLDHVNIVRMREFVTIPPRIYLVFEYLDHDLKACLDTKFRSGMPAPLVKSCALQILRGLAFCHSHRILHRDLKPQNVLIDNAGIVKLADFGLARASLLLNSQLYTNEVVTLWYRAPELLLGTQNYINSVDVWAAGCIFTELSCRMPLFPGDSEIE

SEQ ID NO: 74671 - protein, 454 aa, Streptococcus pneumoniae TIGR4
MKVVKFGGSSLASASQLEKVLNIVKSDSERRFVVVSAPGKRNAEDTKVTDALIKYYRDYVAGNDISKNQSWIIDRYAAMVSELGLKPAVLEKISKSIHALATLPIEENEFLYDTFLAAGENNNAKLIAAYFNQNGIDARYMHPREAGIVVTSEPGHARIIPSSYDKIEELTNTNEVLVIPGFFGVTKENQICTFSRGGSDITGSIIAAGVKADLYENFTDVDGIFAAHPGIIHQPHSIPELTYREMRELAYAGFSVLHDEALLPAYRGKIPLVIKNTNNPDHPGTRIVLKHSNDEFPVVGIAGDSGFVSINMSKYLMNREVGFGRKVLQILEELNIGWEHMPTGIDDLSIILRSRQLTPIKEEEILRQLVQKAKVDHAEIEHDLSIIMIVGEKMKSHIGVTATATRALSENKINIQMMSQGSSEVSIMFVVNKDQEKAAIKALYNAFFGESKED

SEQ ID NO: 74672 - protein, 314 aa, Chromobacterium violaceum ATCC 12472
MQDVSAFANRLAKNYKHYAKWARRQGLDAWRVYDKDVPQFPFAVDIYGSRVHLQEYDTGWEMDDDAYRAWIDAVVAAIAQVAGIPAAAVTLKNRRRQKGVSQYEKVGAEGEDFIVEEFGQRFIVNLDQYLDTGLFLDHRNTRQRVREEAAGKRFLNLFAYTGSFTVYAGAGGALSSETVDMSNTYQDWSRRNFELNGLDLGKHQLVRADVFQYLEEAVDAGKQFDLIVMDPPTFSNSKKMRDILDVQRDHVWLIDYAMALLAPGGWLYFSNNLRTFQLDERLHQDYRIRDISAQSVPEDFRNRKIHQCWRIDRV

SEQ ID NO: 74673 - protein, 211 aa, Neisseria gonorrhoeae FA 1090
MPMNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 74674 - protein, 97 aa, Oryza sativa
  misc_feature (28)..(28): Xaa can be any naturally occurring amino acid
  misc_feature (51)..(51): Xaa can be any naturally occurring amino acid
HEGGSASPPPPPPPRRMQRASQAIGSHXSLLKSAVLRHISAPKTSILPAVXYSRSLSVSSAPIEESGFETGTVADILKSKGKSADGSWLWCTTDDSV

SEQ ID NO: 74675 - protein, 399 aa, Clostridium tetani E88
MIGVLGVKTEVKLDIREKLSIIPKRYESSLMKLKEKCDEVVILSTCNRTEVYYSYKKHNENIISHIFKCLNWDENYKKYTFHYKDDEAINHLMRVICGFDSLILGEDQILSQIKQAYEIALSSKSVNRDLNKLFQMAITCGKEFRNKSQLYKIPVSSASIAVNEGRKHGGKNFMVLGYGAVGSLAVKYILSGEFDKLYIVVRNPSVVDLRDDRMTIINFNERGKYYKDVDCIISCTSAPHVVVDAFELPKHKNIVVYDLAVPRDVDEEVRYMKNVKLYDIDNISCINDENCSKREDIMNNNLFVIEKYEREFEKWRKTSEISPHIVNLKKKGDEVYKKRLTTFKNKKYTKDVDALAEIMLKSTSNAYINKAIEVLKEEQLKGRGEECLRIIEKIFYSAQ

SEQ ID NO: 74676 - protein, 463 aa, Nostoc punctiforme PCC 73102
MADLTPNSSFSLTLRLQIPNRVGMLASVTQAIATTGGNLGQIDLIEQTRKESTRDITVDAASTEHAETIVQAVKALPDIKLLSVYDRTFNLHRGGKISITSRIPLKSVSDLAMAYTPGVGRICTAIAQDPEEVYKLTIKQNTVAIVTDGSAVLGLGNLGPAAALPVMEGKAMLFKEFAGLDAFPICLATQDTEEIIQTVKNIAPVFGGVNLEDIAAPRCFEIEKRLREELDIPVFHDDQHGTAIVTLAALFNSLKLVHKPMAEIRIVINGAGAAGVAIARLLRKAGAEKIWMCDSKGIISTSRADLTEEKLEFAVKAQGTLAGAMQGADVFIGVSAPGVLTPEMVHSMAKDPIVFAMANPIPEIQPELISKDVAVIATGRSDYPNQINNVLAFPGVFRGALDCRAKTITTTMYLEAANAIASLVKPSDLDREHIIPSVFDERVVNAVAAAVQQAARQEGIAQN

SEQ ID NO: 74677 - protein, 293 aa, Triticum aestivum
  misc_feature (36)..(36): Xaa can be any naturally occurring amino acid
  misc_feature (101)..(101): Xaa can be any naturally occurring amino acid
  misc_feature (178)..(178): Xaa can be any naturally occurring amino acid
  misc_feature (198)..(198): Xaa can be any naturally occurring amino acid
  misc_feature (209)..(209): Xaa can be any naturally occurring amino acid
  misc_feature (226)..(226): Xaa can be any naturally occurring amino acid
  misc_feature (275)..(275): Xaa can be any naturally occurring amino acid
MMEGGMRGGTSYEPKLYTGYVFSALETLKKKKKGDXSKGCSSKGGKQGNDPTPHQQKELFWAPAPLNTKSWADVEDDDDDDYFATTAPPEPIWGNDHSSSXTAKEEEENEFDSVHAALPEAIESEDEEHDDESEDGAEDEPEHEVEAADPDVKKVAAAPKETERQLSKKELKKKELAXELDAVLADLGISDNTTDAAXQDVDFYAEKKXLSQAGDGKRKEDPPAPXKSRMPQKRRNRRAQTAKEAKEPKVSEEAGISNPEENPVVDVKEPLRKMXSIKKKKLGKGTDPPSKIR

SEQ ID NO: 74678 - protein, 463 aa, Burkholderia cepacia
MSTAALVEGKIVQCIGAVIDVEFPRDSMPKIYDALILDGSELTLEVQQQLGDGVVRTICLGASDGLRRGLTVKNTSKPISVPVGKPTLGRIMDVLGRPIDEAGPIESEHTRSIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVLTGLTMAEHFRDEGLDVLFFVDNIYRFTLAGTEVSALLGRMPSAVGYQPTLAEEMGKLQERITSTKKGSITSVQAVYVPADDLTDPSPATTFGHLDATVVLSRDIASLGIYPAVDPLDSTSRQIDPNVIGEEHYSITRRVQQTLQRYKELRDIIAILGMDELSPEDKLSVARARKIQRFLSQPFHVAEVFTGSPGKYVPLKETIRGFKMIVDGECDHLPEQAFYMVGTIDEAFEKAKKIS

SEQ ID NO: 74679 - protein, 493 aa, Oryza sativa Japonica Group
MTRDKLGLDPRLGWGWEGVWGWEAAACGLAVGGGHDMYGGNETLKARGALSIAVPGEIAGLYEAWKRHGKLPWKRLVMPAAKLARAFRVSPYLRKQMEATRDGILQNKGISGVYTSNGDILNVGDVCRNIRLARTLVAVAEKGPDVFYKGAVGDQLAKDIQEVGGIITMEDLKKYQVKIRRPLLENVLGLTVLSMPPPSAGGAGLMLVLNILTQYGLPAGFSGSLGIHRLIESLKHYFAIRMNLGDPEFVNVNEVVSDMMSPKFAADLKKTIYDNMTFDPKHYGGRWNILQDHGTSHLSIVDSERNAVSMTTTVNAYFGSLILSPSTGILLNNEMDDFSMPANTSANSPPPAPANFVRPLKRPLSSMTPTIILKDGNLKAAVGASGGSMIPAGTMEVLLNHFVKNMDPLSSVMAPRVYHQLIPNVVQYENWTTVTGDHFELDAATRADLRRKGHVLEPLAGGTISQLVVDDVERHGGLTAVSDPRKGGFPAGY

SEQ ID NO: 74680 - protein, 462 aa, Prosthecochloris vibrioformis
MQEGKISQIIGPVVDVDFPEGQLPSILDALTVTRQDGSKLVLETQQHLGEERVRTISMEGTDGLVRGMSVANTGRPIQAPVGAEVLGRMLNVVGEPIDGKGPVPSKKSYPIHRSAPKFDELSTKAEMFETGIKVIDLLEPYSRGGKTGLFGGAGVGKTVLIMELINNIAKEQSGYSVFAGVGERTREGNDLWHEMMESGVIDKTALVFGQMNEPPGARARVALTGLSIAEYFRDEEGRDVLLFIDNIFRFTQAGAEVSALLGRMPSAVGYQPTLGTEMGELQDRIVSTKKGSVTSVQAIYVPADDLTDPAPATAFTHLDATTVLSRQIAELGIYPAVDPLDSTSRILDPNIIGNDHYDTAQAVKQILQRYKDLQDIIAILGMDELSDEDKLVVARARKVQRFLSQPFFVAEAFTGLAGKYVKLEDTIKGFKEIIAGKHDSLPENAFYLVGTIEEAVEKAKKL

SEQ ID NO: 74681 - protein, 201 aa, Francisella tularensis subsp. tularensis SCHU S4
MITNNLVPTVIEKTAGGERAFDIYSRLLKERIVFLNGEVNDHSANLVIAQLLFLESEDPDKDIYFYINSPGGMVTAGMGVYDTMQFIKPDVSTICIGLAASMGSLLLAGGAKGKRYSLPSSQIMIHQPLGGFRGQASDIEIHAKNILRIKDRLNKVLAHHTGQDLETIVKDTDRDNFMMADEAKAYGLIDHVIESREAIIK

SEQ ID NO: 74682 - protein, 177 aa, Arabidopsis thaliana
MTGTGQKLNIRRRVGENRCVNMIANLFHAPVGQDEAVISCGIVASSESAGLAFKMKWQHRRKAQGLPIDKPNIVTGVNVQVCWEKFARYFEVELKEVKLSEDYYVMDPAKAVEMVDENSICVAAILGSTFTGEFEYVKLLNDLLAEKNAKTAWETPIHVDAASGGFIASMGEEYQCQ

SEQ ID NO: 74683 - protein, 193 aa, Triticum aestivum
  misc_feature (120)..(120): Xaa can be any naturally occurring amino acid
IPLDPCTTACTHHHTYESPRLPEKQASKQDGREEGRREEEGGDPVREGRAPVPRRPHRALPQDRAATRSASAPATPSTSSPSSSTSPPRDWSWSVTRTTTTRNTLIVMSKLLMDDLKEHXLGRLVYEVHIPYLVDLNDIQEVIVIWIYNQHECENDATLIGTILNAYAKAPPKTTVPSIRSEVMDSTATPRDR

SEQ ID NO: 74684 - protein, 471 aa, Herpetosiphon aurantiacus
MATGKILQITGVVIDAEFPADSLPQIYNALEIPLGQGRPSLICEVQQQLGDSVVRAVAMSTTDGLVRGMDVINTGAPISVPVGPETLGRVFDVQGRPIDGEGPVGTTKTMPIHRPAPTFEEQSNRAELFETGIKVIDLIAPFTKGGKTGVFGGAGVGKTVIIQELISNIAKEQSGYSVFAGVGERSREGNDLIHEMKDSKIPGTDQTVFDKTVMVFGQMNEPPGARLRVALSALTMAEYFREEGRDVLLFVDNIFRFTQAGSEVSALLGRMPSQVGYQPTLGTEMGELQERITSTKTGSITSLQAVYVPADDYTDPAPATTFAHLDATISLERSISEKGIYPAVDPLASTSRILDPNIVGEEHYRVATEVQRMLQRYKDLQDIIAILGVEELSDDDKLTVSRARKLERFFSQPFGVAEVFTNIPGKYVAVGDTVKSFARVLAGEFDHIPESFFFMKGRIDDVVAAFDASKQ

SEQ ID NO: 74685 - protein, 265 aa, Moritella sp. PE36
MSLEIRDLSILLIEPSTTQSRFITTQLQDAGVDNIECVSSIAQAKQSLTGFIPDLIISAMYFEDGSGAELAEFVKSNILTENIAFMLISSEQRFSVLDKVKQAGAIAILPKPFKFVDLQRALNATLSFIEPEEIELDLYDVTTLKILVVDDSLTARKHICRVLFSMGIVGVTTAENGVEALEYLAQNTFDLIVTDYNMPEMDGKELVEKIRTNPELSYLPILMVTSEEGSAQLSAVKQAGVSALCDKPFDIDTVRMLVQQLLNEQ

SEQ ID NO: 74686 - protein, 427 aa, Peptococcus niger
MNQGTIIKVVGPVVDVEFPSGLLPNINNALHISSDEQPEDKKTGHDFKVVLEVAEHLGGNIVRAIAMSSTDGLMRGMVVTDQESPITVPVGDATLGRLMNVVGDPIDEAGEVPSETRWPIHRSAPTYVQQNPSKEILETGIKVVDLLCPYVKGGKIGLFGGAGVGKTVLIQELIRNIAYEHGGYSVFAGVGERTREGKDLLVEMRESGVIDKTSLVFGQMNEPPGARMRIALTGLTVAEYFRDEQNQDVLLFIDNIFRFTQAGSEVSALLGRMPSAVGYQPTLATEMGTMQERITSTDKGSITSVQAVYVPADDLTDPAPATTFAHLDATTVLERSISEKGIYPAVDPLASTSRILDPRIVGEEHYEIARDVQEVLQEYRELQDIISILGMDELSDEEKLTVARARRIERFLSQSFFVAEQFTGNPG

SEQ ID NO: 74687 - protein, 211 aa, Erwinia carotovora subsp. atroseptica SCRI1043
MTQQYNYHMTRFIISAPDIRHLETDNGIEVAFAGRSNAGKSSALNTLTNQKSLARTSKTPGRTQLINLFQVAEGVRLVDLPGYGYAEVPEQMKIKWQRALGEYLQKRNSLKGLVVLMDIRHPLKDLDQQMILWAVDVKLPVLVLLTKADKLASGARKAQLNMVREAVLPFMGDIQVEAFSSLKKIGVDKLQQKLDNWFSTLQHIEEEQDAE

SEQ ID NO: 74688 - protein, 591 aa, Oryza sativa
MDDHNLDYKGSGALEELEMLTVNAKEAQELILTKILERNQATEYLSKFMNGSTNISAFKRHVPVVTYDKVHPYILRIATGEESSILCGEYILELLRSSGTSRGEPRLMPSILKDLDRRTYLYSLIMPIMNKYISGLGEGKAMYLLFVKAETLTDSGIPVRSVLTSYYKSPHFLHRKHDLYNNYTSPDEVILCPDSQQSMYCQLLCGLVERQHVLRIGAVFASAFLRSISFLEQHWRDLVNDIRIGQLNSSITSPACRLAMLNFLALPNPELADQVEAICSCGSWKGILGRLWPNVKYIEAVLTGTMAQYIPMLEFYGGGAIPFVCTMYASSESYFGVNLSPLCSPADVSYTILPNMAYFEFIPLEDGLRVTDHEEVIENDKLVSLVDVKVGCYYELVVTTFSGLYRYRVGDVLQVTGFYNRAPQFKFICRRNVILSIDSDKTNEEDLHNSVTTAKKILENQNYLLLEYTSYTDISTVPGHYVLFWEIKSTHDERPAPLDAQLLESCCAAVEESLDYVYRRCRAHDRSIGPLEIRLVEAGAFDALMDLLVSHGSSINQYKTPRCIESSLALKLLNSKVIACFFSPQDPECGM

SEQ ID NO: 74689 - protein, 463 aa, Oryza sativa Indica Group
MDYNPVDSSGTDDDLPPTYQNRGVRGSGRVSGNGRDIVSAVPYNRTKPQTDMETQIHQLEQDAYCSVLRAFKAQSDAISWEKEGLITELRKELRVSDKEHRELLNRVNGDDIIQRIRHFYSREWRETKGGLQADMVNNAQRSHDRVPSPTTSARKRQKTSQSIPSASVPVPSPAVHSQTLTAPMQPLSSATKKVAPPGTKGKKTKPGQKIPGGSAIKTMSSAGPSGRGPIMNKNLSGGLPTEPISVNPLIGRKVMTRWPDDNSFYEAVITDYDPQLDRYALVYDINTADETWEWVDFKEMAPEDIRWEGGDPGIIQQGRGATVHGGKKSSSRNGPMSGPGRGSRGPQKNTSRKEFPPSQNGVGKKSSDCIEILHTESLIKEVERVFSASNPDPLEMEKAKKVLKEHEQSLIDAIARLAEASDGESEERAQPLQHNRGWRNHHGGNYANDMTIDGHMVGDADAL

SEQ ID NO: 74690 - protein, 393 aa, Nocardioides sp. JS614
MKAVTWQGRKDIRVEEVPDPRIEEPTDAIIRVTTTGLCGSDLHLYDPLTPFMTPGDIVGHEPMGVVEAVGSEVTELAVGDRVVVPFNISCGSCWMCERGLHSQCETTQNRDTGTGASLFGYSSLYGAVPGGQAELLRVPFADFLPVQVPHGPPDDRFIYLSDVLPTAWQGIAYAGVPEGGTLLVLGAGPIGDMATRIALHRGIRVIVVDRVPERLARVSARGAEILDLGEIDDVAEQVRGLTGGRGADSVLEAVGMEAHGSPVAEAVQKSLRLLPKKLQQLMMTNLSVERLAALYLAFEAVRRGGTVSISGVYGGTSDPMPMMQLFDKQLQLRMGQANVRAWTDELRTLLEQDEDHLDVEGFATHHLPLDAAPQAYASFQAKDDGMVKVLFRP

SEQ ID NO: 74691 - protein, 454 aa, Haemophilus influenzae R2846
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGKMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVVDALKVVRS

SEQ ID NO: 74692 - protein, 106 aa, Lactobacillus johnsonii NCC 533
MEEIKELTPEKLKEITKNGKVVLLFSATWCPDCRFLDPFLPQIEKDNPDAKFYKIDRDGSIDVAKELNIFGIPSFVVYQDGKEIGRLVNKDRKTKEEVENFLNSLK

SEQ ID NO: 74693 - protein, 308 aa, Wolbachia endosymbiont strain TRS of Brugia malayi
MKIIIGNASKELGKLIANKLNVQPFSAQVSKFADGAINAEVESNLCSQEVYIIQSISPPVNDHLMELLFIIDAVKRSGTKRITTIIPYYGYSRQDRIIKNNNMQSALNAKLVANLIQTAGASSVAVIDLHSSQIEGFFDVPLTNLSCFEAFADSIHIENLAIVAPDVGAIGRARAFAKTLEKKYEIKLSDKIIIIDKYREKAGTSHVMNVIGEATNKNCVIVDDIVDSGGTLCNAALALKNRRARSVISCITHGVLSGNAIEKISSSSLDKLVTTDTIFHKLEKTDKIEIVSIANILTHFIQGGKDAS

SEQ ID NO: 74694 - protein, 337 aa, Zea mays
  misc_feature (105)..(105): Xaa can be any naturally occurring amino acid
  misc_feature (278)..(278): Xaa can be any naturally occurring amino acid
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTAXLAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVSGFKVDTVDTTGAGDAFXVGSLLVNVAKDDSIFHNEEKLREALKFSNACGAICTTKKGAIPALPTVATAQDLIAKAN

SEQ ID NO: 74695 - protein, 327 aa, Rhodopseudomonas palustris CGA009
MTRRHILVTGGAGYIGSHMTLALLGAGERPLVIDNLSTGSRAIVPTDVPFFEGNVGDADFVGRIMDEHPIEAIIHFAASIVVPESVTQPLAYYGNNTANARTLLECAVNHGVPHVVFSSTAAVYGEPDRTPVEEDDPTRPINPYGRSKLMVEWMLADIAQAYPFSYAALRYFNVAGADPQGRAGQSTPNATHLIKIAVQAALGKRSGLDVYGTDYSTPDGSCIRDYVHVSDLAQAHLDALDYLRAGKPSITCNIGYANGYSVLDVINVVKRVSGVDFEVRIKGRRAGDPAALIAANQRARTALSWTPRYDDLEQIVRDALAWERRLG

SEQ ID NO: 74696 - protein, 386 aa, Wolbachia endosymbiont strain TRS of Brugia malayi
MNKIIEIRAPKTLGGESITEGVIKIKKSIGEAIEVDDLIFEIETDKTALELTAEASGQITEFLVSEGDVISPDQLLAKLSVGEVKKEDKSENLAKRDAPSARKIMEENAISTESVKGTGMGSRITKADVIDHMRKAEQPTIKQYELPKSAASGERREERVKMSKIRQVIAARLKASQNTAAILTTFNEIDMKNVIDLRAKYKETFEKKYGIKLGFMSFFIKAAVQALREIPEINAEISGDEIIYKRYYDIGVAVGTNKGLVVPAIRNADQMSFAEIELTLADLGKKAREGKLQVSEMEDATFTISNGGVYGSLLSTPIINPPQSGILGMHSIQNRPFAVGNSIEIRPMMYIALSYDHRIIDGKGAVTFLVKIKNYIEDPNRLVLEV

SEQ ID NO: 74697 - protein, 140 aa, Zea mays
MSGNGAKKVVDAAVKAGRTIIDWDGMLPPLLRARPPLPAFPFPRLLFPSAMAQPAFLSSLRSRLCSAPPPPPNHRLQPRRGYHVELGAREKALLEEDVALKRFKSYKNSVKQVSKIGNALTLAVVLACSYELAVLATSTK

SEQ ID NO: 74698 - protein, 364 aa, Pichia angusta
MKGLILVGGYGTRLRPLTLSLPKPLVEFGNRPMILHQIEALANAGCTDIVLAVNYKPEVMVGALKQYEKEYGVSITFSVEEEPLGTAGPLKLAEKILKKDNTPIFVLNSDVICEYPLRDLLEFHTAHGGEATIVATKVDEPSKYGVIVHDRDVPNLIERFVEKPVEFVGNRINAGIYVLNPSVIDLIEMRPTSIEHETFPILVEQKKLYSFDLPGYWMDVGQPKDFLSGMCLYLSALTKKNSNLLTSTSEEYVNGGNVLIDPSAKIGKGCKIGPNVVIGPNCIIGDGVRIQRSTILKNSQIKDHAWVKSTIVGWNSTVGKWARLEGVTVLGEDVTVKDEVYVNGGKVLPHKSIKDNVETPQIIM

SEQ ID NO: 74699 - protein, 184 aa, Salmonella enterica subsp. enterica serovar Paratyphi A str.
MSETLRPYKNLFPGIGQRVMIDTSSVVIGDVRLADDVGIWPLVVIRGDVNYVAIGARTNIQDGSVLHVTHKSSSNPHGNPLIIGEDVTVGHKVMLHGCTIGNRVLVGMGSIVLDGAIIEDDVMIGAGSLVPQHKRLESGYLYLGSPVKQIRPLSDAERSGLQYSANNYVKWKDDYLSQDNHIQP

SEQ ID NO: 74700 - protein, 171 aa, Myxococcus xanthus DK 1622
MPQRPFRGVSPRVHPGCFVDDSAQLVGDIEVGEDSSIWFNCVLRGDVNPIRIGKRTNVQDLSLIHVTSGRSATTVGDDVTVGHHVILHGCTIGNRVLVGMGATVMDDAEVGDDCIIGAGALLTPGTKIPPGSLVVGSPGRVKRPITETEREFLLMSAQHYVLLAAEYHTDR

SEQ ID NO: 74701 - protein, 481 aa, Stigmatella aurantiaca
MSAQVATVGKITQVLGPVIDVEFPPGGLPEVYTALKVTNTSISAEADNLTIEVAQHLGENMVRCISMDSTEGLARGQAVKNTGAPIQVPVGQGTLGRILNVIGEPVDERGPITSSQTWPIHRPAPTFVDQDVRVQAFETGIKVIDLLGPYTRGGKIGLFGGAGVGKTVLLMELIVNVAKERGGFSVFAGVGERTREGNDLYHEMQEGNVSTPRTWMESQCVLVYGQMNEPPGARARVALSALTIAEYFRDMEGHDVLLFVDNIFRFTQAGSEVSALLGRIPSAVGYQPTLSTEMGALQERITSTTKGSVTSVQAIYVPADDLTDPAPATTFAHLDATTVLNRAISELGIYPAVDPLDSTSRILDPNVVGPEHYAVARKVQGILQKYKELQDIIAILGMDELSETDKLTVARARKIQKFLSQPFHVAEVFTGAPGRYVELKDTIQGFKELAEGKHDDLPEAAFYMVGNINEAIEKARKLAAA

SEQ ID NO: 74702 - protein, 202 aa, Glycine max
ICFLSFLPFPSISCRHFVPNLTIGAPVIESLRKHTKAYLDCHLMVTNPLDYVEPLAKAGASGFTFHVETSKDNWKELIQRIKSHGMIPGVALKPGTPVGEVYPLVEAENPVEMVLVMTVEPGFGGQKFMAETMDKVRILRKKYPSLDIEVDGGLGPSTIDVAASAGANCIVAGSSVFGAPEPAQVISLLRSSVEKAQQTSIQ

SEQ ID NO: 74703 - protein, 227 aa, Arabidopsis thaliana
ILVDWLVEVSEEYTLASDTLYLTVYLIDWFLHGNYVQRQQLQLLGITCMLIASKYEEISAPRIEEFCFITDNTYTEDQVLEMENQVLKHFSFQIYTPTPKTSLRRFLRAAQASRLSPSLGVEFLASYLTELALIDCHFLKFLPSVVAASAVFLAKWTMDQSTHPWNPTLDHYTTYKPSDLKASVHALQDLQLNTKGCPLSAIRMKYRQEKYKSVAVLTSPKLLDTLF

SEQ ID NO: 74704 - protein, 142 aa, Aquifex aeolicus VF5
MAVERTLIIVKPDAMEKGALGKILDRFIQEGFQIKALKMFRFTPEKAGEFYYVHRERPFFQELVEFMSSGPVVAAVLEGEDAIKRVREIIGPTDSEEARKVAPNSIRAQFGTDKGKNAIHASDSPESAQYEICFIFSGLEIV

SEQ ID NO: 74705 - protein, 216 aa, Aquifex aeolicus VF5
MKLFNFKGERVFTPGPVEIPDRIREVLGRQIIHHRTKEFTEAFLETRELFKRLVDCTSENFVFFASSGTGAMEASVQNFFNPGEKVLAVVGGKFGERWAELGRTWGLEVVELQVEWGKSVDPDQVEDILNKNPEIKGVLVQMSESSTGAYHDVKTLAKITKDRDTLLVVDAITALGVYNMKPHEWGLDVVVGGSQKAFMLPPGLSMLCSPKRRKKG

SEQ ID NO: 74706 - protein, 469 aa, Erwinia carotovora subsp. atroseptica SCRI1043
MSAEHVLTMLNEHEVKFVDLRFTDTKGKEQHVTIPAHQVNADFFEEGKMFDGSSIGGWKGINESDMVLMPDASTAMIDPFFEDTTLIIRCDILEPGTMQGYDRDPRSIAKRAEDFLRSSGIADTVLFGPEPEFFLFDDIRFGSSTSGSHVAIDDVEAYWNSGKAYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKDGTNLFAGDKYGGLSEMALFYIGGVIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEALAALNEDREFLTRGGVFTDDAIEAYIELRKPEIDRVRMTPHPVEFELYYSV

SEQ ID NO: 74707 - protein, 270 aa, Arabidopsis thaliana
MTSLKAVRCQTVRIQPRNSFHRLDRYALGYDKNRNHKILRFVDDHLAVGEHVFGYEIYDFSSSSWRVLDVTPDWDIQFYQRGVSLNGNTYFFAQEKITEDGEYEEFEDFLLYFDFSTERFEPRLPLPFHFYVLETVSLSSVRDEQLAVLYQRLDSYEILDIWLTTKIEPSAVSWSMFLKLDMRPLTGFQFMVDGGSFFIDEEKKVAVVFDLTKHKQTVTRRYQTAYIIGQDGYFKPVSLGEAPYLGDPHELYCLPLVCPSYAPSLVQLYN

SEQ ID NO: 74708 - protein, 443 aa, Aquifex aeolicus VF5
MKGIRRNLQKSYLKRCSEMYLRGLKVSGEIVSAKGIYLEAILPFANIGNEVEIQSNSRRIRGEVIGFSGDKVLVMPYEPVFGLRKGDKVLLKNELVSTKTGNGVVGKVVDPFGNPLDGGFIGFVEEKGLELPQINPLYRERIREVFDTGVRSVNALFTLGKGQKIGIFAGAGVGKSTLLGMITRHSKADVVVLALIGERGREVKEFLEEVLGEEGLKKSVVVVSTADQSPILKVKGAISAVVHAHHFASQGKDVLLLMDSITRLALAQREIGLAAGEPPTLKGFTPSVFQLLTRIAESCGAFKKGSITGIFTVLVEGDDISLDPIADSLMGVLDGHIILSRKRAVRGLFPAVDPVRSLSRLMPKLVSEEHFMKANFFKEVLSKFEDVEELVRIGLYKGGSNPLVDKVINNLEKVESFFKQKPEEKVNFEESLKALDEIYSLLK

SEQ ID NO: 74709 - protein, 917 aa, Bacillus cereus E33L
MKKTTSTLLSMALVFSSFGALSAHAESLQKEKQFSPQLKANIEQWGENKIAQNVETKTSKEISVIVELQHAPLASQSNIQHAPDLQNNNAQSYHTELKKAQEDTTKKIKEKAPGAKIKEVYNTLFSGFSISVPGDQITALASLPEVKAVYPNLTYKLHETSKSTTNEEAPNIGGPTIGATEAWNLKDPSGKPLDGKGMKVAIIDSGVDYTHPDLKANYIGGYDTVDEDNDPMDGNVHGTHVAGIIAGNGKIKGVAPNASILAYRVMNDGGTGTTEDIIQGIERAIQDGADVLNLSLGQSLNTPDQPVTLTLERAAKLGVTAVVSNGNDGPHPWSVDAPGNASSVISVGASTVSIPFPTFQVAGSSKTYQGLPLSKSDFPIGNDSPLVYVGYGNPSDYAKQDVKGKFALVLQGTSSTLVKAEQAKQAGAVGVLFISTEKEINIMPEYFMRENLALPVMQLSNVHGEELKNLITKRKKNIKIGQPNPTELIANFSSRGPSQGSWLIKPDIIAPGVQIMSTVPRGGYESHNGTSMAAPQVAGAVALLRQMHPDWTTEQLKASLANTAKILKDVNENTYPIMTQGSGLINIPKAAQTDVLVKPNNVSFGLIKPNSGKVKLTQNITLQNLSSKKKSFSTRVELLDTNTKTKVKTSVPSSISIQPNNSTEKPFTITVDSSLPQGVYTGNVYIKEQGKKEETRIPFTFSIDPKDYKRIDGLEIINSTFSPNGDQILDDNLINYYLVAPVDDVTLHANLVTKEHVTYQGIIHQAKNETAGYKPFKWNGTKADGTPLADGLYQIEAVASNSGGETKQTAAVFLDRTAPKLTYEIDQENLVITGKVDDILLDWMTESGWVAPGIPVRLQYEINGNGVWESAFLNPWEKNYGIYLDRTQLQEVKNTIHIVATDAAGNTSNLNVDLDVK

SEQ ID NO: 74710 - protein, 95 aa, Arabidopsis thaliana
  misc_feature (39)..(39): Xaa can be any naturally occurring amino acid
  misc_feature (84)..(84): Xaa can be any naturally occurring amino acid
  misc_feature (87)..(87): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(93): Xaa can be any naturally occurring amino acid
MASSMLSSATMVASPAQATMVAPFNGLKSSAAFPATRKXANNDITSITSNGGRVNCMQVWPPIGKKKFETLSYLPDLTNFEKAXEVXDXLXPXKW

SEQ ID NO: 74711 - protein, 334 aa, Leptospira interrogans serovar Lai str. 56601
MASQIKTIKRRNRSNVCLLIEGAKMRNTSLKIVNQLAQKDDRVVFIGSDLGPGVLEEMKQSIPDRFYMEGVSEQHVIGMAAGMAMEGFIPYINTIATFLTRRCFEQVALDLCLHNLPVRLIASGGGIVYAPLGPTHLAVEDIAILRALPNMTIIAPCDAEEMKRLMPLTLDWPHPIYIRLAKGGDKVISKPEFGFEIGKAIVMQEGKDGLFVTTGVMTQLALEAIQQLESEGVSCGVIHMHTIKPLDGEILKKWIPKVSAIVTVEEHTRIGGLGSAVLEFCNDEIPNEVGKVRRIGLPDRFSEKYGSQESLLNYFGINKDSLVQTMRDAISIKK

SEQ ID NO: 74712 - protein, 182 aa, Pseudomonas putida KT2440
MHSDAFDLKALIRPVVDFPKPGVIFRDITPLFQSPRGLRYVADQFIERYVEAEFSHIGAMDARGFLIGSIIAHQLNKPLILFRKQGKLPADVLSEGYQTEYGEAFLEVHADSLCEGDSVLIFDDLIATGGTLLAAANLVRRTGAQVFEAAAIIDLPELDGSRRLQAAGVPTFCLTEFSLSEY

SEQ ID NO: 74713 - protein, 79 aa, Brassica napus
  misc_feature (10)..(12): Xaa can be any naturally occurring amino acid
  misc_feature (16)..(16): Xaa can be any naturally occurring amino acid
  misc_feature (18)..(18): Xaa can be any naturally occurring amino acid
  misc_feature (27)..(27): Xaa can be any naturally occurring amino acid
  misc_feature (48)..(48): Xaa can be any naturally occurring amino acid
  misc_feature (50)..(51): Xaa can be any naturally occurring amino acid
  misc_feature (58)..(58): Xaa can be any naturally occurring amino acid
  misc_feature (60)..(60): Xaa can be any naturally occurring amino acid
  misc_feature (63)..(63): Xaa can be any naturally occurring amino acid
MAYSMLSSAXXXTSPXQXTMDAPFTGXLKPSSAFPVTRKVNNDITSIXSXXGRVSCMXVXPPXGKNKFETLSYLPDLTE

SEQ ID NO: 74714 - protein, 224 aa, Carboxydothermus hydrogenoformans Z-2901
MEISQKLQEVKREIAKIRPGSKVKILGVTKTVDVERIKEASKAGVEAFGENKVQEFLEKYEKLPNLEWHFIGHLQTNKINKILGKVVLIHSLDRYNLAEEINKRAYRLGINVPVLLEVNMAKEETKFGLMPEEVEDFYFEVRENFKNLEVSGLMTVAPYVENPEEVRPVFRAMRELFLKLKAKDPENDKFQYLSMGMSNDYKVAVEEGANIIRLGTLLFGERKY

SEQ ID NO: 74715 - protein, 648 aa, Oryza sativa Indica Group
MGRHGGVPVEAGGVEAKLLGRWLAATSLDNIGELWNVDLEAQEQQGVAVSNQGCVGVFGSFCSLRKASSIVKHVAATGCLPEYSSEAPARYFSSESSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIISKYGDALKATEERIAELKAKRVIDDGDDKLTMFNVYRVVSSVDANNEVLFELADFESFAGGVRWLSSSSIGGHLKHMSRRQQQQSAAQLKQHNTGEQRMHASSAGDHTVN

SEQ ID NO: 74716 - protein, 305 aa, Triticum aestivum
  misc_feature (108)..(108): Xaa can be any naturally occurring amino acid
MSIARFSCTTHLATLHTLGATRQITRRLLGKMSQGQQRRPSSDQAQAGGGGQGQGQGGGAVRYGDVFPAVTGGLAEKPVAPQDAATMQSAENLVFGETIKGGPAAATXVRSAAMRNERMGLVGHDQATDATAEQGVSVSETRVPGGRIVTEFVAGQAVGQYLAPDDAADAGGAGGDDTKITIGEALEAAGYAAGGRPVERSDAAAIQAAEVRATGLDVNIPGGLAAPAQSAADAHAWAARDDEKAKLGDVLSNAPAKLVADKEVEADDAARVASAETRNQDDKTVRPGGIAASVAAAARLNKQGA

SEQ ID NO: 74717 - protein, 260 aa, Wolbachia endosymbiont strain TRS of Brugia malayi
MSITLHSQKDFEFMRKAGRLAAETLDFIAPYVKVGVTTNKLNDLCHDFIVKAGAIPAPLNYKGYPKSICTSKNAVVCHGIPDDKPLKDGDILNIDVTVILNGWYGDTSRMFWAGKPSIKAKRLCDATYVALMEAIKQVKPGNKLNEIGLAVEKYIRDFGYSIVRSYCGHGIGKVFHAPPNVVHFYDQGESLVLKEGMFFTIEPMINAGKHETLLSRLDNWTVTTRDLSLSAQFEHTLGVTEDGVEIFTLSPKNWHFPPYN

SEQ ID NO: 74718 - protein, 267 aa, Haemophilus influenzae R2846
MNPMLNIAIRAARKAGNAIAKNYERRDAIESTQKGINDYVTNVDKAAEAEIIEIIRKSYPDHTIITEETGAIEGKDSDVQWIIDPLDGTRNFMTGLPHFSVSIAVRVKNRTEVGVVYDPIRNELFTAVRGEGAKLNEVRLRVDSKREIQGSILATGFPFKQPKLMPTQFAMMNALIEDAADFRRTGSAALDLCYVASNRIDGYFEMGLKAWDCAAGDLIVREAGGLVCDFDADNGYLRSGNIIAAPSRVIKEMLNKIRPCLGAEFNH

SEQ ID NO: 74719 - protein, 194 aa, Rhodococcus sp. RHA1
MSQYTIPHVIERTPAGERSFDIFSRLLNERIVFLGTEIDDGVANVVMAQLLHLQADSSDQEIGLYINSPGGSTTAMLAIYDTMQFLRPTIATYCMGQAASAAAVLLAAGTKGHRHVLAHSRTLLHQPSTQGNGTISDLALQAAEIMRVRSQTEAILSKHTGQTVERLRRDTDRDRIFTAEEAIEYGLADTLVAA

SEQ ID NO: 74720 - protein, 349 aa, Mycobacterium sp. JLS
MTIRDNESAAPIPVFADVDTGVDDAMALVYLFASEDADVVGIASTAGNVGVDQVCHNNLALLDLCGTHGVPVSRGADGPIASALRTAEDTHGPEGLGYAHLPSNGSTVTTYDAAEAWVRAARAHPGELVGIAVGPLTNLALAVRAEPALPTLLRRLVIMGGAFDYRGNTTAVAEWNVSVDPEAAAEVFHAWSAPGLTPPIVLGLNLTEHIALTPTLLTRLAAAAQSPTRAMSVLDDRGTRSVAANPLIRVLEDALRFYFEFHFDQGEGYLAHLHDPLAAAVALYPDLVQYRAATVDVELTGTLTRGMTIADWNGRWGRPPNALVGIGVDAGVFFDRFIDRVGPFARRLG

SEQ ID NO: 74721 - protein, 506 aa, Klebsiella pneumoniae subsp. pneumoniae MGH 78578
MRYAHPGQPGAVVSFKSAYGNFIDGRFVEPLSGEFFMNTSPVDGSNIAQFPRSDARDIDFALDAAHRAAPAWGKTSVQQRSRLLLQVADRIEQHLEYLAVAESWDNGKPIRETLNADLPLAVDHFRYFAGCLRAQEGSTAEIDETTVAYHFHEPLGVVGQIIPWNFPLLMAAWKLAPALAAGNCVVLKPAEQTPLSITLLLELIGDLFPAGVLNVVQGFGKEAGEALATSKRIAKLAFTGSTPVGRHILACAAENIIPCTVELGGKSPNIYFADVMDGEEEFIEKAVEGLVLGFFNQGEVCTCPSRALIHESIYEPFMARVMEKVAQIRRGDPLDTDTMIGAQASRQQFDKILSYIQIAREEGGQILTGGERAAIAPALDNGFYIQPTLIKGRNDMRSFQEEIFGPVIGVTTFKDEAEALAIANETQFGLGAGVWTRDTNLAYRMGRGIKAGRVWTNCYHVYPAHAAFGGYKQSGVGRETHKMALDAYQQTKNLLVSYGTAPLGLF

SEQ ID NO: 74722 - protein, 675 aa, Nicotiana tabacum
MSRVGVMREEEKEKSMEIQREEMEEVRDYSEEVKRIPPWTKQITVRGIVASVLIGIIYSVIVTKLNLTTGLVPNLNVSAALLAYVFIQSWTKILKKANFVYTPFTRQENTIIQTCAVCMLQPLAVGGGFGSYLLGLNKKTYEQAGVDTEGNTPGSHKEPSLDWMIGFLFVVSFVGLLALVPLRKIMIIDYKLAYPSGTATAVLINGFHTPKGDKMAKKQVKGFMKVFSMSFLWSFFQWFYSGGDQCGFAQFPTFGLKAWKQSFYFDFSMTYVGAGMICSHLVNLSLLLGAVLSWGIMWPLIGERKGSWFPATLPQSSMKSLSGYKVFISIALILGDGLYNFVRTLFFTGRSIYVSLKTRRPESSAAADNKNQPLDELQRNEIFIRESIPLWLACIGYMVFSLISIIVIPLMFPALKWYYVLVAYILAPALSFCNAYGAGLTDLNMAYNYGKVALFVLAALSGKENGVVAGLIGCGLIKSIVSISSDLMHDFKTSHLTLTSPRSMLLSQAIGTAIGCVVAPLTFFLFYKAFPVGDPNGDYKAPYAIVYRNMAILGVEGFSALPNHCLQLCYGFFAFAIIANLVRDITPERFGKWVPLPMAMAVPFLNNASFAIDMCVGSLIVYVWHKLNSKKASLMVPAVASGLICGDGLWILPSALLALVKVKPPICMAFTVGQA

SEQ ID NO: 74723 - protein, 425 aa, Wolbachia endosymbiont strain TRS of Brugia malayi
MTKRIINNVFAREILDSRGYPTVEVEIELCDGATGRASVPSGASTGKLEALELRDQDEKRYCGKGVLKAVKAVNGVIANAIIGMDAADQSTIDKALIELDGTRNKSKLGANATLGVSLASAKAAANSFKMPLYRYLGGEQANVMPFPLINIINGGVHADNKLDFQEFMILPIGAEAFSEAIRMSAEVFHNLRSILRKRGYSTNVGDEGGFAPNIESTEEALDLIVHAIESASYSTQNHFALGLDVASSTFYKNKIYKFANKELTSEELVEYYYNLVEKYPITSMEDAMSEDDYEGWKLLTAKLGSKVQLVGDDLFVTNCELIRKGIEEKMANAVLIKPNQIGTLTETFTAIGMTKSGGYKAVISHRSGETEDTTISHIAIASNCGQIKTGSLSRSDRLAKYNELIRIEGTLERNAKYYYGLAWTS

SEQ ID NO: 74724 - protein, 164 aa, Escherichia coli
MARRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSGKLDAFLASIRDVAKIVEVARSGVVGLSRGDKIMR

SEQ ID NO: 74725 - protein, 473 aa, Mycobacterium aurum
MTIMAPESVNESLDPRDPLLRLSTFFDDGTVELLHERDRSGVLAAAGTVNGVRTVAFCTDGTVMGGAMGVEGCAHIVNAYDTAIEEQSPIVGIWHSGGARLAEGVKALHAVGLVFEAMIRASGYIPQISIVVGFAAGGAAYGPALTDVIIMAPESKVFVTGPDVVRSVTGEDVDMVSLGGPEAHHKKSGVCHIVADDELDAYERGRRLVGLFCQQGHFDRTKAEAQDSDLKALLPESARRAYEVRPLISALLDEGVPFEEFQSRWAPSIVVGLGRLAGRSVGVIANNPLRLGGCLNSESAEKSARFVRLCDAFGIPLVVIVDVPGYLPGVDQEWGGVVRRGAKLLHAFGEATVPRVTLVTRKIYGGAYIAMNSRSLGATKVFAWPDAEVAVMGAKAAVGILHKKKLAAAAPEDREALHEGLALEHERIAGGVDSAIEIGVVDDKIDPAHTRSVLTQALAEAAPRRGRHKNIPL

SEQ ID NO: 74726 - protein, 380 aa, Oryza sativa Japonica Group
MAKATTMEGRPAKMGFRMPAEWEPHEQCWMGWPERRDNWRELAGPARKVFARTAIAISKFESVTICASAKQYPYVHELMLHQPNIRVVEMSMNDCWFRDIGPTFIVRKGAPGLGITEKNIAGIDWEFNAWGGATDGCYVDWSLDSYVAKKIVEIERIPRFPHTMVLEGGSIHVDGEGTCITTEECLLNPNRNPNMTKLEIENELKDFLGVAKVIWIPHGLYGDDDTNGHVDNLCCFIKPGVVLLSWTDDENDPQYQRSVDALSTLSKSVDAKGRQIEVVKIHVPGPLYMTKEESEGVVKTEHAIPREPGTRLAASYVNFYIANGGIVAPAFGDKWDEEACAVLQKAFPDHEVVMVEGAREIVLAGGNIHCITQQQPVRPS

SEQ ID NO: 74727 - protein, 197 aa, Francisella tularensis subsp. tularensis SCHU S4
MNYSKAKYIMGAAKVSQLPEDTGVEVAFAGRSNAGKSSALNTLTDQKGLARVSKTPGRTQLINLFDLGNNNRLVDLPGYGYAKVSESIKRQWQSEMENYLTSRKCLNGIVLLVDLRHELKEFDSLMIEMAISFDLNLHILLTKADKLNNKERAQANRMIESFLKTFVSTDKISYQLFSSLTKMGLDKFKEKLDTWYQ

SEQ ID NO: 74728 - protein, 514 aa, Chlamydomonas reinhardtii
MALKMRVSQRQALGSQTFVCPHGSVVRKAVSSKARAVSRQAQVVRAQAVSTPVETKVANGVAASSAAGTGQNDPAGDISKTVLGIILGGGAGTRLYPLTKKRAKPAVPLGANYRLIDIPVSNCLNSNVTKIYCLTQFNSASLNRHLSQAYNSSVGGYNSRGFVEVLAASQSSANKSWFQGTADAVRQYMWLFEEAVREGVEDFLILSGDHLYRMDYRDFVRKHRNSGAAITIAALPCAEKEASAFGLMKIDEEGRVIEFAEKPKGEALTKMRVDTGILGVDPATAAAKPYIASMGIYVMSAKALRELLLNRMPGANDFGNEVIPGAKDAGFKVQAFAFDGYWEDIGTVEAFYNANLALTDPEKAQFSFYDKDAPIYTMSRFLPPSKVMDCDVNMSIIGDGCVIKAGSKIHNSIIGIRSLIGSDCIIDSAMMMGSDYYETLEECEYVPGCLPMGVGDGSIIRRAIVDKNARIGPKCQIINKDGVKEANREDQGFVIKDGIVVVIKDSHIPAGTII

SEQ ID NO: 74729 - protein, 130 aa, Pyrococcus furiosus
MAAKPSYVKFEVPKELAEKALQAVEIARDTGKIRKGTNETTKAVERGQAKLVIIAEDVDPEEIVAHLPPLCEEKEIPYIYVPSKKELGAAAGIEVAAASVAIIEPGKARDLVEEIAMKVKELMKHHHHHH

SEQ ID NO: 74730 - protein, 267 aa, Moritella sp. PE36
MMKLEIYQVDSFTNEAFTGNPAGVCITEHPLDESLMFSIAAEIAVSETAFLSLNDFNLRWFTPEVEVNLCGHGTLAMAHILKQKGLVAIGEGIVFETLSGPLEVTVGEHDIDMLFPTAELEFDTLVNTVLLELLGLKLSDVVSYVQFGPKYLIEIRNEEILRSLSPNFDGLNELEGRGVVVTAKSDFSHVDFVSRHFAPWVGINEDPVTGSAHCALAVYWAEKLNKVALKGFQASKRGGFVGVELMPNKKVKLTGSAITVIEGVIHV

SEQ ID NO: 74731 - protein, 496 aa, marine gamma proteobacterium HTCC2080
MLTTLKEEWFGNIRADLLAGLVVALALIPEAIAFSIIAGVDPRVGLYASFCIAVVIAFVGGRPGMISAATGAMALVMVTLVKEHGLEYLLAATMLTGVLQVIAGFLKLGELMRFVSRSVVTGFVNALAILIFMAQLPELTQVTWHVYAMTASGLGIIYLFPRLPVVGKAIPSPLVCIICLTAISIFLGLDIRTVGDMGDLPDTLPIFLLPDIPLNLDTLMIILPYSVGLAVVGLLESLMTATIVDDLTDTPSDRNKECKGQGIANVVSGCFGGMAGCAMIGQSIINVKSGGRGRLSTLTAGSVLIIMVVFLDSWLQQIPMAALVAVMIMVSIGTFSWVSIRDLRRNPMSSNIVMITTVIVVVATHNLAIGVFVGVLLASLFFAHKIGRFMVVKADPDPELGAQTYRVIGQVFFASSEQFIAAFDFKEAVEQVVIDLSLAHFWDVTSVAALDKVVIKFRREGAEVTIHGMNEATETVVDKFGIHNDPAEVEKLMGGH

SEQ ID NO: 74732 - protein, 137 aa, Zea mays
MQFLRGSGGGGGGGGFPGVAWEVLRRHFSKKRSVDVRRINPKVPKEEAVAISGRLLQILSDHGPLTVGNTWNHAKDAGIAGLNSKTHMKILLKWMTGRNVVKLTCVHVGNAKKFLYSPSTESSSSAGASPSSTSASQ

SEQ ID NO: 74733 - protein, 249 aa, Xanthomonas campestris pv. campestris str. ATCC 33913
MTRKLVLLRHGQSQWNLDNRFTGWVDVDLTEQGRQEAAAAGKLMKDEGLQFDVAYTSVLKRAIHTLQGALKELDQDWLPVHKSWRLNERHYGGLQGLDKAETAAKHGEEQVKIWRRSYDIPPPAMDVTDPGHPGHDRRYATLDRNALPGTESLATTLVRVLPYWHDAIAPQLKAGQTVLVTAHGNSLRALYKYLNDISNAQILELNIPTGIPLLFELDDNLQVQSYRYLGDPEAAKRAAEAVANQGKAK

SEQ ID NO: 74734 - protein, 493 aa, Oryza sativa
  misc_feature (25)..(25): Xaa can be any naturally occurring amino acid
MGWWPPAAWRRWGVVVVVVAALMAXVSATAAVEEELGGRESGVVAAAAQGRWPRHRHAYAAMMYMGTPRDYEFYVAVRVMMRSLARIGADADRVLIASADVPADWVRAMREEDGMRVVLVENMKNPYESNLGGINRRFKLTLNKLYAWTLVDYERVVMIDSDNIFLQKTDELFQCGQFCAVFINPCYFHTGLFVLQPSMDVFKGMLHDLEIGRANSDGADQGFLVGCYPDLLDRPMFHPPENGSKLNGTYRLPLGYQMDASYYYLKLHWHVPCGPNSVITFPSAPWFKPWYWWSWPILPLGLSWHKQRWDDLGYAAEMPVILMEILMYAVIITITRLAKPGMTKLCYNRRPEKQNAMVQGLIKMSAIVAMLIAYAIPFFIIPRTVHPFMGWSMYLFGALALGVLVSNAFLLPLLAVLTPWLAIIGMFFVMAFPWYHGGIVRVLAIFGYAFCSAPFLWASLVRVMDSLQTMLEREPFFPRLGEPAQETEFSKLF

SEQ ID NO: 74735 - protein, 966 aa, Oryza sativa
MVSAADAVIPACAAVGIAFAVWQWLLVSRVKVSPYSAAAAAARNGGAGRAVFRPEGEVDDDDGGCGDDEEADGDGGVAAMASGIGGGDAAEVVAKALSHPAATPSLPRRTRKATTAALGGQIEDDGVDGQIKEEEPLRGKGGEGRAVAVVSTAVGGCAGLGAPHQLRGGGGGRTTTAWTAAEVVWRSGRRQRSSGDGVDNGGGRGWRRRGRQRPSRLTTAPAALGAIKSLGEVVGDALRREMRRASGAETGKTSSGNTTSSFVHTTMAVPCGDQDSIRKVMTILGGANSFLFTQYKYLAAFTAVFAVVIFLFLGSVHRFSTESQPCQYTRGKACKPALANAVFSTIAFLLGAATSVASGFLGMRIATAANARTTVEARRGIGPAFAAAFRSGAVMGFLLASLGLLVLYVAIKVFGLYYGDDWEGLYESITGYGLGGSSMALFGRVGGGIYTKAADVGADLVGKVERNIPEDDPRNPAVIADNVGDNVGDIAGMGSDLFGSYAESTCAALFVGSISSFGADHNFAAVSYPLLISSAGLIVCLITTLFATDLYRVKTVDGVAPALKLQLLISTVLMTVGVLVVTFTALPHEFTMFDFGEVKRVKNWHLFFCVTIGLWAGLAIGFTTEYFTSNAYSPVRDVADSCRTGAATNVIFGLALGYKSVIVPVFAIAVSIYVSFTLASIYGIAVAALGMLSTVATGLAIDAYGPISDNAGGIAEMAGMSHRIRQRTDALDAAGNTTAAIGKGFAIGSAALVSLALFGAFVSRAGMAVINVLSPKVFVGLVVGAMLPYWFSAMTMKSVGSAALKMVEEVRRQFAAIPGLMEGRATPDYASCVRISTDASLREMMPPGALVLLAPLVAGTFFGVQTLAGLLAGALVSGVQVAISASNSGGAWDNAKKYIEAGASDHAKALGPKGSDAHKAAVIGDTIGDPLKDTSGPSLNILIKLMAVESLVFAPFFAAHGGLIFK

SEQ ID NO: 74736 - protein, 244 aa, Moritella sp. PE36
MFCGEQALGNPCGVVFLDEWLDSSKLLNITRSLSQPVTSFIVENALGYSIRWFSNTAEINLCGHGSLGAAAAILEKTGEERVLLQSQYGDIEITQQDSFYQMELPAWTPEFIHHGIDYQELNIDPIEVYATRDLVLVVESEQAVRDFIPNHAWFEKFADYHALIVTAQSDSYEYVLRYFAPRIGIPEDLATGSAQCSLAPFWFSKLSAHNLKVRQLSSAGGVFEVSFKDESTIRLSAQAMKRKA

SEQ ID NO: 74737 - protein, 147 aa, Vitis vinifera
MASFSSSILMPPASFTSKTLELGYASSSSLSCRCSLILTPLFIPQRKQMMFHKNRSKLKQRVLSMAPEEEKLTRRNPLDFPIEWNRPKPGRRPDIFPQFSPMKTPLPPPLPYDPPDEDEEEEEKKEEEEEEEEEDPEKEESDNPEKQ

SEQ ID NO: 74738 - protein, 225 aa, Rhodococcus sp. 4N4
GGNKLRKLEYIVPDALAQGADTLVSIGGVQSNHTRQVAAVAAKLGLKAVLVQEKWVDWPDSVNDKVGNILLSRIMGADVRLDPSGFGIEFKDSWQKAIEDVERAGGKPYAIPAGGSDHKLGGLGFANWAYEVQKQEEELGVFFDTIVVCSVTGSTHAGMIAGFAGQERPRRVIGIDASAKIAQTRDQVARIARNTAELIELGRELRDDEITVLESWAGDYYGISV

SEQ ID NO: 74739 - protein, 397 aa, Oryza sativa Indica Group
MAASTTRSSASCSASPSPSPRYPPPTRPALPLLAVRSSSSSAAARPRAVAVCSFGSGVAEDDTSIPAAVKVPILKEFHRHIYNRDWHYSCGTKDYKLLMDKFRLVSTAFLELGQGYQEAIEEITRLMGAGMAKFICKEFHVQFLAVLSVETVDDYNEYCHYVAGLVGYGLSRLFHAGGTEDLASDSLSNSMGLFLQKINIIRDYLEDINEIPKSRMFWPREIWSKYVNKLEDLKYEENSEKAVQCLNDMVTNALSHAEDCLQYMSALKDHAIFRFCAIPQIMAIGTCAICYNNVNVFRGVVKMRRGLTARVIDETNTMSDVYTAFYEFSSLIESKIDNNDPNASLTRKRVDAIKRTCKSSCSLKRRGYDLEKSKYNSMLIMVVLLLVAIVLGMIYAK

SEQ ID NO: 74740 - protein, 301 aa, Pantoea agglomerans
MNPDNPLLALRDKISAVDKKLLTLLAERRLLAVEVAQAKLATHRPIRDVERERALLENLIVLGKAHNLDAHYITRLFQLVIEDSVLTQQALLQKNLNHPHAHAARIAFLGPKGSYSHLAARNYASRHFDSMVECGCLKFHDIIKQVENGVADYAVMPIENTSSGSINDVYDLLQQTSLSIVGELTLPIDHCVLVNGPTDLQQIETVYSHPQPFQQCSQFINRFPHWKIEYTESTAAAMEKVAALNSPKVAALGSEAGGELYQLQVLERNLANQQQNHTRFIVLARKAIEVSDQVPAKTTLK

SEQ ID NO: 74741 - protein, 616 aa, Acidovorax sp. JS42
MAIIDIKVPDIGDFAEVGVIEVLVQPGDTIRAEQSLVTVESDKASMEIPSSHAGVVKELKVKLGDKVAEGSVLLTLEVAQGAAAPAAAPAAASTPSAPPSESKPAPAPAVQAPAAPKTEAASFGGSADVECDVLVLGGGPGGYSAAFRAADLGLNVVLVERYATLGGVCLNVGCIPSKALLHVAAVMDEVSHLKSAGIDFGAPQVHIDTLRGHKEKVIGKLTGGLAQMAKMRKVTVLRGYGHFVGANHLEVEETTGTGQDKTGSKKVVAFKKAIIAAGSQAVRLPFMPDDPRVVDSTGALALQGVPQKMLIVGGGIIGLEMGTVYSTLGARLDVVEMMDGLMQGADRDLVKVWEKMNKHRFDNILLKTKTVGAQATPEGIQVQFEGLDGTKSEGTYDLVLQAVGRTPNGKKIAADKAGVSVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWAASGRAIANGRDEGFTKLLFDDSPEAHGHGRILGGGIVGTHAGDMIGEIALAIEMGADAVDIGKTIHPHPTLGESIGMAAEIAHGSCTDVPPQRR

SEQ ID NO: 74742 - protein, 237 aa, Triticum aestivum
  misc_feature (28)..(28): Xaa can be any naturally occurring amino acid
MCRLRDYTPAWPVIRAPWMDTLKIPLAXVEHATLDDVSVWEWSGSAYDEGAEAAEWLSTYFGKPCRLVCFKEESEIRPTNPEYAQGYKITFTDCFPFLIASQGSLDALNELLKEPVPINRFRPNILVDGCHPYAEDLWKTMKINKLTFDGVKLCDRCKVPTINQENGIPGSEPTETMLTFRSGEVIRPSHKNKQKVYFGQNLVCKESVSAKGKGRIVKVGDPVYVLQTYPCSDEVPA

SEQ ID NO: 74743 - protein, 140 aa, Zea mays
  misc_feature (9)..(9): Xaa can be any naturally occurring amino acid
  misc_feature (48)..(48): Xaa can be any naturally occurring amino acid
  misc_feature (66)..(66): Xaa can be any naturally occurring amino acid
ELVSELCAXETGANQDDALARIEKLSKVNPMLGFRGGRLGILNPGLAXIPTPANFEACLTMTNHCXGNTLTPWLDKGSQKIWFLLAEPPQNLGHKGILFIQVMKKGSAMVGKIFGTKVGQWMQIPRPVLEVKKIGNKANF

SEQ ID NO: 74744 - protein, 271 aa, Arabidopsis thaliana
MGYAQLVIGPAGSGKSTYCSSLYEHCETIGRTMHVVNLDPAAEIFNYPVAMDIRELISLEDVMEDLKLGPNGALMYCMEYLEDSLHDWVDEELENYRDDDYLIFDCPGQIELFTHVPVLKNFVEHLKQKNFNVCVVYLLDSQFITDVTKFISGCMSSLAAMIQLELPHVNILSKMDLLQDKSNIDDYLNPEPRTLLAELNKRMGPQYAKLNKALIEMVGEYGMVNFIPINLRKEKSIQYVLSQIDVCIQFGEDADVNIKDDDDFSDDGPDL

SEQ ID NO: 74745 - protein, 140 aa, Zea mays
MPIPVDSTRPKYTCQIRFQFSPPLDTAHEARTKPTQLPSVSTAADDEPRNPTHRTTTRTDRRASERASEMAGRLTAAGFRVLGGGGARAAAAAAALRHRAGMGLPVGRHIVPDKPVSLPHPESRSKSDPRSCVLSSSARQ

SEQ ID NO: 74746 - protein, 250 aa, Acidovorax sp. JS42
MKRVENKVILVTGGAMGMGRSHSELLAAQGAWVFVADVNATEGQATVDSIRKNGGKADFLELDVTQEAQWNAALAQITERAGRLDVLVNNAGILILKPMQDTTNEEWDRVFDVNVRGLFIGTRAAVPLMQKAGGGTIVNVSSIYGLVGAPGASAYEASKGAVRLFTKSCAVDLAPFNIRVNSVHPGVIETQMTKAMLDDPIIRPALLGPTLLKRPAQPIEVSQAVLFLASDESSFVHGAELVVDGGYTAN

SEQ ID NO: 74747 - protein, 334 aa, Chromobacterium violaceum ATCC 12472
MKLAILGAGAWGSALAIAFARHHQVTLWARDAEQIRQLGEERVNRRYLPDCPFPEQLKLSSDLAEAAHDAELVLIVTPMAGLRPTLKALTALDAPLPPILWACKGFEAGSSLLPHQVAEEELPADHLYGALSGPSFAREVAQGLPAAVTIASDHAEFAASVARELHSPLLRLYANDDLVGVEVGGAVKNVMAIATGVADGLDFGMNARAALITRGLAEITRLAMALGASPQTMMGLSGMGDLILTCTGALSRNRQVGLKLAEGKPLQQVLEELGHVAEGVATAREVLTMAERLQVDMPITAAVCGLLYQGHDPQQVVDGLLRRSPKSESGGLLD

SEQ ID NO: 74748 - protein, 583 aa, Azoarcus sp. EbN1
MSELIEVKVPDIGDYADVPVIELFVKPGDTIKVEDPIATLESDKATMDVPSTAAGVVREVLVQVGDRVAEGKVLIKVEAAGAENTAAPEAAGNAAAQATPASSGAALEQSEASAPSAASAATASAPTPTPTSAPAATGGSTEVRVPDIGDFSDVPVIELFVKVGDTIKVEDSIATLESDKATMDVPSSAAGVVREVKIKVGDRVSEGAVLIVVDSAAGAATAPAPAATPATARIAAADATPADAPEAFEQSKLSAPAAGQAGAPSAVALGGRVHASPSVRAYGRELGVDLAQVRATGPKGRVVREDVTAFVKGAMQTGIVPGKAAAAGAGVSLGGGLDLLPWPKVDFSKFGEIETKPLSRIKKISGQNLARNWVMIPAVTYHEDADITDLEAFRVAINKENEKSGKKLTMLAFIIKASVRALQQFPEFNTSLDASGGEMSLVYKKYFNIAFAADTPNGLVVPVIKNADRKSVFEIAAESGELAKKARDGKLGPADMSGACFTISSLGGIGGTYFAPIVNAPEVAILGVNKSAMKPIWDGKQFVPRLTLPMSLTADHRVIDGALATRFNVYLAQLLSDFRRVML

SEQ ID NO: 74749 - protein, 615 aa, Azoarcus sp. EbN1
MSQIVEVKVPDIGDFSDVPVIELFVKPGDSIKVDESICTLESDKATMDVPSSAEGVIREVLVKVGDRVGEGAVLLKVEPQGAGAAPAGAGEAKPVPAAAAPAASPSPSAAAPAQTAAKSGAYAGSVDLECDMLVLGAGPGGYSAAFRAADLGLKTVIVERYATLGGVCLNVGCIPSKALLHVAQVMDEAEHMAVAGIKFAKPEVDLDALRAHKDKVVGKLTAGLAGMAKGRKVEVVRGLGTFLDANHLEVELSSGSGQDKTGEKKVVRFKQCIIAAGSAAVHLPFIPKDPRIVDSTGALELRTSDGKAPAKMLVIGGGIIGLEMATVYSTLGTRVDVVEMLDALMQGPDRDAVKVWEKQNAQRFDNIMLKTKTVAVEAKDDGLWVTFEGEKAPQGPQRYDMILQAAGRSPNGKKIGADRAGVVVTDRGFIEVDAQMRTNVPHIFAIGDVNGNPMLAHKAVHEGHVAAEVAAGETQGKSELARSAFDATVIPSVAYTHPEVAWVGFTEEQAKKEGRKVETAKFPWAASGRAIANGADYGFTKLIFDAETHRIIGGAIVGPSAGDMIGEVCLAIEMGADAVDIGRTIHPHPTLGETIGLAGEVAHGSCTDIPPMRKK

SEQ ID NO: 74750 - protein, 397 aa, Wolbachia endosymbiont strain TRS of Brugia malayi
MTISPILPVYSPININFSYGKGIYLYNIDGKRYIDFHSGIAVSSLGHTNLQLTSVLNLQGERLWHISNTYNIPTANNFAEKLINNSFADTVFFANSGSEAVECGLKIARVYQNGKGNKNRYRILTFHGAFHGRTFLTCATNDKRKFSELLNPYIDWCDNIEPNIESVKKAISNDIGVMLIEPIQGQGGIKVMNDAFMKELRKLCDENDILLFFDCIQCGTGRTGKLFAYEHIGVKPDICALAKGIGGGFPLGVCLATEKAAQYITVGMHGSTFGGNPLATSVGNAVLDKLLSPGFLGNVEIRGKHLKNKLEDLASKFPIIEEVRGKGLMLGIKVKMDNQKFAGELSHRGLLTVGATSDNVVRIFPPLIITEKEIDEGIEILTQYLSEKSSDPYQYER

SEQ ID NO: 74751 - protein, 158 aa, Streptococcus pneumoniae TIGR4
MRRMLTAKLQNRSGVLNRFTGVLSRRQVNIESISVGATEDPNVSRITIIIDVASHDEVEQIIKQLNRQIDVIRIRDITDKPHLEREVILVKMSAPAEKRAEILAIIQPFRATVVDVAPSSITIQMTGNAEKSEALLRVIRPYGIRNIARTGATGFTRD

SEQ ID NO: 74752 - protein, 134 aa, Brassica napus
  misc_feature (122)..(122): Xaa can be any naturally occurring amino acid
  misc_feature (130)..(130): Xaa can be any naturally occurring amino acid
MVLSHAASDSDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLGETETAVGVXGTVGSSEXIMLA

SEQ ID NO: 74753 - protein, 416 aa, Streptococcus pneumoniae TIGR4
MLSSKDIIKAHKVLNGVVVNTPLDYDHYLSEKYGAKIYLKKENAQRVRSFKIRGAYYAISQLSKEERERGVVCASAGNHAQGVAYTCNEMKIPATIFMPITTPQQKIGQVRFFGGDFVTIKLVGDTFDASAKAAQEFTVSENRTFIDPFDDAHVQAGQGTVAYEILEEARKESIDFDAVLVPVGGGGLIAGVSTYIKETSPEIEVIGVEANGARSMKAAFEAGGPVKLKEIDKFADGIAVQKVGQLTYEATRQHIKTLVGVDEGLISETLIDLYSKQGIVAEPAGAASIASLEVLAEYIKGKTICCIISGGNNDINRMPEMEERALIYDGIKHYFVVNFPQRPGALREFVNDILGPNDDITRFEYIKRASKGTGPVLIGIALADKHDYAGLIRRMEGFDPAYINLNGNETLYNMLV

SEQ ID NO: 74754 - protein, 163 aa, Brassica napus
FSSLSLVSAMSHAKSREDANGECRDSKSRVTIVGSGSWGSVAAKLVASNALKLPSFHDEVRMWVFEEVLPNGEKLTDVINKTNENANYLPGIKLGRNVVADPDLENAVKEANMLVFVTPHQFMDGICKKLKGKIKGEVEAISLVKGMEVKKEGPCMISNLISK

SEQ ID NO: 74755 - protein, 233 aa, Triticum aestivum
MAAAAVDPMVLGLGTSGGASGSGVVGGGVGRAGGGGAVMEGAQPVDLARHPSGIVPVLQNIVSTVNLDCRLDLKQIALQARNAEYNPKRFAAVIMRIRDPKTTALIFASGKMVCTGAKSEEHSKLAARKYARIVQKLGFPATFKDFKIQNIVASCDVKFPIRLEGLAYSHGAFSSYEPELFPGLIYRMKQPKIVLLVFVSGKIVLTGAKVRDEIYAAFENIYPVLTEYRKSQQ

SEQ ID NO: 74756 - protein, 514 aa, Triticum aestivum
MGLVWLVAAAVAVVLASWAFNALVYLVWRPRAITRQLRAQGVGGPGYRFFAGNLAEIKQLRADSAGAALDIGNHDFVPRVQPHFRKWIPIHGRTFLYWFGARPSLCVADVNTVKQVLSDRSGLYPKSIGNPHIARLLGKGLVLTDGDDWKRHRKVVHPAFNMDKLKMMTVTMSDCAGSMMSEWKAKMDKGGSVEIDLSHQFEELTADVISHTAFGSSYEQGKKVFLAQRELQFLAFSTVFNVQIPAFRYLPTEKNVKIWKLDKEVRTMLMNIIKGRLATKDIMGYGNDLLGLMLEACAPEDRQNPLLSMDEIIDECKTFFFAGHDTSSHLLTWTMFLLSTHPKWQEKLREEVLRECGNGVPTGDMLNKLQLVNMFLLETLRLYAPVSAIQRKAGSDLEVGGIKVPEGTVLTIPIATIHRDKEVWGEDANEFKPMRFENGVTRAGKHPNALLSFSSGPRSCIGQNFAMIEAKAVIAVILQRFSFSLSPKYVHAPMDVITLRPKFGLPMVLKSLEM

SEQ ID NO: 74757 - protein, 472 aa, Blumeria graminis f. sp. hordei
MPTFGFLKKRKKVSLGHRDLDSPASTLSQPASPITPSTSRGLGEPIDTTSSKITSPGQKLGSNITKDHRGTRTTVEDLPSMTDVSHLQQAYRNLSQGSTASKSNLLTIHNLINPPQHDGAGQSKVMPEKHMNNKTERPVQGKAAVAQVRQTKGKYSLSDFEILRTLGTGSFGRVHLVQSKHNQRFYAVKVLKKQQVVKMKQVEHTNDERSMLQEVKHPFLITLWGTFQDSKNLYMVMDFVEGGELFSLLRKSQRFPNPVAKFYAAEVTLALEYLHKKDIIYRDLKPENLLLDRHGHLKITDFGFAKKVTDITWTLCGTPDYLAPEVVSSKGYNKSVDWRWSLGILIFEMLCGYTPFWDNGSPMKIYENILKGRVKYPPYIHPDAQDLIQRLITADLTKRLGNLHGGAEGIKSHQWFAEVTWERLAKKDIDAPYVPPVKAGSGDASQFDKYPEETERYGQTGPDEHGSLFENF

SEQ ID NO: 74758 - protein, 510 aa, Pseudomonas syringae pv. tomato str. DC3000
MGIRELKSALPRELLASVVVFLVALPLCMGIAIASGMPPAKGLITGIVGGLVVGWIAGSPLQVSGPAAGLAVLVFEVVREHGMAMLGPILLLAGLLQLLAGRFKLGCWFRVTAPAVVYGMLAGIGVLIVLSQAHVMFDSGPKPSGLDNLIGFPATLVQAIGPGTGMQAGMLGLGTMLIMWGWEKLRPQSLRFVPGALLGVGIATGISLFMALQVKRVEVPDNLADAIDWLRPADLMNLADPAILVAAIVVAFIASAETLLSASAVDRMHSGERSDFDKELSAQGVGNMLCGLLGALPMTGVIVRSSANVQAGAKTRYSTILHGTWLLAFVLLLSSVLQSIPVASLAGVLVYTGLKLVDLKAFRGLGRYGRMPMFTYAATAVAIVFTDLLTGVLIGFGLTLVKLAFKASRLKINVVPLAGEKECELRLVGAATFLKVPALTQALATIPQGSTVHVPLGNLSYIDHSCLELLEEWGRSNAANGTRLLIEPRGLKRRLEGRVYTTTGIGSGAT

SEQ ID NO: 74759 - protein, 402 aa, Arabidopsis thaliana
  misc_feature (359)..(359): Xaa can be any naturally occurring amino acid
MMRSVDVYVKTLGPPVRSILYSIFTSQQKPSSLPSLPFHFSLRSSSNIPTRCFSNVVAKSNSPIYDFQGFRNLFTERAISSSTTTPVASAQPQQLQNQNQHPAEVDEEISMGLEDEAKLSIPVRAYFFSTSVDLRSLIEQNKQNFIPPTSRMTNYVVLKFGNHSDLTDTTRGRISGSESIYMVVFHYGSIVLFNVREHEVDEYLKVVERHASGLLPEMRKDEYEVRENPNLDTWMEVGRDFIRLQFLNTDGIRTIGCVLGQSIALDYYGRQVDGMVAEFTEINRQLEITGTFTMKRKKLFQLVGKANVILADVILKLGLFERSDIAWKDAKYGQIWEFLRDEFELTQSFANLDYKLKFXEHNVRFLQEILQNRKSATLEWLIIILISMEIAISFYNMSRASL

SEQ ID NO: 74760 - protein, 385 aa, Aquifex aeolicus VF5
MKLHEHQAKEIFAKYGIPVPEGKVAFSLKEAKEVAEELGEFPLVVKAQIHCGGRGKAGGVKIVKDMDELEKAVESLLGKVLKTFQCPDGKPVNRVLIEKATNIDKEYYLAITLDRSKSKPVIMASAAGGMEIEEIVKENPEAIIIETIDPELGLMPYQARELAFKLNLPVKEFASIALKLYQIYSDLDASLVEINPLVLTKEGNLIALDAKLDIDDNALFRHKDLEEMEDETQLPQLEVEAKKYGLNYIKLNGNIGCMVNGAGLAMATMDIIKLAGGEPANFLDVGGGANVEQIANAFRILMADPDVKAVFINIFGGILRVDRLAQGLIEASKMVELRVPIVARLEGTNVEEGKRMLQESGLNFIIAEDMWDGAKKAVEIANKQS

SEQ ID NO: 74761 - protein, 339 aa, Pseudomonas viridiflava
MSTAKQNPAAAPAVKKKLTTSAMIASIASEGQATRSAPFGHALAALADQRSDIVGLSADLSKYTDLHIFAKAHPERFYQMGMAEQLLMSAAAGMAREGCVPFATTYAVFASRRAYDFICMAIAEENLNVKIVCGLPGLTTGYGPSHQATDDLAIFRAMPNLMIVDPCDALEIEQAVPAIAAHQGPVYMRLLRGNVPLVLDEYGYQFEIGKAKTLRTGNDVLIISTGLMTMRSLEAAKELQADGVDVAVLHVPTIKPLDEQTILAEARKPGRLVVTAENHSIIGGLGEAVATVLLRNGVTPTFRQIALPDAFLDAGALPTLHDRYGISTPAVCAQIKAWL

SEQ ID NO: 74762 - protein, 212 aa, marine gamma proteobacterium HTCC2080
MEKIGDECLMIVAITGASGSGKSTLAQSLVKSSLSVASGPAACLLSLDAYYRDLSHFSLAQREGVNFDRIEAIDLPLFCEHLSKLKSGGQIEVPRYDFSKHTRIADHTDVLGPAQLVVVDGLLLGAWAELTSNVDYTIFVDTPTNVCLQRRLQRDCGERGRSEASVHEFWNSRVLPEFQRWGEGAKRRADLVVSGEVPTALATAEVWDALSF

SEQ ID NO: 74763 - protein, 959 aa, Aspergillus nidulans FGSC A4
MRSRIPNILKPWGRQETQGDTPVVRRNRNQLPMLHLADTTRNNLIAMTGEFVGTFLFLFFSFAGTQVANTPKPVEGAPPNTDALLYSALAFGFSLMVNIWAFYRVTGLLFNPAVTLALCLVGGMPAYRGLFVFAAQIVGGIAAAGVVSALFPGDLNVSTRLGGGASISQGLFIEMFLTAQLVFVIIMLAVVKHKGTFLAPVAIGIAFFVTEMIGDYYTGGSLNPARSLGPDVINRSFPGYHWIYWVGPLLGSLLACGFYYFLTFFSYESVNPGQDFNEWEAKWGPGPTSWDSSMRQHSHSDTTTLNRGMSPRDSRAARNGNGDWNGAHGAHVPPPPGEEQSHSPPISFAHETPGYKPWLDQRRSLELLAWHLLNRGVGVPTHRETRRASLISFPPLLPFTIFISIHAAHLSIVATMGKQTDVRPPSPGLGDTYDQQLLAKLGYKQELRRSYSTLQIFAIAFSIMGLVPSIASTIPFSLPAGPAGMVWGWLTASILIFTVGLAMSDMASSMPTAGGFYWWTHYFAGKKFKRPLSFLVGYSNTLGLIGGICSVDYTLSLLILACISIARDGNWSASNGIIYGLYAGLILVHSVATIVTSNIMPRIQTACIFINVGLIIATVVALPVGKVTRGGTLNSGSFVFGHIDNLSNWPTGWNFVLAFMSPIWAIGFFDSCVHMSEEARDAPKAVPRGILFSAGSACLLGFLVLSVLAAVMDPDVAKTAGTVYGQPMAQIYYDSLGKRGALGFMAVLILIQFLIGLSLIVAASRQVFAFSRDYALPFSPILRKITSLNGQPQPINAIVFLGGICVIFGLLALINSVAANALFSLFVASNYVAWGTPILCRLIWSKRFVPGAFYTGPKVSSIIAGIAVAWLGFGLLLSMFPTVKNPGPAEMNYTVVINGFVWIASMLYYAVYARKVFTGPRVTLAEGEGVSSSFIGTQAEAAREVNNEKEVGTDTSPAG

SEQ ID NO: 74764 - protein, 470 aa, Yersinia pestis CO92
MKKTKIVCTIGPKTESEEMLTNLLNAGMNVMRLNFSHGDYAEHGQRIKNLRAVMAKTGKKAAILLDTKGPEIRTMKLEGGKDAALVAGQTFTFTTDQSVVGNDKIVAVTYPGFAADLKIGNTVLVDDGLIGMEVIEVTEHTVVCKVLNSGDLGENKGVNLPGVSIQLPALAEKDKGDLIFGCEQGVDFVAASFIRKRSDVLEIREHLKAHGGEHIQIISKIENQEGLNNFDEILEASDGIMVARGDLGVEIPVEEVIFAQKMMIEKCNRARKVVITATQMLDSMIKNPRPTRAEAGDVANAILDGTDAVMLSGESAKGKYPLESVTIMATICERTDRVMPSRIESLNDNRKMRITEAVCRGAVETAEKLEAKVIVVATGGGKSAKSVRKYFPTATILALTTNEMTAHQLILTKGVITQLVDEIASTDDFYRLGKEAALASGLAQKGDVVIMVSGALVPSGTTNTSSVHVL

SEQ ID NO: 74765 - protein, 208 aa, Corynebacterium glutamicum ATCC 13032
MSNGFQMPTSRYVLPSFIEQSAYGTKETNPYAKLFEERIIFLGTQVDDTSANDIMAQLLVLEGMDPDRDITLYINSPGGSFTALMAIYDTMQYVRPDVQTVCLGQAASAAAVLLAAGAPGKRAVLPNSRVLIHQPATQGTQGQVSDLEIQAAEIERMRRLMETTLAEHTGKTAEQIRIDTDRDKILTAEEALEYGIVDQVFDYRKLKR

SEQ ID NO: 74766 - protein, 183 aa, Gloeobacter violaceus PCC 7421
MSDTLTLKDEAGRTLACELVTELEIDGSQYGLVVPQATPVRLMAWEAAEGDDDTEEEDALLADLDDEEIERVFPTARAVLAEQDLKLVDSAYLLIVEGDIPNAEEAEVYSIADDEDGEEMEEEEYQLLEEFFFEDRRYGIFTPLDPVMLFVELPEGGEPRVLEPEETARLMPNFEEALLDLAE

SEQ ID NO: 74767 - protein, 458 aa, Gloeobacter violaceus PCC 7421
MLRSLTLAWGGDQCFCNIEYSCLNPFVKGRSMVTSLNDSPSPAYICPNDMACSNLDRAAQILRLDPGVVEVLGTPHRVLTVSVPVRMDNGRIRVFAGHRVQHCNVLGPYKGGMRYHPDVTLREVSTLAMLMTWKCALMGIPYGGAKGGIAVNPTTLSVGELERLTRRFTSELVRDIGPQIDIPAPDVGTGPREMAWMMDTYSMSIGHASPGVVTGKPLSIGGSKGRDAATGRGVVIATREALDTAGLALRGATIAIQGFGKVGKAAALIFQQHGARVIALSDGSGGIYNPDGLDIEQAADFVRDGSRLAQYPFPGVKPIANPELLTLPCDVLVPAALEHQITEANAARVRARLVVEAANAPTTMEADRILEERGVTVLPDILANAGGVVVSYLEWVQGLSYLFWDEEKVNLELEKLMVGAYARVLQQATQFRLPLRPAAYTLAVGRVVEAFNHRGLYP

SEQ ID NO: 74768 - protein, 380 aa, Clostridium perfringens str. 13
MNKNVIGIEISGIRKFYNEVVKFPEAISLTLGQPDFPVPEKVKEAMIRAIEEGKTTYTANAGIVELREEISSLLKNNFDIDFSKDEIIITVGGSEGLYAAMTALLNPGEKVLVPSIAYPAYESISKIIGCEVINYDLNEDFSVNIESLKEGIKEGGKLLVLSYPCNPTGALLSKKSRDELIEIIKENDILVLTDEIYSSLCFEEEYYSVAQCKDIKEKIIYVSGFSKMFSMTGLRIGYVACPKKIYDQIIKVHQYNSSCATSISQWGALEGLKSCMNDVENMKESFKERMNFTYKRLKSMGLEVEKPKGAFYIYPNISKFGLTSEEFCHRLLKEGKVACVPGDAFGKGGEGYIRISYCYSKDELERALDKLEAFVKTLKK

SEQ ID NO: 74769 - protein, 257 aa, Leptospira interrogans serovar Copenhageni str. Fiocruz L1-130
MKYTIGIAGCGNMGGAIYFSLKERYPTQVLGYDPYIISNQKIELISSWDEFVSKSDLILVCVKPGKVIELLRQIKVPKKIISVAAGIHIDTILKNLPTGSNVVRVMPNLPLLVSEGAIGFFGDEELYETVSEIFQPLGHSVKLGSETLMDAVTGLSGSGPAYVFKFIQALAEGGVLSGLGYQEALDLSIQTVIGSAQLLRKEREKDPTTHPEVWKNKVTSPGGTTIAGLVELEKNGFSNAVLEAVKAAANRSKELGV

SEQ ID NO: 74770 - protein, 175 aa, Gloeobacter violaceus PCC 7421
MKHTLSVLVEDEAGALTRIAGMFARRGFNIESLAVGSAEQSGTTRITMVVAGDEQAVEQITKQLHKLINVLRVQDITTIPCVERELMLIKVNATTATRSEIIELATVFRARIVDVAEESVTVEVTGDPGKMVAIIQMLTRFGIKEIARTGKISLTRESGVNTEFLRTQPPAATRV

SEQ ID NO: 74771 - protein, 738 aa, Oryza sativa Indica Group
MGSSSVVLWWEEWQLRILVLGSLFLQCFLAFAAVHRRRSIPASLRFFIWLAYLGSDALAIYALATLFNRHKTDNQGGSHVLATLVSPQGKGGGDDTGLEVFWAPVLLLHLAGPDSITSYNIEDNELWRRHVLTVISQVTVSLYVFCKSWSGENKLLRAAVLLFIAGTLKCIDKPMALKSASIYGLVTSSPFHDQKSQNNDQGENRSLEAYIQEAKGYFSNLKINDVYTELVAAAQNKDLRVMPFWLFVDLASTLCHRLRVLRFFLVLDNKSADSLLQTALCGSFVRLYTKKSMLLSYFWAKDKRNALISTYSHLNRLLAVCLTISAVALFHQSHKQGYNNSDVKVTYTLLWCTAALEVYALFGPKYKFFTWCKNVAQYNLVGFFARDQTPTRLLKLASCFWCKDYVDQHWYVNQCSSSFAITELVIEQVKDGWKNYIEDTSTYWMFNDRRGQLTIQHELCDEELCKSLDVPFDESIIVWHIATDICFYEGAPAANHHHLKAATRCREISNYMLYLLVVNPDILMSGTRANILSNTCKELRSMFEDEKPPSDESDLTREIHRRAQSSNVDAAATEELIPRASKLASQLLAMDGDKRWKVMQGVWVEMLCFSASRCRGYLHAKSLGQGGEYLSYVWLLLWYMGLESVAERQQRSDFRSHVERVASRQLPCTETESSQEPEIQEEEGAVVPLFQEGDIGVAVRSNVEDEEAGAVTLEIQDDEEAATTAHASKATVPGDNNV

SEQ ID NO: 74772 - protein, 260 aa, Oryza sativa Indica Group
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTTFVAGNDFAQVEFNRLPLGRLGKPEDISSLVAFLCMPAASYITGQIICVDGGRMLS

SEQ ID NO: 74773 - protein, 248 aa, Listeria monocytogenes EGD-e
MNKVALVTGSSRGLGREIAIALAKEGYDIAVNFSRNRKKAEEVQQEIEQLGRKCVIFKANVGDVEKVRELFKAVDEEFGRLDIFINNAASGVLRPLMELEESHWDWTMNINAKALLFAGQEAAKLMQRHQSGKIISLSSIGSIRYLENYTTVGVSKAAVESLTRYLAVELAPFGIAVNAVSGGLIETDALNHFPNREELLKDAVSKTPAGRMIEPNDLVNAVLFLASEKADMIRGQTILVDGGRTLLV

SEQ ID NO: 74774 - protein, 591 aa, Vigna radiata
MSKQTYSFCFCFRRRFSLPVSEAPPEIRTLFDRYSDENGIMTASHVRSFLVEVQKEESVTEEEAQAIIDGHKHLSIFHRRGLNLESFFNYLFSSNNNPPLSPSLGVHQDMSSPLSHYFIYTGHNSYLTGNQLSSDCSDVPIIKALQKGVRVIELDIWPNESKEDVDVLHGRTLTSPVALIKCLRSIKQYAFVASEYPVVITLEDHLTPDLQAKVAEMITQTFGDILFSPGSESLKEFPSPKSLKRRIIISTKPPKEYIEAKEVQEKGEGSQKEKPVDDEEAWGKEVPSLRGGTISDHKNIEDEDDLDNEDDTDEAEYSRQNASDEYRRLIAIHAGKPKGGLTECLKVDPDTVKRLSLSELQLEKAAETHGKEIIRFTQRNILRVYPKGTRIASTNYNPLIGWMHGAQMVAFNMQGYGRSLWLMQGMFKANGGCGYVKKPDFLLKTGLNNEVFDPKARLPVKKTLKVTIYMGEGWFHDFKHTHFDQYSPPDFYARVGIAGVPYDTVMKKTKSVEDNWSPSWNEEFKFPLSVPELALLRVEVHEYDMSEKDDFGGQTCLPVWELRSGIRAVPLYSRKGEKYHNVKLLMRFEFI

SEQ ID NO: 74775 - protein, 500 aa, Rhodococcus sp. RHA1
MVQELSHFVGGKRVPGASNKFGDVYDPNTGEVQARVPLADKAETEAIIANAVDAQREWALFNPQKRARVLMKFLQLVQEEMDSLARLLSSEHGKTIPDAKGDIQRGLEVIEFALGAPHLLKGEYTESAGTGIDVYSMRQPLGVVAGITPFNFPAMIPLWKAGPALAAGNAFILKPSERDPSVPLRLAELFLEAGLPAGVFNVVNGDKEVVDVLLTDDRVKAVGFVGSTPIAQYIYETAAAHGKRAQCFGGAKNHAIIMPDADLDEVADALIGAGYGSAGERCMAISVAVPVGEETADALVAKLTERVGKLTIGRSDDESADFGPLVSKDALERVNNYIQIGIDEGAEAVIDGRGFTLEGHENGFFAGATLFDKVTTDMRVYKEEIFGPVLLVARAADYEEALRLPTEHEYGNGVAIFTRDGDTARDFTNRVNVGMVGVNVPIPVPIAYHTFGGWKRSGFGDLNQHGPDSFRFYTKTKTVTQRWPSGKKEETNHFVIPTMN

SEQ ID NO: 74776 - protein, 320 aa, Pelargonium x hortorum
MEKFPVINLEKLNGEGRAETMDKIKDACENWGFFEVLNHGIPYELLDTVEKMTKEHYKKCMEQRFKEMVTSKGLDGVEAEVEDMDWESTFFLKHLPESNISQVPDLQDNYRKVMKEFALKLENLAEELLDLLCENLGLEKGYLKKAFYGSKGPTFGTKVSNYPPCPKPDLIKGLRAHTDAGGLILLFQDDKVSGLQLLKDGNWVDVPPMHHSIVINLGDQLEVITNGKYKSVEHRVIAQSDGTRMSIASFYNPGSDAVIYPAPALLAKETEEKQVYPKFVFEDYMKLYSGLKFKAKEPRFEVMKAREDNINVTLDPIATS

SEQ ID NO: 74777 - protein, 463 aa, Chromobacterium violaceum ATCC 12472
MPGEQQTLHRGLEERHINLMALGATIGVGLFLGSATAIKMAGPAIMLAYGLGGLAIFMIMRALGEMAIHNPVAGSFSRYAQDYLGPLAGYLTGWNYWFLWLVTCMAEITAVGVYMGIWFPDVPSWYWALAAMLAMGGVNFIAVKAYGEFEFWFALIKIVTIVLMIAGGFAMIAFGFGNHGVATGISNLWAHGGFMPNGFSGVLMSLQMVMFAYLGVEMLGLTAGEAKNPKKALARAVDSVFWRILIFYVGALFVILSIYPWNELGTRGSPFVLTFESMGIPAAAGIINFVVLTAALSSCNSGIFSTGRMLFNLAEQKQALPIFAHVSKRGVPVPALLMSVAALLLGVLLNYLAPKEVFTWLTAISTFGAVWTWLIILLAQLRFRRSLSADELASISHRMPLWPYGSYLTLGFLALVIGLMAYFPDTRVALIVGPGWLVFLVAAYYLLGYHKQDAAWRLAQQSR

SEQ ID NO: 74778 - protein, 364 aa, Photobacterium leiognathi
MALSSAKEIIDDIRQGRMVILMDDESRENEGDLVIASEMITPEAINFMATNGRGLICLTLSKDRCKTLNLPLMVQGNNDKFSTPFTISIEAANDVTTGISAFDRAKTVLAAVAPNAKSTDIVMPGHVFPLMAQDGGVLIRAGHTEAGCDVARLAGLEPSSVIVEILNEDGSMARRPQLEIFAEKHGLKLGTIADLIEYRTQQESHIERISEYDLNTEYGIFTLVAYRDTLDDQVHFALCKGEIQAKATTLVRVHVKDTLKDILQIGLSQWSLETAMQRIQKEGGVLVIINQQEPPKTLFDKLDMYVKEQPNSPPSGIVQSRNIGLGSQILANLDVKKIRLLSNSNQNYRALSGFGLEVVEYIYD

SEQ ID NO: 74779 - protein, 594 aa, Triticum aestivum
MGGEVPEPRRLSRALSFGVPDEALHLVMGYVDAPRDREAASLVCRRWHRIDALTRKHVTVAFCYAADPSRLLARFPRLESLALKGRPRAAMYGLISDDWGAYAAPWVARLAAPLECLKALHLRRMTVTDDDVATLIRSRGHMLQELKLDKCSGFSTDALRLVARSCRSLRTLFLEECVITDEGGEWLHELAVNNSVLVTLNFYMTELKVVPADLELLAKNCKSLLSLKISECDLSDLIGFFEAANALQDFAGGSFNEVGELTKYEKVKFPPRVCFLGLTFMGKNEMPVIFPFSASLKKLDLQYTFLTTEDHCQLISKCPNLFVLEVRNVIGDRGLEVVGDTCKKLRRLRIERGDDDPGLQEEQGGVSQLGLTAVAVGCRDLEYIAAYVSDITNGALESIGTFCKNLYDFRLVLLDRQKQVTDLPLDNGVRALLRSCTKLRRFALYLRPGGLSDIGLDYIGQYSGNIQYMLLGNVGESDHGLIRFAIGCTNLRKLELRSCCFSEQALSLAVLHMPSLRYIWVQGYKASPAGLELLLMARRFWNIEFTPPSPEGLFRMTLEGEPCVDKQAQVLAYYSLAGQRQDCPDWVTPLHPAA

SEQ ID NO: 74780 - protein, 156 aa, Photobacterium leiognathi
MKIIEGGLPAPHARIAIIVTRFNSFINENLLSGAVDALQRKGEIKAENITIIRCPGAYELPLAALQIAKQNNYDAIIALGSVIRGGTPHFDFVASECNKGLAHVALKYQIPVAFGVLTVDSIEQAIERAGTKMGNKGEEAALSALEMINVLIEIAP

SEQ ID NO: 74781 - protein, 507 aa, Saccharomyces cerevisiae
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGADPFGSILAQPENLNKTDITDYKVEGIGYDFVPQVLDRKLIDVWYKTDDKPSFKYARQLISNEGVLVGGSSGSAFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLNYLA

SEQ ID NO: 74782 - protein, 226 aa, Achromobacter xylosoxidans
GGNKLRKLEYLIPQALEQGCDTLVTIGGIQSNHTRMVAAVAAKLGLACVLVQENWVDYSDAVYDRVGNIMMSRLMGADVRLVDQGFDIGFRRSWEEALEEVKRRGGKPYAIPAGASDHELGGLGYVGFAEEVRRPEADLGFKFDYIVVCAVTGSTQAGMVVGFAADGRADRVIGIDASATPEQTRAQVLRIARRTADLVGLERPIEDKDVVLDTRYAYPAYGLPSA

SEQ ID NO: 74783 - protein, 197 aa, Photobacterium leiognathi
MVTVRARVSFKVGQHSHIPAELLSFNGFKSNKEHVAIVFKNADKTSNPIVRLHSECLTGDVFRSSRCDCGEQLNETIMKMQQQGGIILYLRQEGRGIGLYNKIDAYQLQSQGMNTYEANNHLGFANDLRDFTEAAQALAALNIKSIRLVTNNPLKIKELTKYGININEVISTRVYIKEDNRNYLTAKSLYGNHKLII

SEQ ID NO: 74784 - protein, 559 aa, Rhodococcus sp. RHA1
MSTATEVLVHGLGVSPGLVCAPWLAFGTPVATSAEDPVGESITAEAARVRDALATVSGDLEARAAQVDGVASEILLVSAAMARDRGIVAAAEENLRAGMPTAHAVSVAFDGYCAKLEALGGYLAERVADLRDLGHRAVAVLLGVPMPGIPDPGYPFVLVARDLSPADTAMLGGSDVVGLLTAEGGPTSHTAILAKSLGLPAIVNCADLDLLVEGRPVVLDGTTGEIVVDPGDLRQAEVAEQLAEARARVAATSGPGRTRDGAHVGLLVNIGTVDDATRAATADSEGVGLFRTEFLYLGRQIAPTLDEQIATYTSVLEQFAGRKVVVRTLDSGSDKPLPFLDLGAEENPALGVRGLRVGAVYPDVPATQLEALGAAAAVTGADLWVMAPMVATAEEAEGFAALARSLGIATVGAMIEIPSAALRARDLLEHLDFVSIGTNDLSQYTCAVDRMAGSLAPLLDPWQPAVLDLIGLVGAAGAEAGTPVGVCGEAASDPALAPVLVGLGVTSLSMVAPSLGAVRASLADTDLGLCREMAAAARRARSPQAARSAVAALASGARR

SEQ ID NO: 74785 - protein, 339 aa, Pycnoporus coccineus
MPGQVPVGINGFGRIGRIVLRNALLHGDINVVAVNDPFIDLEYMVYMFKYDSVHGRFKGSVEAKDGKLWVEGKPISVFQEKDPANIPWGSVGAQYIVESTGVFTTTEKASAHLKGGAKKVVISAPSADAPMFVCGVNLDAYDPKYTVISNASCTTNCLAPLAKIINDKFGIVEGLMTTVHATTATQRTVDGPSHKDWRGGRAVGNNIIPSSTGAAKAVGKVIPSLNGKLTGLAFRVPTIDVSVVDLVVRLEKPAKYEDIKNAVKEAANGNMQGIMAYTEDKVVSTDFTGSDASSIFDAEAGIALNDHFVKLISWYDNEWGYSKRVCDLLAYAAKRDGAI

SEQ ID NO: 74786 - protein, 721 aa, Myxococcus xanthus DK 1622
MLGVGSATGSCAGRRGLCRGHAPGDESGMRLRSWWWVLVLLTVSCAGRRSSSEDLGGRDARSELFRARGDAAIETKQWALAAGYFASARHTEDSPTARWGQVWAEKRASSLEWAKQFEGSVLALAFSPDGRLLASGGYDAVVRVWDVAAGAQVAELKGHEAELHAVAFSPDGRWLAAAGRPGALWLWDWKQGRRVALLSGHTDVVRGLAFSPDGEWLASGGLDRTVRVWRIRDGAEVLRFTHDDIVIAVAFSPDGGRLVSSSMDRTARVWELTARRELHRLTGHGDKVESCAFSADGERVMTASADRAIRFWDARTGALLDVQRNTGALSAVAIDAGFQQLVQAGWEGRVQRVDVRGGGEVLERLDAHRTFVMAVALSPDGRTFASGGMDGVLKVWSRPEVPPDVLLRELPAWPEVLTSVGPDAFVSGGEDGLRSWSVSAGGELHSRLEAPDAVGAVAVSADRRLLAVGTLKGEVRVRDVRSGNQLMVIPAARESIRALAFSPDGALLAAGVAQDVVLWAVPSATQVARLTGHTGKAWALAFDATGQRLASGAADHTVRIWDVARGTVIRVLEAGDRVRAVTFLASGELLTAGMRQPIRLWSPDDGRVLTSMDSLTVGVLSLAMAPQGAFVASGGVGGEMKVWRLPDGALMGEVPGLQGFVSAVTFSSDGAWLAAAASDRTFHLLGFDAFALPPPVEPDLTRILRRHGLAWDDLRGAFTLH

SEQ ID NO: 74787 - protein, 535 aa, Bordetella bronchiseptica RB50
MPIIESRIDTRSQDYADNARAMQAQLDDLNQKLARTAQGGSETARAKHVGRGKLLPRERVEQLVDPGSPFLELSPMAAHGMYGDEAPGAGMITGVGRIAGTECVIVCNDATVKGGTYYPMTVKKHLRAQEIAAQNRLPCVYLVDSGGANLPRQDEVFPDRDHFGRIFYNQAVMSSQGIAQIAVVMGSCTAGGAYVPAMCDESIIVRDQGTIFLGGPPLVKAATGEEVSAEDLGGGDVHTRLSGVADHLAANDMHALQLARNAVARLNRAKPAALALAPVREPRYDASELNGIIPADTRKPYDVREVIARIVDGSEFDEFKARYGTTLVTGFAHIHGMPVGIVANNGILFSESAQKGAHFIELCAQRKIPLVFLQNITGFMVGRKYENEGIARHGAKMVTAVATAAVPKFTILIGGSFGAGNYGMCGRAYSPRMLFMWPNARISVMGGEQAASVLATVKRDGIEARGAQWSGAEEDAFKQPIREQYEREGHPYYATARLWDDGIIAPADTRRVLGLALSAALNAPIEDTRFGVFRM

SEQ ID NO: 74788 - protein, 596 aa, Bacillus thuringiensis serovar konkukian str. 97-27
MVESLLLSIVIIITLGIASQWTAWRFQLPAIVVMAVAGLLIGPVFGIINPKEVLGDVFSPLVSLSVAIILFEGSLSLDIRELRGLSKPVFRIVTFGAFIAWIAGSLAAHYVAGLDWAVAFIIGGLFIVTGPTVIIPLLRQARLKPRTAAILKWEGIIVDPFGALLAVFAFQIVNFLTKENVQLHTLLYFFAGSLFAMVLGYIFSIFMSYMILKGKVPEYLKAPILLVTVLLCFGIADEVMHETGMLAVTVMGITLARMKKYISSIGDIRHFNENISVLLTSTVFIILTASLPRTTIMEIFSWPIISFVLMMLFVVRPLSIWISTIGTELTKAERALVGWIAPRGIVALTVSSYFATELLQEGYKDASILTALTFALVITTVCAHGFSIGFLAKRLGLANTEPPGILISGASTFSSAFALHCKEMGVPSLIVDVSEEHLQCAKVKGLNTYNGQVLSEQLQFEVDMNQYEYLIAVTDTDSYNVLVANTYVPQFGHHNTFLLPIHDVEKIEQERISLSKKAHLLFGQNEIYEELNRKIEDGYTFKTIQVAEEQKINKEESDSEDLILFIRHRDGSLTFSTLYKYIAVMPGDELVVLAKQ

SEQ ID NO: 74789 - protein, 197 aa, Corynebacterium glutamicum ATCC 13032
MSDIRMAAQGGPGFGNDVFDRLLSERIIFLGSQVDDEIANKLCAQILLLSAEDPTRDISLYINSPGGSVTAGMAIYDTMKYSPCDIATYGMGLAASMGQFLLSGGTKGKRFALPHARIMMHQPSAGVGGTAADIAIQAEQFAATKREMAQLIAEHTGQTFEQISKDSDRDRWFTAQEAKDYGLVDHVITLAEGPISN

SEQ ID NO: 74790 - protein, 406 aa, Yersinia pestis CO92
MNFPIERVRADFPLLSRQVNGQPLVYLDSAASAQKPQAVIDKELHFYRDGYAAVHRGIHSLSAEATQQMEAVRTQVADFIHAASAEEIIFVRGTTEAINLVANSYGRHFLAAGDSIIITEMEHHANIVPWQMLAQDLGVEIRVWPLTATGELEITALAALIDDTTRLLAVTQVSNVLGTVNPIKDIVAQAKAAGLVVLVDGAQAVMHQPVDVQALGCDFYVFSGHKLYGPSGIGILYGKSALLQQMPPWEGGGAMIKTVSLTQGTTFADAPWRFEAGSPNTAGIMGLGAAIDYVTELGLLPIQQYEQSLMHYALAQLSQIKSLTLYGPTERAGVIAFNLGQHHAYDVGSFLDQYGIAIRTGHHCAMPLMAFYQVPSMCRASLALYNTREDVDRLVAGLQRIEKLLG

SEQ ID NO: 74791 - protein, 313 aa, Aquifex aeolicus VF5
MGNTLATHLDRKGHEVLLYDINEEVVKKINEGIHPYVEGIRFKNVKATTDLNQINEFKNLICALPVQVIPKVITKVNLKGKNFISASKGIIHENLKRISQLVKEIEPKLKFFVLSGPSFAEEVSKGLPTAIVLAYEDKEEAMKLQDALDSENFNVYLNDDITGVELGGALKNVIAIAVGLSDGMGYGYNARSAIITRGLHEMANVGEKFGARRETFFGLSGAGDLILTSTSDLSRNRTFGKLLGQGYSVEEALKKINQTVEGVKTAEALYEIIKRENIFAPICEGVYRIIKGEDPKKVYPHFLSNHLREEFQR

SEQ ID NO: 74792 - protein, 311 aa, Aquifex aeolicus VF5
MNGVKIIAGTSNKTLSEEIAGYLGLRLTDALITTFSDGEIRVQINESIRGYHVYVITSLSNPVNHNLMELLLTLDAVKRSSPKEITAVVPYYAYGRQDRQDKPRTPISAKLVADLIQKAGANRVIVVDLHSPQIQGFFDIPVEHLTAIPVLYDYIRKNVVLENPIVVSPDAGGVKRARDLANKLGCGIGVILKRRPEPNKAEVMDVVGDIEGKEAIIVDDIIDTAGTLVAAANLLVNKGVKRVIACATHGIFSGPAVERLTNSPIEKVIVTNTLPVYEKKFGKLEVVSIAPLIGEAIRRIQEGTSVSSLFT

SEQ ID NO: 74793 - protein, 456 aa, Burkholderia mallei ATCC 23344
MTAVDAYRREAHMQDIDDFLRQHRITEVEAIIPDMAGIARGKIIPRNKFETGESMRLPQAVMVQTVTGDYPEDGTLTGVTDPDMVCVADASTICLIPWAVDPTAQVIHDCVHFDGSPVEISPRYVLRRVLDLYRARGWKPVVAPELEFYLVDMNKGPDLPLRPPVGRTGRAETGRQSYSIEAVNEFDPLFEDIYEYCELQGLDIDTLIHEVGAAQMEINFLHGDALSLADQVFLFKRTVREAALRHNMYATFMAKPMESEPGSAMHIHQSVVDIETGRNLFIGASGDVTPMFRSYLAGLQKYTPALMPIFAPYINSYRRLSRFMAAPINVQWGYDNRTVGFRIPHSAAAARRIENRIPGVDCNPYLAIAGTLAAGYLGVTQGLEPTEPLASDGYSLPYQLPRNLEEGLTLMSACAPLAEMLGEKFVKAYLALKETEYEAFFRVISSWERRHLLLHV

SEQ ID NO: 74794 - protein, 954 aa, Bifidobacterium longum NCC2705
MAKPRVYELAKVLNVDSKTVLEKLKDMGEFVKSASSTIEPPVARRLKAEFAKDNAKGDSKPVQQRRPAAPSAPASTSSSAPTPAAPARQASPASAHQQAPTPGAPTPRPQGGARPGMPTPGRHGQNDNRENGRDNREGRENGRQSRPNDRRNNDRRNNQGRPNNSQPVQHQNNRGNASAPRPHAQGPRPGNNPFSRKQGMHTPTPGDIPRPHPMARPTADNGRGGRPGRPGQGQGQGRGFRGGRPGQGGQGGPRPGQWGHNRPGQGGGSQGAGQGGARGGFRGGQGGGNNFQGGGAPSNGPARGGGRGGRGGAAGAFGRQGGKSSKARKNRLAKRHEYEELKAPTIGGVRIPNGNGQTIRLRQGASLADLAEKINVNQAALVTVLFHLGQMATATQSLDEETFQILGEEIGWNIQLVSAEEEDKELLQQFDINLDEEELQDDEDLKPRPPVVTVMGHVDHGKTRLLDTIRKTNVIAREAGGITQRIGAYQVTVNLEGEPRKITFLDTPGHEAFTAMRARGAELTDVAILVVAADDGVMPQTVEAINHAQAAKVPIVVAVNKIDVPGANPEKVRGQLTEFGLVPEEYGGDTMFVDISAKQNLHVDKLLEAVLLTADAELDLRANPDMDARGATVEARLDKGRGAVATVLVQQGTLHVGDAIVAGTSYGRVRAMLDENGQPMEAAGPSTPVQVLGLTSVPTAGDLFLVASDDRAARQIAEKRQATERAAQLAKRRKVVSLEDFKKKFAESEIDMLNIVIKGDSSGSVEALEDSLMKIEVSDEVGIQVIHRGVGAITQNDVNLATVDKAVIIGFNVRPNRQVADLAEREGVEIKYYSVIYRAIEDIEASLKGMLKPEYEEVVTSHSEIREIFRSSKFGNIAGVMVQDGEVKRGTKCRILRNGVATVNDLEISSLRRFKDDVQSVKEGYEAGINLGTFNDIELGDIIETFEMREVERK

SEQ ID NO: 74795 - protein, 209 aa, Zea mays
  misc_feature (174)..(174): Xaa can be any naturally occurring amino acid
  misc_feature (180)..(180): Xaa can be any naturally occurring amino acid
MAAAGTLVVYRAVFAALGCLMVGTLVYTCITDGSPFRTELLTPWMVTTLVDLYVNIAAISTWVVYKEGNWITSIFWVVLLICFGSATTCAYIVSKLFEITSSGLSQNPLDLLLLRQNNLPERKCSFVVIGRTIFSILGILMAALVTYTVITDGLPFRKDLLTPWMAATLIDFYXMFLQYXVWVVHRESTWISAVIWICLLICFGSITTC

SEQ ID NO: 74796 - protein, 335 aa, Xanthomonas campestris pv. campestris str. ATCC 33913
MRGIRLQQPAGLASLSSVALPDPGQPAAGQIRVRLHASSLNFHDLGIVSGQMPTADGRIPMSDGAGVVEAVGEAVSDFAVGDHVVSTFFPQWLDGEPLHAGFATTPGDGVDGYARSAVVAAAQAFTHAPRGYSHAEAATLTTAGVTAWRALVVNGRIKAGDTVLVLGTGGVSIFALQFAKAMGAMVIVTSSSDQKLETARTLGADHCINYRQHTEWAAQVLEITNGRGVDHVVEVGGPGTLAQSIKAARVGGHIALIGVLTGAAGPVPTAEMMGRQQRLQGLVVGSRRHQQELVRALDGLPLRPVIDRSFALEDIAEAFALQHAGGHLGKIVLEF

SEQ ID NO: 74797 - protein, 265 aa, Bacillus cereus E33L
MGNILIDAFLETRAVKPSCLTIINRTPAKAYHIKEKYPSVHIAKTIDKVIERSHLIFICVKPIDIYPILQKYAEHFSDEKCLVSITSPISPSQLETLVPCHVARIIPSITNRALSGASLFTFGNNCSEEWQQKLFSLFKNISTPLVIEEDITRVSSDIASCGPAFFSYLLQCFINAAVDKTNITHEEATTLVSEMVVGMGELLEKGIFTLPTLQEKVCVKGGVTGEGIRVLEEHVGDMFHKLIERTHEKFDEDLKCVDQQFNKHT

SEQ ID NO: 74798 - protein, 448 aa, Nocardioides sp. JS614
MSRLTCLAFPGRSIPMAVLERLSVAARELPASVRALRAVPGVDQVLVLSTCERTEVYAWWTDEADPAALLRALAGQRGLGPEPLLEHAVGLTGREAVQHLLRVTAGLDSFVRGESDIVGQVRAAVQAARAEGAVGLEVQRLVDAAVNTSRRVHRSTGAGLAAGSVASTAVAAVAGLLPDGLAGRDLLVVGTGQVAVSVVAAAREAGARLTVCGRDPERAAAIAPAGARVLGLDDLPGALLDADAVVFGTSSPERLLRAGDLGPGLSEHRSGRELVVVDLCVPRNVDPDVRGVPGVRLLDLTDLRGAAVPGRRPSAPAPAALELAEQIVAQEVDRFLHWWVDRAAAEPVRRLRADVEACVREEVARATRGLSPDLEPLVAEGIRRAVQHLAHGPTRRLLDAAAAGEDEVVALLAGLFAPSAEEDQAVPAYSPQPIGNTSNAAASATPRR

SEQ ID NO: 74799 - protein, 177 aa, Picea sitchensis
MYAAGFYTYSIFALIFWETRRSDFGVTMSHHVATVILILASYLLRFSRVGSVVLAIHDASDVILEVSKMFKYSGSTAIPSISFILFAISWIVLRLIYFPVWIIWSTSYEVILTLDMDKHKIEGPIYYYIFNSLLICLLVLHIYWWVLIYRMFVRQIKAKGKISEDLRSDSECEDKED

SEQ ID NO: 74800 - protein, 789 aa, Oryza sativa Indica Group
MDSTKQDFQPRTFSIKLWPPSESTRLMLVERMTKNLSTESIFSRKYGLLGKEEAHDNAKRIEEVCFASADEHFKEEPDGDGSSAVQLYAKETSKLMLEVLKRGPRTTVEPEVPVADTPLEPADSVFDISGGKRAFIEADEAKELLSPLIKPGNAYKRICFSNRSFGIGAANVAGPILESIKKQLTEVDISDFVAGRPEDEALDVMRIFSKALEGAVLRYLNISDNALGEKGVRAFEELLKSQDNLEELYVMNDGISEEAAQALSELIPSTEKLKILHFHNNMTGDEGAMFIAEMVKRSPNLESFRCSATRIGSDGGVALAEALGTCTRLKKLDLRDNLFGVEAGLALSKTLSKLPDLVELYLSDLNLENKGTVAIINTLKQSAPQLEVLEMAGNEINAKASQALAECLTAMQSLKKLTLAENELKDDGAVVIAKSLEDGHQDLKELDVSTNMLQRVGARCFAQAIANKPGFVQLNINGNFISDEGIDEVKDILKSGENSVEVLGPLDENDPEGEAEDDEEEEEEEEDDDQRRGLRHRSPHPHPPPPLAITLQQIGNLAGGGGGGAGKRADTGDEREEEEEEEGEDGGDAVAARRRDRPRDGHRRGIHRLRWEDKLPRLPPQGGSPRHLQRGRLHTPLQHHQRHFYLCSVSPGASCSLDLHIVRSLQYVDARVGPFDTFLVGGDTAEVSDIKFSNDGKSMLLTTTNNHIYVLDAYGGDKRCGFSLESSPNVATEAAFTPDGQYVISDCLLEQSHRSYHCFEVGSPSSNVCNCVNCPNFLDSQQFQFELGA

SEQ ID NO: 74801 - protein, 316 aa, Triticum aestivum
MPSLLEIFLGSCSSSAPPVDWEAEAYPEYADYAVLPLLLAFFPALRLLLNQFLFEVLARRLIFGKGYDKLAETDERRKKINKFKESAWKFVYYLSAELFSLSVTYNESWFTNTRYFWVGPGEQLWPDQKMKLKLKAVYMYAAGFYVYSIFDLLFWETRRKDFGVMMSHHVATIVLIVVSYICRLSRPGSVILPLHDASDIFLEIGKMAKYSSCEWLAVVAFLLFVASWILLRLIVFPFWILRSTSYEIAMIVDNENRKIYRTSYYYLFNTLLFSLLVFHIYWWVLIYRMLVKQIQSRGHVGEDVRSDSEGENNHED

SEQ ID NO: 74802 - protein, 396 aa, Hevea brasiliensis
MASASLLKSSPVLDRSEFVKGQSLRQPSASIIRCHPASSSALTILAGSYADELVKTAKTVASPGRGILAMDESNATCGKRLASIGLENTEANRQAYRTLLVTAPGLGQYISGAILFEETLYQSTTDGKKMVDVLIEQNIVPGIKVDKGLVPLPGSNNESWCQGLDGLASRTAAYYQQGARFAKWRTVVSIPNGPSALAVKEAAWGLARYAAISQDNGLVPIVEPEILLDGEHGIDRTFEVALKVWAEVFYYLAENNVLFEGILLKPSMVTPGAECKDKATPQQVSDYTLKLLKRRIPPAIPGIMFLSGGQSEVEATLNLNAMNQGPNPWHVSFSYARALQNTCLKTWAGRPENVKAAQEVLLVRAKANSLAQLGKYTGEGESEEAKKGMFVKGYVY

SEQ ID NO: 74803 - protein, 627 aa, Acidovorax sp. JS42
MAIIDIKVPDIGDFAEVGVIEVLVQPGDTIRAEQSLVTVESDKASMEIPSSHAGVVKELKVKLGDKVAEGSVLLTLEVAQGAAAPAAAPAAASTPSAPPSESKPAPAPAVQAPAAPKTEASSFGGSADVECDVLVLGGGPGGYSAAFRAADLGLNVVLVERYATLGGVCLNVGCIPSKALLHVAAVMDEVSHLKSAGIDFGAPQVNIHTLRGHKEKVIGKLTGGLAQMAKMRKVTVLRGYGHFVGANHLEVEETTGTSQDKTGAKKVVAFKRAIIAAGSQAVRLPFMPDDPRVVDSTGALALKDVPKRMLILGGGIIGLEMGTVYSTLGARLDVVEMLDGLMQGADRDLVKVWQKMNQHRFDNVMLNTKTVAAEATPEGIKVSFAPAKDGVTVPEPQVYDLVLQAVGRTPNGKKIAADKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWAASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 74804 - protein, 567 aa, Acidovorax sp. JS42
MALVNIQVPDIGDFDEVGVIELLVKVGDTVKAEQSLITVESDKASMEIPSSHAGVVKELKVQLGDKVKQGSVIAVLEAAGEAAASDEKPAPAPAAQAPAAIETQAPVAPAAPAAPAAGGGAVEVRVPDIGDFKDVAVIELLVQPGDAVKVEQSLFTVESDKASMEIPSPAAGVLKELKVKIGDKINVGDLVAVLEGAAAAPAAAPAQGSTPAAASAPAAAAPVAAQGSAPAPAAATATATATATAPVPAHQPSTPTPGLPHASPSVRKFARELGVPLAEVKGTGIKGRITQEDVAAFTRQVMSGALQTQAQGSKAPAAGGSGVGLDLLPWPKVDFAKFGPVERKELSRIKKISGANLSRNWVMIPHVTNNDEADITELEAFRVSTNKENEKSGVKVTMLAFVIKAVVAALKKFPEFNASLDGDALVYKQYFHIGFAADTPNGLVVPVLKDADKKGILQISAEMAELAKKARDGKLGAADMQGGSMSISSLGGIGGTHFTPIINAPEVAILGLSKSQMKPVWDGQQFVPRLTLPLSLSYDHRVIDGASAARFNAYLGQVLADYRRILL

SEQ ID NO: 74805 - protein, 532 aa, Sorghum bicolor
MSIKSETNERSSTIQSAGHRICSIVKLCYQHLMLAVSYALYLFLAPIILATLVLHLSRHTSADDDLIVSARSTLTANLPFTVVVVAAAATAVYLMRRPRAVYLLDLACYKPGAEHAVTRETFMRLVVGYGTFSDDSLAFQRKILERSGLGQGTYLPKALTSSPPNPCMAEARREAEAVMFGAVDQLLAKTGVRAGDIGIVVVNSGLFSPTPSLSAMIVHHYKLRRDVSSYNLAGMGCSASLISVDLAKQLLQVQRNTYALVVSLEIMAASAYVGNTRSMLVPNCIFRMGGAAVLLTNHGTERRRAKYQLLHTVRTHQGADDRAYRCVYQEEDESGHVGVALSKDLMSVAAEALKTNITTLGPRVLPMSEKMKMMLVGGKAAVVQVLGVQQQGQGGSRSRPYIPDLTTAFEHFCIHAGGRAVLDTVERSLDLSAWHMEPSRMTLYRWGNTSSSSLWYELAYTEAKGRVRRGHRVCQIAFGSGFKCNSAVWRALRTIDPAKESAAAGNPWVEEIHRFPVEVPQVERVDVAAMAS

SEQ ID NO: 74806 - protein, 281 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQRVIAEMTDGGVDRSVECTGHIDAMISA

SEQ ID NO: 74807 - protein, 627 aa, Geobacter sulfurreducens PCA
MTDTMLGQAVVYLAAALFCVPIARRLGMGSVLGYLLAGILIGPFCLGFVGREGEDIMHFAEFGVVMMLFLIGLELEPAHFWRMRTTILGLGSLQLALTTCALTAGLLLLGLDWRGALAAGLALAMSSTAIVLQSLKEKGLGNSHAGLSSFAVLLFQDIAVIPILALLPFLAIQAGGGAVHGDAPSLLDGLPVWMKAGSVLFAVVAVVVMGRSIVVPFLRIVTKASVRELSVAAALLIIVAIAYLMELVGLSPALGAFLAGVLLANSEFRHELESDIEPFKGLLLGLFFIAVGASINFRLLTDKPATIISLVLAVILVKAVVLVVAGRLFRLSFDQNSIFAIGLSQVGEFAFVLFAFIDRLGIIGRDWTDTLMAVTAISMTMTPLLLLANERLVLPRFGTREREEQEADLIDTEHPVIIAGFSSFGSTLGRFLRANGVEATILDNDSDQVDLLRRMGFKVFYGDATRLDILRSAGADSARVLFIAIDSPATVNKLVATARKHFPHLKVMARAGTNLDAHELLDLGVRDIYRDFLDTSVRAGVDVLASLGYRRYGATRAGQDFIRYDESAMHHLAPHRHDESSYISTAREQIRLQEQLLAGDRTANHTHHDHAWDTSTPVTAAEGETQP

SEQ ID NO: 74808 - protein, 517 aa, Geobacter sulfurreducens PCA
MKREDLLRHLAETEVWDMIVIGGGATGLGTAVEAAGRGYRTLLLEQGDFAQGTSSRSTKLIHGGVRYLQQGNLTLVLEALRERGLLIRNAPHLVHNLSFVVPLYDWWEGPFYGIGLKLYDVLAGKLGLGPSRLLSREETLGHIPTVEPHGLRGGVIYHDGQFDDSRLAISLALTLADLGGVALNHFPVTGIISRDGLVAGVEARDRETGGAFRIMGRAVINAAGPFVDGVRRLADPAARDLIAPSQGVHLVLDGSFLPGDSAIMVPHTDDGRVLFAVPWHGRTVVGTTDTPIPAAGLEPRPLPEEIDFLLSHAARYLTRHPERRDVLSTFAGIRPLVRSDSGGDTASLSRDHTLLVEGSGLVTIAGGKWTTYRKMGEDTVTAAAQVAGLDHRPSVTETLRIHGWQEDATEGPLQVYGSDAAALEQLLRENAAWREPLHPALPYCAGEVVWGVRHEWARTVEDVLARRTRALLLDARAAVAAAPRVAELMARELGRDSDWQAAQVAAFTHLARGYLPE

SEQ ID NO: 74809 - protein, 391 aa, Francisella tularensis subsp. tularensis SCHU S4
MHDESLISIFVFVMLGILVVTIVLKKLKQPYVVAYLLTGILLGPYGLRLIQDQENLARLGEIGVILLLFFAGMEVSPRKFAENWQVPTIGTMLQMLITSLIVSIIGVALGWSIAKILLFGAVISLSSTAVVLKLLNDSGSMKTRLGQNVLGILLIQDLAVVPMLILVRLIGGEELSISQIVTQILGGILIISIAAIMAVKKNIKISFISVLGKDEEMRVFAALVICFGMAALTESLELSSALGAFVGGMIVSTLEETEWVGHSLSTVKTIFMALFFISVGMLIDLKLFWNHIFLFMALLLLIYSLNTTINALIFKALRQRTEEALIGGAMLSQIGEFSFVLISMGFASGILSLTIYHYCITLISLSLLFSPLWISGVNLYIKKYIKKKPQN

SEQ ID NO: 74810 - protein, 360 aa, Arabidopsis thaliana
MASSMLSSATMVASPAQATMVAPFNGLKSSAAFPATRKANNDITSITSNGGRVNCMQVWPPIGKKKFETLSYLPDLTDSGGRVNCMQAMGEPNLNPAYTLDQAIANLQQTEDASARYYAAWWIGRFRAAQPETIAALLVALEDETDRSPDGGYPLRRNAAKALGKLGDRQVVPALIKALECEDYYVRESAAQALEGLGDARAMAPLMAKLTGGLAAAQLVEGKPHLAQPYEAIIEALGTLQAVESIGLIEPFLEHFSPKVQYAAARALFQLTGDNRYGDLLITALGGTDLQLRRSAMMDLGATGYLPGAQAIAKAFAENSLKLIALRDLWATHRQRQASSESKALSPASRQILELMDSLL

SEQ ID NO: 74811 - protein, 794 aa, Yersinia pestis CO92
MSNNGHTRCNVLWYNQLGMHDVDRVGGKNASLGEMITHLSELGVSVPNGFATTAQAFNDFLEQSGVNQRIYQLLDNTNIDDIAELSKAGAQIRQWVIETPFHPEFEQSIYDAYKQLADGEPEASFAVRSSATAEDMPDASFAGQQETFLNVQGIDAIMVAIKHVFASLFNDRAISYRVHQGYDHRGVALSAGVQRMVRSDLASSGVMFTIDTESGFDQVVFITAAHGLGEMVVQGAVNPDEFYVHKPTLRNGKPAIVRRNMGSKKIRMIYAENQEHGKQVCIEDVPEIQRNRFALSDDEVEALAHQALLIEEHYGRPMDIEWAKDGHTGQLFIVQARPETVRSNEQVMERYQLNNQSNVLVEGRAIGHRIGAGPVKVIHDISEMDRIQAGDVLVTDMTDPDWEPIMKKASAIVTNRGGRTCHAAIIARELGIPAVVGCGNATELLKEGQNVTVSCAEGDTGYVYHELLDFSVQSSQVTELPDLPLKIMMNVGNPDRAFDFARLPNEGVGLARLEFIINRMIGVHPKALLEFDQQEPALQAEIKALMHGYDDPVEFYIGRLTEGIATLGAAFWPKPVIVRLSDFKSNEYANLVGGAGYEPHEENPMLGFRGAGRYVSDHFRDCFALECEAMKRVRNVMGLTNVEVMVPFVRTVAQAEAVVAELARQGLKRGENGLKIIMMCEIPSNALLAEQFLEHFDGFSIGSNDMTQLTLGLDRDSGVVSALFDERNEAVKALLSMAIQAAKRHGKYVGICGQGPSDHEDFALWLMEQGIDSLSLNPDTVVKTWLSLAQHTKH

SEQ ID NO: 74812 - protein, 322 aa, Francisella tularensis subsp. tularensis SCHU S4
MSEDLMIFSGNASKKLASEVAKELGATLGNATVDRFKDGEIHVVLNENVRGKDVFVIQSTCPPSDNLMELILLIDALKRSSAERVTAVLPYFGYARQDRRSKSARVPISAKVVANLLQAVGLDRILSVDIHAEQIQGFFDIPFDNAFATKIFLEYVRKNPEKYQNIKIVSPDMGGVVRARSVAKNLGVEIAVVDKRRPKPNVAEVMNIIGEVDGKHCILVDDIMDTGGTMCQAAKALIEKGGAAKVSAFCIHPLLSGDAIKNIEDSAIDELIVTDSIPLKPHAEACSKIKVITLAPLLAQIVEKTNGEESVSDIFRIDGLVD

SEQ ID NO: 74813 - protein, 458 aa, Pseudomonas syringae pv. tomato str. DC3000
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSTSGTEIGISNLWAHGGFMPNGVTGLIASFAVVMFAFGGIEIIGITAGEAKDPQRSLPQAINAVPLRILLFYVLTLFVLMCIYPWPQIGTQGSPFVQIFDNLGIASAATILNIVVISAAVSAINSDIFGAGRMMYGLARDGQAPASFARLSRQGVPWMTVLVMGVTLLGGVLLNYLIPKDVFLLIASLATFATVWVWLMILLTQVAMRRSMSREEVTQLKFAVPFWPYGPAAAIAFMLFIFGVLGYFPDNRAALIVGAIWIALLLIAYGLWVKPKALNKTH

SEQ ID NO: 74814 - protein, 232 aa, Bifidobacterium longum NCC2705
MDKAQQDALKKAAGIEAAKLVENGMIAGLGTGSTVKFLVDELGRRHQEEGLEFTGVTTSRRTQAQAESYGIKIVDIDDVDHIDVTIDGADEVDKNFNGIKGGGAALLWEKIVATNSNQIVWIVDESKVVDTIGKFPLPVEVIPFGAGQVIKKFEARGYKPVLRLDADGKEVRTDENNFVVDLHLERIDHPQELAEDLINTVGVVEHGLFLNMVDKVIVGDPNGPRVMTNANK

SEQ ID NO: 74815 - protein, 292 aa, Pseudomonas viridiflava
MSTANQNPAAAPAVKKKLTTSAMIASIASEGQATRSAPFGHALAALADQRSDIVGLSADLSKYTDLHIFAKAHPERFYQMGMAEQLLMSAAAGMAREGCVPFATTYAVFASRRAYDFICMAIAEENLNVKIVCGLPGLTTGYGPSHQATDDLAIFRAMPNLMIVDPCDALEIEQAVPAIAAHQGPVYMRLLRGNVPLVLDEYGYQFEIGKAKTLRTGNDVLIISTGLMTMRSLEAAKELQADGVDVAVLHVPTIKPLDEQTILAEARKPGRLVVTAENHSIIGGLGEAVATV

SEQ ID NO: 74816 - protein, 259 aa, Bordetella bronchiseptica RB50
MISLPYLQRFALSGQVALVTGSARGLGLRIAQALAGSGAHVLLNGRDAHAVEAAVSDLRQQGLRASALPFDVSDEQATEQAFARIDAEHGRLDILVNNVGARNRKPLAETSPAEIRAMMDTNLVAGILLARLAAQRMVRQRYGRLIAITSVAGELARANDAVYPAAKQGLTGMMRALAVEFGRHGITSNAIAPGAFATETNAAMANDPQAGAAMAARNPTGRWGDPEEIAGAAVFLASPAASYVNGHVLVVDGGLSVQF

SEQ ID NO: 74817 - protein, 483 aa, Oryza sativa Japonica Group
MAAPWAIPRRGLFIGGGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 74818 - protein, 363 aa, Francisella tularensis subsp. tularensis SCHU S4
MGFKCGIVGLPNVGKSTLFNALTEAGIDAENYPFCTIDPNVGIVSVPDQRLNELAKIVKPERIITTTMEFVDIAGLVTGASKGEGLGNKFLANIRETDAIAHVVRCFEDDNIIHVSGKVDPIDDINTINMELILADIESCDRTVQRFAKMKKSGDKEALAKADFYTRLKEHLESEKPARTFEMNKDETKWLKQTPLLTSKPVLYIANVNENGFENNPLLDKVVEYAKAENSNVVPVCAAMEQEISQLEADEKLEFLADMGLSETGLDRVIKAGYALLNLHTYLTASVKEVRAWTIPVGATAPQAAGVIHTDFERGFIRAEVIAYDDYIKYNGEKGAKEAGKARLEGKEYIMKDGDVVNFRFNV

SEQ ID NO: 74819 - protein, 769 aa, Burkholderia mallei ATCC 23344
MSTSSSSSSSKEKLREAALDYHEFPTPGKVAIAPTKQMINQRDLALAYSPGVAFACEEIVENPLNAARFTARSNLVGVVTNGTAVLGLGNIGPLASKPVMEGKAVLFKKFAGIDVFDIELNESDPHKLVGVIAALEPTFGGINLEDIKAPDCFIVERECRKRMKIPVFHDDQHGTAIVVAAAVTNGLKVVGKSIKEVKLVASGAGAAALACLDLLVDLGLPLEHITVTDLAGVVYKGRAELMDPDKERFARETDARTLSEVIDGADIFLGLSAAGVLKADMVKKMAERPLILALANPTPEILPEVALEARPDAVLATGRTDYPNQVNNVLCFPFIFRGALDVGATTITREMEIAAVNAIAELAQQEQSDIVATAYGIQDLSFGPEYLIPKPFDPRLIVKIAPAVAQAAMDGGVATRPIEDMEAYKVHLQQFVYHSGTTMKPVFQIARGAPAEKKRVVFAEGEEERVLRAVQIVVDEKLAKPILIGRPAVIEHRIQRYGLRLTPGVDFTIVNTEHDERYRDFWQTYFKMMARKGISEQLARVEMRRRTTLIGSMLVKKGEADGMICGTISTTHRHLHFIDQVIGKRAGCSVYGAMNALVLPGRQIFLVDTHVNVDPTPAQLAEITIMAAEEVRRFGIEPKVALLSHSNFGTSNAPSAQKMRDTLAILRERAPDLHVDGEMHGDVALDAALRKEILPESTLEGEANLLVLPNIDAANIAYNLLKTAAGNNIAIGPILLGAAQPVHVLTESATVRRIVNMTALLVADVNAVR

SEQ ID NO: 74820 - protein, 306 aa, Picea sitchensis
MSMPSNAQHFIPVLRSGSWADIGSKQRMEDEHICIDDIARNHLGDPDFESRTPMAFYGVFDGHGGRDAATYIKENLLNFITEYGDFPNGGLRNAVKNAFLKADDALAEPKSCVDMSSGTTALVAMVSGKSLLVANAGDCRAVLGKRWGRTLQLSSDHKLTSSAERKRIESLGGFVEDVYLNGELGVSRALGDWHLKGRGAVYLSPLSAEPEVQELELSEEDEFLIIASDGLWDVVSNESAVGIARRELMSNNDPDSCCRALVTEALRKHSVDNLTVVLVCFSTGPPPKKRFRNSRLRRSTNAASDL

SEQ ID NO: 74821 - protein, 471 aa, Pseudomonas putida KT2440
MTPDKKVKILATLGPAINGIDDIRQLVEAGVNIFRLNFSHGEHADHALRYQWIREVEQQLNYPLGILMDLQGPKLRVGRFAEGKVQLQRGQALRLDLDKTPGDSRRVNLPHPEIIAALEPGMDLLLDDGKLRLRVTAKHSDAIDTEVLNGGELSDRKGVNVPQAVLDLSPLTEKDRRDLAFGLELGVDWVALSFVQRPEDIVEARQLIGDRAYLMAKIEKPSAVEQLQAIAELADAIMVARGDLGVEVPAESVPQIQKRIIGTCRQLGKPVVVATQMLESMRFSPAPTRAEVTDVANAVAEGADAVMLSAETASGDYPLEAVQMMSKIIRQVENGPDYQAQLDVGRPKAEATVSDAISCAIRRISGILPVAVLVNYSESGASTLRAARERPRAPILNLTPNLNTARRLSVAWGVHSVVNDRLRQVDEVVSTALEIAQAQGMASRGDTLLITAGVPFGKPGTTNTLRIETLI

SEQ ID NO: 74822 - protein, 547 aa, Thermosynechococcus elongatus BP-1
MPVFDSIESALEALRRGEVIVVVDDENRENEGDLIGAAERVTPAMINFMAVHARGLICLAMEGDRLDELDLPLMVTTNTDSNQTAFTVSVDAGARWGVTTGISAEDRARTIQALIDPSTQPQDLRRPGHVFPLRSRPGGVLKRAGHTEAAVDLTRLAGLYPAGVICEIQNPDGTMSRLPQLMEYARTHQLKIISIADLISYRLQHERFVRREAVAKLPTEFGEFQIYGYRNSLDQSEHVAIVKGDPATFGEQPVLVRVHSECLTGDALGSLRCDCRMQLQAALKMINAAGRGVVVYLRQEGRGIGLVNKLRAYSLQDLGMDTVEANEHLGFPADLRNYGVGAQILNDLGVKQIRLITNNPRKIAGLKGYGLEVVDRVPLLIEATPYNTPYLTTKAEKLGHLLLQTYLITVAFRWQGSQLAAGDRYERLEKLRHLAAGVHLLVREEARPVAQAIFGHPDLIVHFGFDQPHVADRQWYKQPEHPYVLAVQTLLRQFCQWPTLKGFEFLVATGTDPMLNLPMDLDRQAYTQQSPSEWRPHLIYSWSAAAG

SEQ ID NO: 74823 - protein, 487 aa, Pseudomonas sp. TW3
MRETKEQPIWHGKVFSSNWVEAQGGVANVVDPSNGNIIGVTGVANGKDVDAAVNAAKRAQKEWAAIPFSERAAIVRMAAEKLKEREHEFADWNVRECGAIRPKGLWEAGIAYEQMHQAAGLASLPNGTLFPSAVPGRMNLCHRVPVGVVGVIAPWNFPLFLAMRSVAPALALGNAVILKPDLQSAVTGGALIAEIFSDAGMPEGVLHVLPGGVDVGESMVANSGINMISFTGSTQVGRLIGEKCGRMLKKVALELGGNNVHIVLPDADLDGAVRCAAWGTFLHQGQVCMAAGRHLVHRDVAQQYAEKLALRANNLVVGDPNSDRVHLGPLINDKQVVRVHALVESAQRAGAKVLAGGTYQDRYYQATVIMDVKPEMEVFKSEIFGPVAPITVFDSIEEAIELANSSEYGLAASIHTTALATGLDIAKRLNTGMVHINDQPINCEPHVPFGGMGSSGSGGRFGGLASIDEFTQSQWISMVEKSASYPF

SEQ ID NO: 74824 - protein, 229 aa, Acidovorax sp. JS42
MTAPTSLSQDELKTLVGQAALQYVVPGELVGVGTGSTVNKFIDALASIKDSIRGAVSSSEASTARLKALGIPVLDANDVRSLSVYIDGADEIDGNGYMVKGGGAALTREKIVAALARRFVCIADESKLVNVLGAFPLPVEVIPMAAAYIARRFESLGGQATLRLKDGQPLVTDNGQHILDVRGLTISDPLAFETEVNQWPGVVTVGVFALQKANVCLLGTAQGVRTLSL

SEQ ID NO: 74825 - protein, 252 aa, Listeria monocytogenes EGD-e
MITLKSRREIDEMKAAGKILADTHKELKKIIKPGITSWDLEVFTEEFLRKNGATPEQKGFEGYEYAICASINDEICHGFPRKQKLNQGDIITVDMVVNYHGALADSAWTYAVGEVPDDVKHLMDVTHKALYLGIEQAQVGARVGDIGHAIQTYVESENLAVVREFIGHGVGPTLHEKPDIPHYGTAGKGPRLKEGMVITVEPMVNMGAWKAKMDDNGWTARTVDGSLSAQYEHTFAITKDGPEILTYQGEND

SEQ ID NO: 74826 - protein, 549 aa, Geobacillus stearothermophilus
MLTFHRIIRKGWMFLLAFLLTVSLFCPTGQPAKAAAPFNGTMMQYFEWYLPDDGTLWTKVANEANNLSSLGITALWLPPAYKGTSRSDVGYGVYILYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTDGTMSLFDAPLHNKFYTASKSGGAFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGGTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 74827 - protein, 246 aa, Achromobacter xylosoxidans
GGNKLSKLEFLLGDAVANGADTVITVGGLQSNHARLTAAAAAVLGLACELVLSRAVPIDDLEYERNGNMLLDPLFGARVHIAPAGMDSLASAQARAEELRAQGRRVVVLPTGGSTALGSLGYVSCAQEIAQQERELGVQFSTVAVANGSGGTQAGLVAGFHALGRDPGMVQAYGVLATEPQTLATTHALVGGACELLGLAPPAESAIRVDGSHRGERYGAPTSGMLGAVMAVARSEGWLLDPVYAG

SEQ ID NO: 74828 - protein, 337 aa, Mycobacterium sp. JLS
MAFTRKPPIDPVRWQPPPVDDLPPLPSPPVTVVPVPGHAPEDVVVDAAGRLYTGVDDGRILRLTPDGGVPAVIANTGGRPLGLAVARDGRLLICDSPRGLLALDPETGRFEPLVETVGGRHLQFCSNVTETADGTIYFTESTSAFTYAYFKGAALEARGRGGLFRRDPDGTVTTLADGLYFTNGVTVTADGSALVFAETLGRRLSKFWLTGPQAGTITPLVGHLPGYPDNLSTGADGRIWVAMVSAPNAAAEGLAPRAPVLRKLLWLLPDRFAPQLTPEVWAVAFDPDSGAVVGGLRTTHPDFGMVTGLVEAGGRLWMGCIGASALAHVALDDVALP

SEQ ID NO: 74829 - protein, 461 aa, Mycobacterium sp. JLS
MTQSYITEPVTSELGAKANRHLWGHFARHGEGITPPIITRGEGVRIWDDKGRSYIDGLSGLFVVQVGHGRKELAEAAAKQAETLSFFPLWSYATPPAIELAERIANYAPGDLNRVFFTTGGGEAVESAWKLAKQYFKLTGKPGKYKVVSRSIAYHGTPQGALAITGIPTFKAPFDPPTPGGFRVPNTNFYRAPEPYAHDVKAFGQYCADRIAEAIEFEGPDTVAAVFLEPVQNAGGCFPPPPGYFERVREICDEYDVLLVSDEVICAYGRIGSMFACDDFGYVPDIITSAKGLTSGYSPLGAMIASDRLFEPFNDGKTTFGHGYTFGGHPVSAAVALANLDIFEREGLNDHVKENAPAFRATLDKLYDLPIVGDVRGEGFFYGIELVKDKATKETFDDDESERLLRGFLTPALWEAGLYCRADDRGDPVVQLAPPLISGQAEFDAIYEILHGVLSEAARRL

SEQ ID NO: 74830 - protein, 385 aa, Arabidopsis thaliana
MKKMYNLPRDLPEEVLCRIPLTSLRPVRSTCKKWSTLSKCGSFAKKHLAQAKVLADAKEFMVVLMMNFRVYLMRVNLQNNVVESSSSSSSSSSSCIKREAKLISLGDEEADISQVFHCDGLLLCISITESKTRLVVWNPYWGHTRLFEPTHQFNKFDSYSYALGYDKSRKSHKILRGITCLDPFKIYDFNSDLWRDLDVTPEWHLWQMLHGVSLKGNAYWFARENYTETMDTDHFFLLCFDFTSETFGPPLPLPFEFAVSEDTMSVSSVREEQLVVLYQPWDYLQLDIWVTSKIEPNAVSWNSKVFLSVSLKQLVSPQFQLTFGSFFIDEEKKVAVVFDKDYDNKRNIAYIFGVDGSFKAVDLGDSDRKCFPLVCSYVPSLVQLN

SEQ ID NO: 74831 - protein, 194 aa, Zea mays
APAFCELSLPLTKEEAAFSPSHPAMQRHVASGRPSGTDGSDFSYRMVVESRYQRVAEGRSRLARLILVQALHLVAGGLLLLLSLSKGAAVNKFAVLSMAAGFLAIVVGELGRMRTMSVLLRLYTSLSSIAVAFSVTCIIRSELFLKVMKQNTEAITSYEMLDAVRVALGILLQMVVIATTTRLLQNMSPPKRAS

SEQ ID NO: 74832 - protein, 502 aa, Mycobacterium sp. JLS
MTALASNASASNSVASSWIDGAPAQTGGGSFQIVNPATGAVVTEYARAANVDVDVAVAAARAALPGWATATPAERSAVLAKLAKLADEHTDVLVAEEVSQTGKPVRLAREFDVPGSVDNIDFFAGAARHLEGKATAEYSGDHTSSIRREAIGVVATITPWNYPLQMAVWKVLPALAAGCTVVIKPCELTPLTTLTLARLAGEAGLPPGVLNVVTGFGADVGTALAGHPGVDLVTFTGSTVVGRKVMSAAAVHGHRTQLELGGKAPFVVFDDADLDAAIQGAVAGSLINSGQDCTAATRAIVARDLYDDFVAGVAEVMGKIVVGDPEDPDTDLGPLISTAHRDKVAGMVSRAPAEGGRVVTGGTIPDLPGSFYRPTLIADVGEQSEVYREEIFGPVLTVRSFTDDDDALRQANDTDYGLAASAWTRDVYRAQRASREINAGCVWINDHIPIISEMPHGGVGASGFGKDMSDYSFEEYLTIKHVMSDITGVAEKEWHRTVFKKR

SEQ ID NO: 74833 - protein, 417 aa, Rhodococcus sp. RHA1
MYLTAGLALLLAATVPRLFQDRAVSAPLIVLAVGAGGGLLLGESGTDTLSPALHPAVTEHLSETCVIVALMGVGLAIDRPLGWRTWNSTWRLLLIAMPLGIAAVALLGWWVAALTPAVAILLGAVLAPTDPVLASDVQVEGPTSGGESHREDDEVRFALTSEAGLNDALAFPFVYLALFMIGKGPIEQWIVQWVAWELIGKVVIGAALGWIAGDLFGRAVFRFPITHMRLAERSEPIFALAATFAVYGLTELAGGYGFLAVFACAVAIRRTERAHDYHAEMHSLIEQLEHVLTLAVLLLLGVALTSGLLTGLTWGGVLVAAALVFVIRPVVGWLSLLGCEEMSGPERRVTAFFGVRGIGSIYYLAYAAAEAGVDDEKWLWSTVAFTVVLSVLVHGVSATRVMRLLDLRREGGAVADR

SEQ ID NO: 74834 - protein, 472 aa, Bacillus anthracis str. Sterne
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 74835 - protein, 299 aa, Brassica napus
SWIAVTGYVVMAIVSIVTVPHIFPQLRWYHILTMYIIAPVLAFCNAYGCGLTDWSLASTYGKLAIFTIGAWAGSANGGVLAGLAACGVMMNIVSTASDLMQDFKTGYMTLASPRSMFLSQAIGTAMGCVISPCVFWLFYKAFPDFGQTGTAYPAPYALVYRNMSILGVEGFSALPQHCLMICYIFFAAAVFVNGVRDAVGPKWSRFIPLPMAMAIPFYIGGYFTIDMCVGSLILFVWRKLNRPKADAYSSAVASGLICGEGIWTLPSSVLALAGVKPPICMKFLSGATNVKVDSFLNPS

SEQ ID NO: 74836 - protein, 222 aa, Nicotiana benthamiana
MVDEVEKPASLEESKTNTREVEEEGEIVGESDDTMSSLGNPSKAMKHPLEHSWTFWFDNPSGKSKQAAWGSSIRPIYTFSTVEDFWSVYNNIHHPSKLAVGADFHCFKNKIEPKWEDPVCANGGKWTMSFSRGKSDTCWLYTLLAMIGEQFDCGDEICGAVINVRVRQEKIALWTRNAANETAQVSIGKQWKEFLDYNDSIGFIFHDDAKKLDRAAKNRYSA

SEQ ID NO: 74837 - protein, 108 aa, Zea mays
APECHWCGTWKGDKICSSSKKARYCSEKHQALHWRTGHKNDCLQIISSAASNLVLPAVGIGFVRWFAKASNVHRLLVLDPSGLYSVLLYDQLTIHYLRLMALINNNKN

SEQ ID NO: 74838 - protein, 759 aa, Pseudomonas syringae pv. tomato str. DC3000
MLNTLRKIVQEVNSAKDLKAALGIIVLRVKEAMGSQVCSVYLLDAEVNRFVLMASEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVAGSPGAAVGVAVVMLPPADLEVVPDKTVTDIAAELTLFQNALEGVRNDMRTLSAKLATQLRPEERALFDVYLMMLDDASLGSEVTNVIKTGEWAQGALRSVVSEHVKRFELMDDAYLRERASDVKDLGRRLLAYLQEERQQALVYPDNTILVSEELTPAMLGEVPEGKLVGLVSVQGSGNSHVAILARAMGIPTVMGLVDFPYSKVDGIDLVVDGYHGEVFTNPSEIMRKQFGKVVEEERQLSQGLDALRELPCVTLDGHRMPLWVNTGLLADVARAQQRGAEGVGLYRTEVPFMINQRFPSEKEQLAIYREQLAAFHPLPVTMRSLDIGGDKSLSYFPIKEDNPFLGWRGIRVTLDHPEIFLVQTRAMLKASEGLNNLRILLPMISSTHEVEEALHLIHRAWGEVRDEGTDVPMPPVGVMIEVPAAVYQTRDLARQVDFLSVGSNDLTQYLLAVDRNNPRVADLYDYLHPAVLQALQSVVRDAHAEGKPVSICGEMAGDPAAAVLLMAMGFDSLSMNATNLPKVKWMLRQINLSKAKELLAQLMTNDNPQVISSSLQLALKNLGLSRMINPGSVKGH

SEQ ID NO: 74839 - protein, 132 aa, Glycine max
LISLAFTQLILLASPLPSDLLPPSSVPAKMSTVTRAYLDQRLAAAKRCSKEAAMAGAKAAAVATVATAVPTLASVRMLPWAKAHLNPTGQALIISTVAGMAYFIVADKTILSMARKHSYETAPEHLKNTSFN

SEQ ID NO: 74840 - protein, 533 aa, Ustilago maydis 521
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDVWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 74841 - protein, 133 aa, Myxococcus xanthus DK 1622
MAYSDKVIEHYENPRNVGTLDKEDPNVGTGLVGAPACGDVMRLQLKISEDGLIEDARFKTFGCGSAIASSSLVTEWVKGKTVDQAMTISNKDVARELSLPPVKIHCSVLAEDAIKAAIEDFKKKRAARQAKAS

SEQ ID NO: 74842 - protein, 436 aa, Streptomyces lincolnensis
MTDATHRVAVCGLWHLGSTAAAGLLTHGRAVVAYEPQEHCGRRAAATPPTGEPGVGEVLRRGLREGRLRVADALAEWARNALCVLAYDSAVDADGGVDDARLAQAVAAFARHAPAGATLAVLSQVPAHTQCAWRRTLLAHRPDVNLVHIPENLRLGRAMDDFVAPARLVVGAEERCTAERTARSLFPRATPAYVTLTEAELVKHATNAYLGMCVSFGNELGWLAAHLGADPQVVARLLKADPRVADAAPLLPGAAFSGATLRRDLVALSRIGAKWGRPEFFDTVLTVNDRHAAFPLDLLGAELGNLKDRRIALAGLTYKAGHATLRDSLPLRLVRTLLTDGAEVVAYDPVAEDLPDDVGARRAATLADAVPAPNACLVAAALPELDGADWAGLRPAARLVVDGCGALDPAALSAAGWRCLGLHPRWQEVTGAHAAP

SEQ ID NO: 74843 - protein, 517 aa, Bifidobacterium longum NCC2705
MTTTTASPVSKQTASAAQETSATGAAATAIETIETGVAGVAGAATNAAANAIEDLEAAESHGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 74844 - protein, 456 aa, Corynebacterium glutamicum ATCC 13032
MALKGYTNFDGEFIEFGSVQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 74845 - protein, 172 aa, Aquifex aeolicus VF5
MAIIKPYKGKYPKIHESVYLSENVVVIGDVEIGEDSSIWFGSVVRGDVNYIRIGKRTNIQDNCVVHVTHDTHPTIIGDNVTIGHRVVLHGCVLHNNILVGMGAVVMDGVEIEDYVIVGAGALVTPNKKIPSGVLVAGVPAKIVRDLREEEIKLIEESAQNYVNYKNEYLRSA

SEQ ID NO: 74846 - protein, 281 aa, Stevia rebaudiana
AWCFKAEHHGGKDYHDPPPAPLIDGEELTKWSFYRAVIAEFIATLLFLYVTVLTVIGYKSQTDPNLNTDQCGGVGILGIAWAFGGMIFILVYCTAGISGGHINPAVTFGLFLARKVSLIRALLYMVAQCLGAICGVGLVKAFQSSYYNRYGGGANELADGYNKGTGLGTEIIGTFVLVYTVFSATDPKRSARDSHVPVLAPLPIGFAVFMVHLATIPITGTGINPARSFGAAVIYNKDKAWDDQWIFWVGPFIGAAIAAFYHQFVLRAGAIKALGSFRSNA

SEQ ID NO: 74847 - protein, 179 aa, Picea sitchensis
MVGGQKPLNTSTPCAACKLLRRRCAQECPFSPYFSPHEPQKFASVHKIFGASNVSKMLMEVPESQRSDTANSLVYEANARLRDPVYGSMGVISTLQHQIQSLQSELNVVRAELVRYRCNQDQNAVTATPSMVNLRGYPPVSSSICSQTASESVDFAAVSPSTTLTNMSDNKGTIRPWKS

SEQ ID NO: 74848 - protein, 2479 aa, Coccidioides immitis RS
MDGDPALDGLRGLYQDLSALSRNALPNVDRLVLELQATVGDFRKLLDKDPKKNESRQAVLSGKITLENLEYSLNDDFQQAVLQVADALDIDEIQAAAYYLQAQLDSVKLDRSPVMVAIIRFHERRAFLLECLRLILRESFEIEREDTRALMQDIVAMILEIQNGPLRNGSLYARKCMDSMGDIERWLVLLGEQIQKASIVGQAQASDVLEVIEYQRHSLGRQHESLGAILSYLFKGTFTSSEDFRKLLEKLKKNERFDMLLIHYIPALISAISQYGSSEGQGPLREARSLHLAITGNKESTSCALPKFHAALVVLWLAEYAGWYFDSGPASPLQGINPGDELAALTQMFMAALEDGGLEFILLVCSGITSEEWVAPARNELVGLLLKDAASLTVEPDAPSPYFRDLLMEGLETFTESLIANMPDAIRQLRSEEDLQRLDQMTALREATNTSLHRGLVEPRMHLESLLVIIAFTFDHRDEAAQEFWADTDSNLYGFLQWVSKRQTVPRVSAFCEMLCSLSGGEENSASAHRFLLDEDASSSKFRRSTSMNWDQMFAELQLYATRVTERPSAAQPSILRNRKPESVDIDEPESPVMLTCYLRLISHLCKENGQIRDWILQHPTANLSNTLLTLCAAPIPHHLRAAIFVTLRCLMIQRTAVHGNEMWALIDQWISGSGASPLSLTKLPALSSSPALNERHAFQRIMESFDQTNAFVELLTILVSPTVDLPGSHICLHFPESLGSSYRMPGIEPYIDFVMGQALANKSTVLDGKEARLLQWNCLSFAATCIESFNENLVSLVNQTTISANTTVGSVPLPTYLRLHPFSRVMEWMFNEDVLRALFSCSHQDIGDVANASSDSMLLCSLIRSIEVMNLILDHQATFFDIVRPFIRSFPQQGMSTMANASLASFEDSMMDNLSLISDLCLYCGTGHPQLTLVSLALLEKLSASRKLNRPTATFSQWQTSNQIVELLNTNVDADRIARSLAAQMASDIRELENGPEASGYLIKLGLVQLLDRCLKAIPNKPTVAHVLLGFRCVGSSLDVAPGSLFDNGLSLLHAISDFVRTYPDGNQGMITSWMVHLKRLAFQVLQYLWTSPLSSPLILPQLRANRLLANILISQPVIGPDLLWDEFRITVPEFWFTESAVALSEFLVYRSIIFDYATTEIRAVFNKSSPSFQKDILSTLLGASVAEDGQTISHSSIFDLFDFADLDIDWAYAFPDLKFFRDVDVSLCTTPQQDGHPVLYDLPSVESLLQLAKDHLVSAGQVNAQEEDQISSERDKLLLFLRATNQSRQVRYNRLVALRSWVELVITVLITCDMEPARMVTLILHTLQAILPKLESSFAGNAAEAIELARLAETLVEKLDTVSTNSTEDVIDERLHHLFQACIRGIPNILEETVLRETFYHICSRYLTRITQRSTAKARFGPRAQQVIKSTGSGLVDTICDDAYSGDEGCRVSALILLNLLSVLDEQQSSSILVTLISQSNYLSMFLGVIRAMASEFRNTQAAPLLSLLQQLSQTKMGAIRLLDAGLFQAVKESQIFAADPDIGLDIDNPDALRKYYDLLLSVLRVIVSTVFTRGLHNNQIVEQTRNFLSENRQSMVGIFKRYAKIGGLEGVGTQESLEELVKSYAALIAAVDFLEIKLTDSHVRILISSKVVPTLCLHKPQVQMQNHGTRGTRKPGGKRKLCDGNSETAEDLVRNSQGTIPDLFSRGRNTIFGHKSRQLSPTSKRLKRNELDPQQQSPSKQSQPAQERISVERMYNFPNQSAKSSSLGQQNSRTVPRTYLNPSSTPSNFTPHTGPKRLTVKNLRAVPKLDQEQYFEKIWAQLNTALTAIFNEQKPSFSLEELYKGAENVCRQKRAQSLAKKLQERCKVYISETVLPSLLAKSKDSDDIVVLRAVEAAWSAWSSRLVTIRSIFYYLDQSFLLRSPEHPTIYEMGTIGFRSIVFSNPSLKPKMLQGACQLVDLDRNNDASSDSTLLRNAIKLFSDLRVYKSEFEPAMLEASDRYLKAWADNEANSSYLATYRIDLGSKLKPAFTSFILEEGSSIVFDKEREGEMVVRLLDFKQNLDDILAKSFQKDELLARALRESFETFINKSQKGGDVAQPGEMIAKHVDLLLRGGLKSIRKRQVPLKNDEDIAMIDEDAELNKALDQVLDLFRFVHGKAVFEAFYKNDLARRLLMGRSASDDAEKSMLARLASECGSNFTHNLESMFKDIDLARDEMASYNALLREKREKTNLDLYVNVLSSAAWPSYPDVPVKVPRIISSALSDFEHFYNNKYNGRKLNWKHSLAHCQLKARFPSGNKEIVVSSFQAIVLLLFNDVADGQTLSYHDIRDETGLSDIELKRTLQSLACAKYRVLIKHPKGRDINATDTFSFNTRFSDPKMRIKINQIQLKETKEENKETHERVAADRNYETQAAIVRIMKSRKTISPQELIVEVIKATRNRGDLDPADIKKNIDKLIEKEYMERDTESNKYKYIA

SEQ ID NO: 74849 - protein, 438 aa, Arabidopsis thaliana
MEGRLANMWRLTVNESKFVETALQSELRVDGRGLYDYRKLTIKFGKEYGSSEVQLGQTHVMGFVTAQLVQPYKDRPNEGSLSIFTEFSPMADPSFEPGRPGESAVELGRIIDRGLRESRAVDTESLCVLAGKMVWSVRIDLHILDNGGNLVDAANIAALAALMTFRRPDCTVGGENGQEVIIHPLEEREPLPLIIHHLPIAFTFGFFNKGNIVVMDPTYVEEAVMCGRMTVTVNANGDICAIQKPGEEGVNQSVILHCLRLASSRAAATTKIIREEVEAYNCERSLQKVKRHPTLAKSEVSGPTVAVKEEHRKSSDQERAAEISREHVERLKLSTEEVRSSKEEEAANFKGGPSNWDPYSEAMDVDSLKVSLASRGDPVTKSSSTKKMNGSGNAQKVGVEISVEEVTGELGKKDTKHKDGEMTLKDAVKPKKKRKNKS

SEQ ID NO: 74850 - protein, 770 aa, Oryza sativa Indica Group
MTVTPRITVAEGRLVAHGRTILTGVADNIALTHASGAGLVDGAFVGATADEPKSLHVFTFGTLRDLRFMCCFRFKLWWMTQRMGTSGRDVPLETQFMLLESRDGGGGGGGEAVYVVMLPLLEGQFRAALQGNDRDELEICIESGDKAVQTAQGTYMVYVHAGANPFDTITQAVKVVERHLQTFHHREKKKLPSFLDWFGWCTWDAFYTDVTADGVKQGLQSLAEGGTPPRFLIIDDGWQQIGSENKEDAGNAVVQEGAQFASRLIGIKENTKFQKTTTTAMADGGETAASAAGLKALVEEAKKEHGVKYVYVWHAMAGYWGGVKPAAEGMEHYESAVAFPVQSPGVMGNQPDIVMDSLSVLGLGLVHPRMALAFYGELHAYLASCGVDGVKVDAQNIIETLGAGHGGRVSLTRAFHRALEASVARSFPDNGCISCMCHNTDMLYSARQTAVVRASDDFYPLDPASHTIHISSVAYNTLFLGEFMQPDWDMFHSLHPAAEYHGAARAIGGCPIYVSDKPGNHNFELLKKLVLPDGSVLRARLPGRPTRDCLFVDPARDGASLLKIWNVNKCTGVVGVFNCQGAGWCRISKKTRVHDAAPGTLTGSVRADDVDAIADVAGTGWTGDAVVYAHRSGELIRLPKGATLPVTLKVLEFELFHVCPVMTVAPGGGGGGGVTFAPIGLLDMFNSGGAVEECDVVRALDAAGEAEAAVVRLRARGCGRFGAYSSRRPARCALDAAEVEFSYDADTGLVALDVPVPAHELYKWTVEIQV

SEQ ID NO: 74851 - protein, 426 aa, Thermosynechococcus elongatus BP-1
MNIAVIGLSHKTAPVDVREKLSVPEDVRERALQHLCGYAHIQEATILSTCNRLEIYIVTSDTEVGVREVHQFLSEWSHIPLPQLRPYLFILLHQDAVMHLMRVASGLDSLVIGEGQILSQVKRCHQLGQQYKSIGPILNRVFTGAIAAGKRVRTETSIGTGAVSISSAAVELADLRLQNLQNCRIAVVGAGKMSRLVVQHLIARGVKEIRIINRSLERAQELAQQFPEVRFELFTMTDLLPIVAAMDLVFTSTAATEPLLDRDNLGAVLVGDRSLAIIDISVPRNVHANVTELGTVQLFNVDDLQAVVAQNQEARRQLAQEAEGILEEELETFLAWWHALETVPIIRSLRQKMEAIRTQELEKALSRLGSEFADKHQGVIEAMTRTIINKILHDPTVQLQSQRDLESRQRAMQTLQDLFNLEPIEA

SEQ ID NO: 74852 - protein, 227 aa, Xanthomonas campestris pv. campestris str. ATCC 33913
MPASSLHQMLAAIQAAAPPNAAPARLLAVSKTQPADAVAGLAAQGQQAFGENYVQEAATKIAQLQALQLEWHLIGHLQSNKADMASQCFDWVQTVDRAKLIALLARHRPDGRAPLNVLIQVNIDDEDSKHGCAPEAIDVLAAEIATHPPLQLRGLMAIPAPFPEVTRRHQAFARMQALFATLRSQYPQADTLSMGMSADFADAIAAGATMVRVGTALFGQRNAPPAA

SEQ ID NO: 74853 - protein, 431 aa, Lupinus luteus
MPSIAHSHVAAEPQHPKGENKQKNEGRNRRVLKDIGNLVVKQADPVANVPKRTTRNFGCQLLANAQAAAEKNKKPNTDVGNLAVVTKVEQTKKETEHEVIIISSDDEEEEKEKQVVKGGRKAREKVAGRGKNDKAFSAVLSARSKAACGLTHKPKDLVLVDDIDVADIANELEAVEYLDDIYKFYKLTEDDGRVHDYMPSQPDINIKMRSILFDWLIEVHRKFELMQETLYLTLNIVDRFLSMKAVPRRELQLVGISSMLIACKYEEIWAPEVHDFVCISDNAYVRENILIMEKTILSKLEWYLTVPTTYVFLVRYIKASTPYDKKIEDMIFFLAELSLMDYPLVISYCPSMIAASAVYAARCILGRVPYWTETLKHYTGYYEEQLRDCAKLMVNFHSVAPESKLRAVYKKFSSLERGAVALVAPTKNLLA

SEQ ID NO: 74854 - protein, 391 aa, Vitis vinifera
MVSDQDIAKGVETLLRQSEPNSFTSLNGIVKQLEAKLGLDLSHKAVFIRDQISFLLRSHPQPLPPKDHFALQQHPQFLSPHPQIPSHFALQHHRPPPEDLNFLVAAQAPKERSVFPQCVGLVLFGLAEMLILGFVWFNFMVRVVILCFFGFVIRVSESIGYTNPSLLSYLSRFILMLNYCNLLLLVSGAPIMAKPSAAKRRGGSGGLNKVCGVSTELQAVVGEPTMPRTQIVKQLWAYIRKNNLQDPSNKRKIICDDALRLVFETDSTDMFKMNKLLAKHIIPLEPSRESSQAKRLKVDVESATESSEASPSPVMISDALATFFGTGEREMLQEEALRRVWEYIKVNQLEDPLNSMAILCDAKLQELFGCESISALGVSEMLARHHLFKRS

SEQ ID NO: 74855 - protein, 284 aa, Actinobacillus pleuropneumoniae serovar 1 str. 4074
MLQNEVENFANLLEQATVYLAPYQEKIIVVKYGGNAMINEDRKKLVMQDILLLNQLGVKVVLVHGGGPEISQGVKLLGKEPQFINGLRVTDQDTINVVLQMLAGKVNKSLVALLKGKGVGLCGIDANMLQCEKLQAEVDYGFVGEIVKVNTQLLELALSANLIPVISTVGVDDQGVAYNINADTVASEIAMALGAAKLVSMTDIAGLLRDRFDESTLIPEVEVSEVQGLIDQGIIAGGMIPKIACCTDFINAGGIEANIIDGRVPHAILVSLFGGKNGTLFYKK

SEQ ID NO: 74856 - protein, 512 aa, Gloeobacter violaceus PCC 7421
MATDSTTPFPIAPPAGPCAMVVFGAAGDLTGRLLVPALYNLAAGGLLGEKFVLIGLARAPLTDTNFRTQLGEALQRHGTAAVNPAVWDALAQRFFYLEANFEAPDTYARLRQRLAEAEAEFNTDGNTLFYLATAPEHFGGIVEQLGWAGLSREETGHWRRVVLEKPFGQDLASAQALNARLRRDLSESQVYRIDHYLGKETVQNILVLRFANGLFEPLWNRNHIDHVQITVAESVGVEKRGGYYERAGALRDMVPNHLFQLLALTAMEPPTCFGADAVRTEKTKLLEAVQTLKPAQISTHVVRAQYAAGTVGERALPDYRAEPRVAPDSTTETFVALKLAVDNWRWAGVPFYLRTGKALARRSTEIAIRFKQAPYAMFRDTPVERLTPNYLVLHIQPEERISLEFGAKVPGPAVRMAGVGMDFCYNRHFGGERAIGYETLLYDCMMGDATLFQRSDTVEAAWQVVEPIFAAWNDSTADLVTYPAGSWGPQQAEELLGRDGRQWRRADHDSCG

SEQ ID NO: 74857 - protein, 310 aa, Xanthomonas campestris pv. campestris str. ATCC 33913
MASATRHRPPDTSAVSFLLLDGAAMTQPSSSTAVAAHGDVPVVAFVGGGNMARSLIAGLLRQGAPASAIRVAEPVAELRQALSADFGVQVFDDARSAVEGAALWVLAVKPQVMSTVCTQLADLAQQQHPLLLSIAAGITATQLERWCGGTAAVVRAMPNTPALLGAGVTGLYANARVSAAQRTQATRLLESAGVTVWLDDEAQMDAVTAVSGSGPAYVFLLAEAMEAAARAQGLPAETARTLVLHTLLGAARMLTESGEAPEVLRRRVTSPNGTTQAAIEEFQAGGFEALTATAIAAATERGRSLSAAND

SEQ ID NO: 74858 - protein, 338 aa, Vitis vinifera
MSMKSAQSSYRDRTQEFLNVAERLKKSFSSAAPNAVTSSGAKPDGTRSSLAIQKEFKDRASRIGYGIHQTSQKLAKLAKLAKRTSVFDDPTMEIQELTAVVKQDITALNAAVVDLQLLCNSQNESGNISSDTTSHSTTVVDDLKNRLMSATKEFKDVLTMRTENLKVHENRRQLFSSTASKESTNPFVRQRPLAAKSTATASSSPPPWANESSSSSPLFPRKQGNVESQPLLQQQQQQQQLVPLQDSYMQSRAEALQNVESTIHELSNIFTQLATMVSQQGELAIRIDENMEDTLANVEGAQGQLVRYLNSISSNRWLMIKIFFVLIVFLMIFLFFVA

SEQ ID NO: 74859 - protein, 393 aa, Actinobacillus pleuropneumoniae serovar 1 str. 4074
MNSNDIKQLDADYIAQTYGRFNLALSHGKGCDVWDFEGNQYLDFTSGIGTNSLGWADDGWLAAVTTQAGKLQHTSNIFFTEPSAVLAKSLVEASGLKRVFFCNSGAEANEGAIKTARKYSHDKYGKGRATLLSLVNSFHGRTISTLAATGQDVFHQHFFPFTQGFEHTPANDLDALHARIEQDDVCAIILEIVQGEGGVCALDTEYLQGVQAICQAKDIILIIDEVQTGIGRTGKLFAYQHFGLQPDIITLAKGLGGGLPIGAFVLGGKCQNTLGKSDHGSTFGANPVCCAAANAVLAKIDEKFLADVAAKGEKLRAALLTLPKVKSVSGLGLMLGIEFEDGVKAADVVAKAIEKGVLTLTAKTKLRLLPPLVISEQQIDHGVAVLREVLESL

SEQ ID NO: 74860 - protein, 118 aa, Glycine max
MPEEEVVELKFRLYDGSDIGPFRYSPASTIAMLKDRIFADWPKDKKIIPKAANDIKLISAGKILENHKTVGQCRVPFGELPKGVITMHVVVQPSLLKAKTEKKVDEVPRKHICACSIL

SEQ ID NO: 74861 - protein, 156 aa, Streptococcus pneumoniae
MKNDRKAQLIITIFKYGKRHVGRSTFYHKLNYKMYQILNAIFVIGIFNTELPASQNISDNIILFHPYGIIVNGDVTLGNNVVIRQQVTIGNKGMERDVGKSPIIEAGVDIGAGAKIIGGITIGEGSKVGANAVVTKSFPPGSILVGVPARNIALEK

SEQ ID NO: 74862 - protein, 313 aa, Vitis vinifera
MAGGGNRRDDGSLVINSTNVFAALGSLRKKKKSEKERASKKAESTEQPQVFWAPTPLTVKSWADVDDEDDDDYYATTAPPQSGWGPADPPKAKESVTPVEESESEEEGIDEIDDDNEEEHENEHEPEVPVEKEPVIKKPPAASLPPKDTERQLSKKELKKKGLEELDAVLAELGLIESCGQDESHGAGEEKKAENLSGELEKKENAPGESKSAKKKKKKDKASKETKEPQDQPNDAEEGNGMEETTVPEKAEDAAAVDMKERLKKMASMKKKKSSKELDAAAKAAASEAAARSARLAAAKKKEKNHYNQQPVR

SEQ ID NO: 74863 - protein, 459 aa, Lupinus luteus
MASRPVVPIHQQQVRGEGVIGGGKQKKNVAADGKNRRALGDIGNLDRVKGVEVKPNRPITRSFCAQLLANAQVAAAVENNKKLAIPNVGGAKPNVVEGAVAKRVAPKPAEKKVVEKPKPREAVEISPHEEVQKNKSVVKKKEGGENKKKPQTLSSVLTARSKAACGLTKKPQEQIIDIDANDSGNELAALEYIEDIYKFYKLEESESRPHQYLDSQPEINERMRAILVDWLIDVNNKFDLSLETLYLTINIVDRFLAVKVVPRRELQLLGISAMLLASKYEEIWPPEVNDFVCLSDRAYTHEQILVMEKIILGKLEWTLTVPTPYVFLVRFIKASVPDQELENMSHFLSELGMMHYSTLMYCPSMVAASAVFAARCTLNKTPFWNETLKLHTSYSEEQLMDCAKLLVSFHSTIGGGKLKVVHRKYSDPQKGAVAVLPPAKYLMPESSSSGTRVSKGLDK

SEQ ID NO: 74864 - protein, 133 aa, Acidovorax sp. JS42
MAYSDKVIDHYENPRNVGSFDKGDDSVGTGMVGAPACGDVMKLQIKVNPDTGVIEDARFKTYGCGSAIASSSLVTEWVKGKTLDEAASLKNSQIAEELALPPVKIHCSILAEDAIKAAVNDYKAKHGAAVEAA

SEQ ID NO: 74865 - protein, 319 aa, Metasequoia glyptostroboides
MAAAAALKTPISLGRSEWFGQTLRPTSSSSLSLQTHSLSTSPALNVRASAYSDELVKTAKTVASPGRGILAMDESNATCGKRLASIGLENTEANRQAYRQLLVSAPGLRQYISGAILFEETLYQSTTDGKKIVDVLVSQNIVPGIKVDKGLVPLAGSNDESWCQGLDGLASRCAAYYQQGARFAKWRTVVSIPNGPSALAVKEAAWGLARYAAISQDNGLVPIVEPEILLDGDHGIDRTFEVAKKVWAEVFFYLAENNVMFEGILLKPSMVTPGAEHKERASPTTVSEYTIKLLRSRVPPAVPGIMFPLWRAIRGGRRR

SEQ ID NO: 74866 - protein, 287 aa, Metasequoia glyptostroboides
MSCFKGKYHDELIANANYIATPGKGILAADESTGTIGKRLASINVENVESNRRALRELLFTAPGALPLISGVILFEETLYQKASDGTTFVDILTSAGVLPGIKVDKGTVDLAGTAGETTTQGLDGLGQRCATYYKAGARFAKWRAVLKIGPTEPSQLAIQENANGLARYAIICQENGLVPIVEPEILVDGSHSIDVCADVTERVVAACYKALNDHKVLLEGTLLKPNMVTPGIRRPQSQPGRYCSVHCPGSAADRATRRARDYVLVRWAERGGGHLELECHEQAAGR

SEQ ID NO: 74867 - protein, 611 aa, Pisum sativum
MGKSSKKSATKVDAAPVVVSPVKSGKKGKRQAEEEIKKVSAKKQKVEEVIAKQKKEAVVQKVKDESSSEEDSSESEDEKPVVKPAAPVKKTPAKNGNAKKAKPDSSSSDSESDEDESSDEDDVSAKKPAKVAVAAKPKQAPKKEESSDESDDESDEDSSEDEKPAPKAVPAKNGSAPAKKAASSSDEESDEDSSSDEEAPKAKVVPAAVKPAAAKKKAESSDSDSSEDSDDEEDTKPTVTAVSKSAAVAKKTEDDDEDSSDEEDSSSDEDNKTSKPSNGNKKPVTVSKKEDKMNVDKDSSDSDEESDSDEESESEDEPSKTPQKKTKDVEMIDADKSSKKAPATPATPSENGGSKTLFVGNLSFSVQRSDIESFFQECGEVVDVRLASDEDGRFKGFGHVEFATAEAAQSALELNGQELLQRGVRLDLARERGAFTPNSTGNQNSGRGQSQTVFVRGFDKSLGEDEIRAKLEQHFASCGQASRVSIPKDYDTGYSKGFAYMDFKDSDSFNKAIELHGSELDGYPLSIDEAKPRESTGFGGRGTPRGGGSRGRGGRFGDRNSGGRFGDRSGGGRSGGRDGGRGGRRGGGRFGFNKPSLAPEGTGKKTTFADD

SEQ ID NO: 74868 - protein, 417 aa, Rhodococcus sp. RHA1
MAQEFRLPDLGEGLTEAELVSWAVEVGQTIELNQVIGEVETAKALVELPSPYAGVVEELLVPAGATVPVGTPIIRVATNAATEEPPARTPVLVGYGPEAAAESKRARRRLVTAPETGTSGPDRRRPDASPAARATARELGVDLAVVAGTGPSGAVTRNDVESHAGSAGQSVPSTPEPPEPSEQSERETRTPIRSVRKQTAAAMVRSAFTAPHVTEFVTVDVTRSVELLERLRGLPDFEGLSVTPLSLVAKAMIVALRENPSLNASWDEENQEIVTKHYVNLGIAAATPRGLVVPNIKEAQSLSLLELCRAITELTATARSGRAEPAQLTGGTVSITNVGVFGVDAGTPILNPGESAILCLGSVTRRPWVHEDELAVRWVTTLSVSFDHRVVDGEQGSRFLSSVAAMLHDPASLLAHL

SEQ ID NO: 74869 - protein, 601 aa, Salmonella enterica subsp. enterica serovar Paratyphi A str.
MEGADLLTAGVLFLFAAVAAVPLAARLGIGAVLGYLLAGIAIGPWGLGFISDVDEILHFSELGVVFLMFIIGLELNPSRLWQLRRSIFGVGAAQVLLSAAVLAGLLMLADFLWQAAVVGGIGLAMSSTAMALQLMREKGMNRSESGQLGFSVLLFQDLAVIPALALVPLLAGSADEHFDWFKVAMKVLAFAVMLIGGRYLLRPVFRFIAASGVREVFTAATLLLVLSAALFMDALGLSMALGTFIAGVLLAESEYRHELENAIDPFKGLLLGLFFISVGMSLNLGVLYTHLLWVAASVVILVVIKMLTLYLLARLYGIRSSERMQFASVLSQGGEFAFVLFSTASSQRLFQGDQMALLLVTVTLSMMTTPLLMKGIDKWLSRRLNGPEENDEKPWVEDDKPQVIVVGFGRFGQVIARLLMANKMRITVLERDIGAVNLMRKYGYKVYYGDATQVELLRSAGAEAAESIVITCNEPEDTMKLVALCQQHFPHLHILARARGRVEAHELLQAGVTQFSRETFSSALELGRKTLVSLGMHPHQAQRAQLHFRRLDMRMLRGLIPEHSDMVQISRAREARRELEEIFQREMQQERRQLDGWDEFE

SEQ ID NO: 74870 - protein, 401 aa, Pyrococcus abyssi GE5
MRIPEDVRKDIPLTQEVIYFDNTATSLTPKPVIEAMDEYYLRYRANVHRGVHRLSQMATQKYEESRKVVADFINAEFDEIAFTKNTSESLNLVALGLEHLFKKGDKIVTTPYEHHSNLLPWQRLAKKKGLKLEFIEGDDEGNLDLADAEKKIKGAKLVAVQHVSNALGVIHEVEELGKMVKEEGAIFVVDAAQSVGHMEVDVKKLKADFLAFSGHKGPMGPTGIGVLYINKEFFDVFEPPLIGGGTIEDVELCCYKLTEPPERFEAGTPNIGGAIGLAAGIKYIEKIGIDKIEKQERKLVKRTTEGLDELEIPWYGPRNLDKHAGVVSFNVPPLHPHDVASVLDEHKIMVRSGHHCALPVMKRLKINGTVRASFHVYNSLEEVETFLGVLEELVKSLRSSQ

SEQ ID NO: 74871 - protein, 635 aa, Salmonella enterica subsp. enterica serovar Paratyphi A str.
MIVFSSLQIRRGVRVLLDNASATINPGQKVGLVGKNGCGKSTLLALLKNEISADAGSFTLPGTWQLAWVNQETPALPQPAIEYVIDGDREYRHLEAQLNDANERNDGHAIASIHGKLDAIDAWTVRSRAASLLHGLGFSNDQLERPVSDFSGGWRMRLNLAQALICRSDLLLLDEPTNHLDLDAVIWLEKWLKSYPGTLILISHDRDFLDPIVDKIIHIEQQTLFEYTGNYSAFEVQRATRLAQQQAMYESQQERVAHLQSYIDRFRAKATKAKQAQSRIKMLERMELIAPAHVDNPFHFSFRAPESLPNPLLKMEKVSAGYGDRIILESIKLNLVPGSRIGLLGRNGAGKSTLIKLLAGELEPLHGEIGLAKGIKLGYFAQHQLEFLRADESPLQHMARLAPQELEQKLRDYLGGFGFQGDKVTEETQRFSGGEKARLVLALIVWQRPNLLLLDEPTNHLDLDMRQALTEALIDFEGALVVVSHDRHLIRSTTDDLYLVHDKKVEPFDGDLEDYQQWLSDVQKQENQADDAPKENNANSAQSRKDQKRREAELRTLTQPLRKEITRLEKEMEKLNAQLAQAEEKLGDSSLYDPSRKAEMTECLQLQASAKSGLEECEIAWLEAQEQLEQMMQND

SEQ ID NO: 74872 - protein, 126 aa, Brassica napus
MGGVTSSVAAKFAFFPPSPPSYKVVTDELTGLLLLAPFPHRENVEIHKLQTRRGTEIMAMYVRHPMATSTLLYSHGNATDLGQMYELFIELGIHLKVNLMGYDYSGYGYYCVLFAMICFFILIKSM

SEQ ID NO: 74873 - protein, 581 aa, Aspergillus nidulans FGSC A4
MEGVDFQSVLNKGKQMASNVAATATNGSTNKKRRKGTDLKPIVTSDSATPADQTGPTSDNVPPSRSGSSSSEEEIETTAEEEDSEDYCKGGYHPVQIGELYNNGRYVVVRKLGWGHFSTVWLSRDTTTGKHVALKVVRSAAHYTETAIDEIKLLNRIVQANPSHPGRKHVVSLLDSFEHKGPHGVHVCMVFEVLGENLLGLIKKWNHRGIPMPLVKQITKQVLLGLDYLHRECGIIHTDLKPENVLIEIGDVEQIVKTYVKEEAKKEQKEDNRNGRRRRRTLITGSQPLPSPLNTTFEFKHSSQNSHSSLSQVINESPGTSEAPSMRQLLGIKDEDEQQKQREKTAYVERLLEGTSLTDDSDLLEREVSGISLDKPSSDEDIDCGIISVKIADLGNACWVGHHFTNDIQTRQYRSPEVILGSKWGASTDIWSMACMVFELITGDYLFDPQSGTRYGKDDDHIAQVIELLGPFPKSLCLSGRWSQEIFNRKGELRNIHRLRHWSLPDVLREKYHFSVAQAKAISDFLLPMLEVLPERRANAGGMASHEWMKDTRGMQEVDLGLTPGSRGEGIEGWATEVKRR

SEQ ID NO: 74874 - protein, 336 aa, Burkholderia mallei ATCC 23344
MTIRVAINGYGRIGRNTLRAFYENGKKHDLEIVAINDLGDAKTNAHLTQYDTAHGKFPGEVSVDGDYLVVNGDRIRVLANRNPAELPWGELGVDVVMECTGFFTSKEKASAHLKGGAKKVIISAPGGKDVDATIVYGVNHDVLKAEHTVISNASCTTNCLAPLVKPLNDKIGLETGLMTTIHAYTNDQVLTDVYHEDLRRARSATHSQIPTKTGAAAAVGLVLPELNGKLDGYAIRVPTINVSIVDLSFIAKRDTTAAEVNAIMKEASEGALKGILGYNDAPLVSIDFNHNPASSTFDATLTKVSGRLVKVSSWYDNEWGFSNRMLDTAIALANAK

SEQ ID NO: 74875 - protein, 340 aa, Bifidobacterium longum NCC2705
MTTVLVTGGAGFIATHTDIELLDKGYDVISVDNYGNSSPVALERVEQITGKPVKRYDGDVRDEALMERVFTENDIDWVIHFAGLKAVGESVAKPIEYYDNNLYSTLVLLKTMRKHGVKKIIFSSSATVYGSPKELPITEETPTGGTTNPYGTSKLFQEQILRDVHVADPSWTIVLLRYFNPVGAHESGLLGEDPKGIPANLTPYVAKVAVGELKEVQVYGDDYDTPDGTGVRDYIHVVDLAKGHVAVIDHIDKEGVFVYNLGTGHGYSVLEVIKAYEKAAGHPIPYTIKPRRPGDIAACYADASKAEKELGWKAELTIDDMAASSLNWQTKNPNGFRDAE

SEQ ID NO: 74876 - protein, 450 aa, Pseudomonas viridiflava
MVNAALDQWKAVQAARLSQYSAVRVSGRVSAVRGILLECKLPAAKVGDLCEVSKADGSLLLAEIVGFTPDCTLLSALGAPDGIQVGATIRPLGIAHRIGVDDSLLGCVLDGFGRPLLGDALGAFAGPDDRRTTLPVIADALPPTQRPRISRALPTGVRAIDSAILLGEGQRVGLFAGAGCGKTTLMAELARNMDCDVIVFGLIGERGRELREFLDHELDETLRSRSVLVCATSDRSSMERARAAFTATAIAEAFRERGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGREHQRANNRLRQLMAAYKQVEMLLRLGEYQAGSDPVTDCAVKLNEDINAFLRQDLREPVPLEETLNALLRITSQLPE

SEQ ID NO: 74877 - protein, 252 aa, Desulfitobacterium hafniense DCB-2
MRLMNKVAIVTGAASGMGKSIALLYAKEGAKVVVSDLNLEGAHKVAEEITSAGGTALAIKTNVAVEEDIQALVDTAVSTYGTVDIFVNNAGIMDNFEPAADIEDKNWERIFAVNTTSVMRATRKVLPIFLEKSSGVIVNVASAGGLNGARAGATYTASKHAVIGFTKNTGFMYAQQGIRCNAIAPGAVETNIGSTITDPHKFGSARAYAGMATNPRMGKPEEIAQVALFLAAEESSFVNGAVIVADGGWSAY

SEQ ID NO: 74878 - protein, 242 aa, Vitis vinifera
MGFDNNEGAANTDLSETKSTAKTPADEERGDEHGGCENSVDATEEEEEEDEERKIELGPQFTLKEQLEKDKDDESLRRWKEQLLGSVDLNSVGETLEPDVKILELAIKSPGRPDIVLPIPESGNPKGLWFTLKEGSRYSMNFAFKVSNNIVSGLRCTNVVWKTGLKVDNTKEMLGTFSPQQETYTHEMPEETTPSGIFARGTYSAKTKVSSTNSLGFLSLQFFFITPNNSPELKKEKLGIGF

SEQ ID NO: 74879 - protein, 98 aa, Glycine max
  misc_feature (83)..(83): Xaa can be any naturally occurring amino acid
  misc_feature (87)..(87): Xaa can be any naturally occurring amino acid
TRAESPLFAPFTVLKTMAGLPTIKTTNYITSIANNGGRVQCMQVCPPVGKKKFDTLSYLPNLDDAQLAKEVQYLLRKGWIPCXEIRXDHGLEYREHNR

SEQ ID NO: 74880 - protein, 411 aa, marine gamma proteobacterium HTCC2080
MAIEIKAPAFPESVADGEVAAWHKAEGDTVARDELLVEIETDKVVMEVVAPESGVLTSIVAVEGETIESEALLAVLEAGEVTQSAPSSSSTSKTVEPVQPSESGEHAMGPAARAMIDEHGIDPAAITGSGKGGRVTKEDVTKHLKNSAQAAPVKPAPTAPATPAVTTIPNDSFGPSSERIEKRVPMTRMRARIAERLLEATQQTAMLTTFNEVNMAPLMKLRSQYKESFEKAHNGTRLGFMGFFVKACCEALKRYPAVNASIDGSDVVYHGYQDIGVAVSTNDGLVVPVLRDADFMSIADVEAAIRDLGLKAQDKKLTIEEMTGGTFTVSNGGVFGSLLSTPILNPPQTGILGMHTIQERPVAVNGEVVIQPMMYLALSYDHRLIDGKTAVQFLVTVKGFIEDPARILLQL

SEQ ID NO: 74881 - protein, 320 aa, Desulfitobacterium hafniense DCB-2
MTVDKTNLEIATFAGGCFWCMESVYSPLPGVLEVLSGYTGGHVENPTYNEVCSHTTGHREAIQIKFNPNIVSYKELLAFFWRQIDPTDPGGQFHDRGESYQTAIFYHSEEQRRLAEESKQALISSSHFDKPIVTEILPAAPFYPAEDYHQGYHQKNAFRYALYRQGSGRDAFINKHWAKEKEQLKKRLTPLQFHVTQEKGTEPPFQNEFWNNKQEGIYVDVVSGEPLFSSKDKFDSGCGWPSFTRPVLKSNIVEKIDLSHNMTRTEVVSRNSESHLGHVFDDGPGPDGLRYCINSAALRFIPKEDLEREGYGDLLRLFRD

SEQ ID NO: 74882 - protein, 401 aa, marine gamma proteobacterium HTCC2080
MTASYDVIVIGSGPAGYVCAIRCAQLGKKVAVVEQWADDKGKPVLGGTCLNVGCIPSKALLDSSHKFLEAKEHFADHGIGIGETQINVATMMQRKDQIVGQLTGGVAGLLKHNQIDVVQGRGKLLANRKVQVLSSDGTESVHEAENIVLAAGSLPIDIPVAPVDQVHIVDSTGALVFESVPERLGVIGAGVIGLELGSVWGRLGAEVVLLEAMDGFLPSMDAQIAKEGQKLFKKQGLDIRLGARVTGSEVIDGQVHVSYAMGEETHTEIFDRLIVSVGRRPQTGELFAEDSGVTMDERGCVFVNEVCSTEAPGVWAIGDMVRGPMLAHKGSEEGVMVAEQIAGHHHPLNYDLIPSIIYTHPEIAGVGKTEQELKAEGVKVKVGTFPFAAIGRALAAATATE

SEQ ID NO: 74883 - protein, 452 aa, Lupinus luteus
MASRPTVRLQQQARDEEVVGGGKQQKNGAGDGKNRKALGDIGNLDHVKPNRPVTRSFCAQLLANAQAAAAAENKKKLAIPNVADPKPNVADGVVAKRVAPKPAEKKVTAKPKAQEVIEINPAEEAQKNKSVNKKKEGGENKKKSRTLTSVLTARSKAACGLTNKPKEKIIDIDAGDSGNELAAVEYIEDIYKFYKLAENENRPHQYMDSQPDINEKMRAILVDWLINVHTKFDLSLETLYLTINIIDRFLALKTVPRKELQLVGISAMLMASKYEEIWPPEVDEFVCLSDRAFIHEEVLAMEKIILGKLEWTLTVPTPYVFLVRFIKASVPDQELENMAHFLSELGMMHYGTLMYCPSMIAASAVFAARCTLNKTPIWNETLKLHTGYSKEQLMDCAKLLVSFHSSIRGEKLKVLYRKYSDPERGAVAVLSPAKNLMSEGGGIDLSVVENNI

SEQ ID NO: 74884 - protein, 250 aa, uncultured proteobacterium QS1
MGIQQTADKWVLVTGGSRGIGRSLVSALAQEGYRVAFTFQSSADAATELERTVAAAGGDARGYVCDGRDYDSVERVCTQLVDDIGEPYALINNMGITGDQLLLNFDIGRYRDVIATNLDSAVYFSKCLAPAMASVRCGKILHMSSVSGFKGNKGQLSYSASKAAMVGITKTMAQELARFKITVNAIAPGFIATEMVEQIADPIRKSITETIPLKRFGETYEVAALVSFLLSANANYITGQTFVIDGGLTA

SEQ ID NO: 74885 - protein, 333 aa, Nitrosospira multiformis
MTIKVGINGFGRIGRMVFRAAVQNFPDIEVVAINDLLEPDYLAYMLQHDSVHGRFKGDVSIEDSTLIVNGKRIRLTAIKDPAVLKWGEVGAEVVVESTGLFLTKESCQKHIAAGAKKVIMSAPSKDDTPMFVYGVNNDSYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICNAMKKASEGSMKGVLAYTDQKVVSTDFRGESATSIFDAEAGMALDGNFVKVVSWYDNEWGYSSKILEMVRVVAGK

SEQ ID NO: 74886 - protein, 333 aa, Nitrosospira sp. HBN8222A
MTIKVGINGFGRIGRMVFRAAVQNFPDIEVVAINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGKALDGNFVKVVSWYDNEWGYSSKILEMVRVVAGK

SEQ ID NO: 74887 - protein, 344 aa, Mycoplasma genitalium
MKLLKRKQSDASLKLSIDNKKHVIFSLSKSKTLVENICKKLNISEGKMVCEHFADGETYIRFDESVRNKDIYIFQSTCPNVNDSLMELLIAIDALKRGSAKSITAILPYYGYARQDRKTKGREPITSKLIADMLTKAGANRVVLTDIHSDQTQGFFDIPVDSLRTYHIFLFRVIELLGKKDLVVVSPDYGGVKRARLIANTLELPLAIIDKRRPSHNVAESINVLGEVKNKNCLIVDDMIDTGGTVIAAAKLLQKEQAKKVCVMATHGLFNNDAEQKFMEAFDQKLIDFLFVSNSIPQYKFKAVKQFEVVDLASLYEEVVLCYANSLSVSAIYERHIEWIKKHV

SEQ ID NO: 74888 - protein, 333 aa, Nitrosospira sp. PM2
MTIKVGINGFGRIGRMVFRAAVQNFPDIEVVAINDLLEPDYLAYMLQHDSVHGRFKGDVSIEDSTPIVNGKKVRLTAIKDPAELKWGEVGAEVVVESTGLFLTKESCQKHIAAGAKKVIMSAPSKDDTPMFVYGVNNDSYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICNAMKKASEGAMKGVLAYTDQKVVSTDFRGESATSIFDAEAGMALDGNFVKVVSWYDNEWGYSSKILEMVRVVAGK

SEQ ID NO: 74889 - protein, 218 aa, Vibrio fischeri ES114
MTQDEMKKAAGWAALEYVEAGSIVGVGTGSTVNHFIDALATMKNEIKGAVSSSVASTEKLKELGIEVFDCNDVAGLDVYVDGADEINGKNEMIKGGGAALTREKIVAAISDKFICIVDDTKQVDVLGQFPLPVEVIPMARSYVARELVKLGGDPAYREGVITDNGNVILDVHGMKITDAKDLEDKINALPGVVTVGLFAHRGADVLLVGAPEGVKKFD

SEQ ID NO: 74890 - protein, 70 aa, Arabidopsis thaliana
MIKPDGVQRGLIGEVICRFEKKGFTLKGLKLISVERSFAEKHYRKEPLFLFKGPFLQWGPRLWELHFLGV

SEQ ID NO: 74891 - protein, 278 aa, Oryza sativa Indica Group
MSAAAASSPAPRLESKVALVTGGASGIGEAIVRLFREHGAKVCIADIQDEAGQKLRDSLGGDQDVLFVHCDVSVEEDVARAVDATAEKFGTLDIMVNNAGFTGQKITDIRNIDFSEVRKVIDINLVGVFHGMKHAARIMIPNKKGSIISLGSVSSVIGGLGPHSYTATKHAVVGLTKNVAGELGKHGIRVNCVSPYAVPTALSMPYLPQGERKDDALKDFFAFVGGEANLKGVDLLPKDVAQAVLYLASDEARYISALNLMVDGGFTSVNHNLRAFED

SEQ ID NO: 74892 - protein, 94 aa, Bromus inermis
MASGQEKGRSELDSLAREGQTVVPGGTGGKSYEAQENLAEGRSRGGQTRKEQMGEEGYSEMGRKGGLSTNDESGGERAAREGIDIDESKFKTKS

SEQ ID NO: 74893 - protein, 524 aa, Zea mays
GCSQGFTTRERFGEASTVRAHMKDPAHRTKVVLRRLPPAIAQQAVVDQVDLRFAGRYDWACFRPGNASQKNHRHSRLYLNFKRPEDVVEFAEVFNGHVFVNEKGAQFKAFVEYAPSQQVPKSTIKKDGREGTIMKDPEYLEFLEFISKPTEHLPSAEIQLERKEAERAAAGKEAPVVTPLMMYVRQQRAAKSMVHRPGSRLSRKLASVVSSSSPKRSSEKRRSSTYVVRDNTKEKPTYIMVPKREEHTQREKVVAGNSGDATSGGTSGSGQVAEFKRDKIVILKGRGRIDSNTPNGATQHSSTPIKNVPPSRSRQDQRLEASGKIIKTILSNKEARSSNPSEHEQEGHMFNTEKDKRPPRAFNPRTIVKDQVVENAERSHFDEKANHLHGSVPIGEKVERHARNRDRPDRGVWAARRYDKSTSAGSSHPSSSEFPQMQSHSGDNILQLADGHGDRKTDTRGQGGSRGVPVENGHRHANRRGLPRGPKETKISASVPDGKNSKRGSASYGAHERQVWVQKSSSGS

SEQ ID NO: 74894 - protein, 245 aa, Achromobacter sp. CM1
WHKTRKLEYLGADALAQGADTLITAGALQSNHVRQTAALAARLGLGCVALLENPLGTDDSNYIGNGNRLLLDLFDTRVELVENLDNADEQLQALAARLRSTGKKPYLVPIGGSNALGALGYVRAGLELAEQIKDTGLAFAAVVLASGSAGTHSGLALALSEALPDLPVIGVTVSRSDEDQRPKVQGLAERTAALLEVNLPSAFKVELWDEYFAPRYGEPNAGTLAAVKLLASQEGLLLDPVYTGK

SEQ ID NO: 74895 - protein, 250 aa, Geobacter sulfurreducens PCA
MAEGFKDYFSDTSDAYRTYRPEYPDALFAWLAGLPPRRDAALDCGCGTGQASVVLASYFPRVYAVDPSAGQIASAVPHEGVVYRVAPAEQTGLPGASVDLVVAAQALHWFDFDRFYPEVRRVGRPGSVFAAFSYGLLSIDADLDRIIGRFYREVIGRYWPPERAHVDDGYRSIPFPFPEIAAPPFAMEARWELEHLLGYLATWSAVREYRQRLGTDPLPELAREVRDAWGIPEEGRTIVWPLALRVGRIA

SEQ ID NO: 74896 - protein, 179 aa, Pyrococcus abyssi GE5
MATKILVEQVVKRKAVVVKPSDSVHRVARILSKNKVGSAVVMDKDEVLGIVTERDILDKVVAKGKDPKEVKVEEIMTKNPVKIEYDYDVQDAIDLMTEKGVRRILVTKFGKPIGFVTAADLLSALASQNNEEEEEISKEEPEVYGICELCGQYGPLYKVHYEGREIWVCENCKDLIEGK

SEQ ID NO: 74897 - protein, 556 aa, Corynebacterium glutamicum ATCC 13032
MGEFIYTMKNVRKAIGDKVILDNVYMSFYPGAKIGVVGPNGAGKSSILKIMAGLDQPSNGEAFLDPGATVGILLQEPPLNEEKTVRQNVEEGLGEIFEKKQRFDAIAEEMATNYTDELMEEMGVLQEALDAADAWEIDSKIDQAMDALRCPPSDEPVTHLSGGERRRVALAKLLLAEPDLLLLDEPTNHLDAESVLWLEKHLADYKGAVLAVTHDRYFLDHVAQWICEVDRGQLHPYEGNYSTYLEKKAERLEVSGKKDQKLQKRLKDELAWVRSGAKARQAKNKARLQRYDEMVAEAEKYRKLDFEEIQIPTPPRLGNKVVEVKDLEKGFDGRVLIKDLSFTLPRNGIVGVIGPNGVGKSTLFKTIVGLENPDAGSVEIGDTVQLSYVDQGRENIDPEKTVWETVSDGLDYIIVGQNEMPSRAYLSAFGFKGADQQKPSKVLSGGERNRLNLALTLKQGGNLILLDEPTNDLDVETLGSLENALQNFPGCAVVISHDRWFLDRTCTHILAWEGNIAEGQWYWFEGNFEDYEKNKVERLGADAARPSRVTHRKLTR

SEQ ID NO: 74898 - protein, 155 aa, Triticum aestivum
  misc_feature (13)..(13): Xaa can be any naturally occurring amino acid
  misc_feature (23)..(23): Xaa can be any naturally occurring amino acid
GRQVKYDLTRKLXLIMVDRVLYXSVVYPHNYGFIPRTLCDDSDPMDVLVIMQEPVVPGCFLRAKAIGLMPMIDQGEADDKIIAVCADDPEYKHFNDIKELPPHRLAEIRRFFEDYKKNENKEVAVNDFLPATAAYEAIQHSMDLYATYVVEGLRR

SEQ ID NO: 74899 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 74900 - protein, 389 aa, marine gamma proteobacterium HTCC2080
MNLHEYQGKALFAQYGLPVSVGHAVSTPEEARSAAEKIGGDKWVVKAQVHAGGRGKAGGVKLVDSPDDAAAFAEHWLDKRLVTYQTDVDGQPVSKILVETCTDIDQELYLGAVLDRASRRIVFMASTEGGVEIEKVAEETPEKILRAEIDPLTGPQPYQGRELAFKLGLEGVQVKQFVAIFVGLAKLFQDKDLALIEVNPLVITDEGNLHCLDAKIVADSNALYRHADLREMHDPSQEDAREAHAAEWDLNYVALDGSIGCMVNGAGLAMGTMDIVKLHGGSPANFLDVGGGATKERVTEAFKIILSDENVKAVLINIFGGIVRCDLIAEGVIGAVEEVGVTVPVVVRLEGNNAELGQKVLADSGLNIMAASSLTDAAEQVVAAAGGAQ

SEQ ID NO: 74901 - protein, 396 aa, Escherichia coli
MFENITAAPADPILGLADLFRADERPGKINLGIGFYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 74902 - protein, 185 aa, Zea mays
  misc_feature (83)..(83): Xaa can be any naturally occurring amino acid
MASASFGKLNGLSSPRISHRSFAHPSASPPPRVSFAIRAGAYSDELVKTAKTIASPGRGILAIDESNATCGNRLASIGLDNTXENRLAYRQLLLTTPGLGDYISGAILFEETLYQSTKDGKKFVDCLNDAKIVPGIKVDKGLVPLPGSNEESWCQGLDGLASRSAEYYKQGARFGKWRTVVSIPC

SEQ ID NO: 74903 - protein, 628 aa, Oryza sativa Japonica Group
MRGPVRWAVVVVVMAMVEAAAGRFVVEKNSLRVTSPEGIKGKYECAIGNFGVPQYGGTLHGWVEYPKSNQKACKSFEDFDISFKSTRSGGRPKFVLIDRGQCYFTTKAWNAQNAGAAAVLVVDDKSEPLITMDNPDDAGTEHLENITIPSVLITKKLGDDLKKSAENGDMVSVLLDWRESLPHPDERVEYEFWTNSNDECGPKCDMQMDFVKSFRGTAQILEKKGYTQFTPHYITWYCPEAFVVSKQCKSQCINHGRYCAPDPEQDFSQGYDGKDVVVQNLHQICVFKAANESGKPWLWWDYVHDFSIRCPMKEKKYTPECAVHVIKSLGLDVEKIKKCVGDPEADEENPVLKAEQDAQIGHDKRGDVTILPTLVINNRQYRGKLDKSAVLKAVCAGFEETTEPAICLSEDVQTNECLENNGGCWQDRDNNVTACKDTFRGRVCECPVVKGVKFVGDGYTNCEASGIGRCEIKNGGCWKETRNGKTISACSNEVSEGCKCPPGFKGDGIKSCEDIDECKEKLYCQCKGCSCENTWGSYECSCGGNNMLYMREHDTCLSKEATSAVGWSFLWVIFFGLVLAGVGAYAVYKYRLRSYMDSEIRAIMAQYMPLDNQEAANQHHVAHAGDDI

SEQ ID NO: 74904 - protein, 300 aa, Vibrio fischeri
GFGRIGRFVFRASVERNDIEVVGINDLIDVEYMAYMLKYDSTHGRFNGTVEVVDGNLVVNGKTVRVTAERNPEDLKWDAINVDVVAEATGIFLDDATARKHITAGAKKVVLTGPSKDATPMFVMGVNHTSYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKEASEGELKGVLGYTEDAVVSQDFIGEVQTSVFDAAAGVALTDKFVKV

SEQ ID NO: 74905 - protein, 415 aa, Glycine max
MAKKAVLIGINYPGTKAELRGCINDVWRMHRCLIERYGFSEDDITVLIDTDESYTEPTGKNIRSALTRLVRSAEPGDVLFVHYSGHGTRLPAETGEDDDTGYDECIVPSDMNLITDDDFREFVDGVPRGCRITIVSDSCHSGGLLEEAKEQIGESTKGEEEQSSSGFGFSSFLHRTVEDAIESRGFHIPSALRHNRGRDDDGDEAQNRDIELPDGGYVKNRSLPLSTLIDILKQKTGKDDIDVGKLRPTLFDVFGEDASPKVKKFMNVIFNKLQHGSDESGGGILGLVGGLAQEFLKQKLDDNDEGYAKPALETKVESKHEAYAGPTKRGLPDGGILMSGCQTDQTSADASPAGNAASAYGAFSNAIQAIIEETDGAITNQELVQRAREKLKNSGFTQKPGLYCSDHHVDAPFVC

SEQ ID NO: 74906 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFPSKLPWKETLSFRYQAEENSPKHIEEYFHNRMGEDFAEFGTVYQDYCEAMSTLSLGIMELLGMSLGVSREHFREFFNENDSIMRLNYHPPCQKPDLTLGTGPHCDPTSLTILHQDQVGGLQVFVDNEWRSINPNFDAFVVNIGDTFTALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 74907 - protein, 300 aa, Vibrio halioticoli
GFGRIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKV

SEQ ID NO: 74908 - protein, 328 aa, Mycoplasma pneumoniae
MDRHNHVVFSLSKTHDLVSRICQKLKMPMGLITHNEFADGETYIRFEESVRNKDVFIFQSTCAPVNDSLMELLIAIDALKRGSAKSITAILPYYGYARQDRKTMGREPITSKLVADLLTTAGVSRVALTDIHSDQTQGFFNIPVDTLRTYHVFLTRTVELLGKKDLVVVSPDYGGVKRARLIATSLELPLAIIDKRRPAHNVAESINVLGEVANKNCLIVDDMIDTGGTVIAAAKLLREHHAKKVCVMATHGLFNGEAPQRFQKAFNEGLVDYLFVSNSIPQTKFDQCPQFQVIDLAPLFEEVLLCYANNSSISAIYTRHIEWIKKHV

SEQ ID NO: 74909 - protein, 233 aa, Zea mays
  misc_feature (146)..(146): Xaa can be any naturally occurring amino acid
  misc_feature (185)..(185): Xaa can be any naturally occurring amino acid
  misc_feature (197)..(197): Xaa can be any naturally occurring amino acid
  misc_feature (209)..(209): Xaa can be any naturally occurring amino acid
  misc_feature (216)..(216): Xaa can be any naturally occurring amino acid
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKDLSAKSFFPNLIEXITSGPVVCMAWEEGLGVVASARKLIGKTDPLQAEPGTKXEGDLAVQTGRNXGVHGSDSPENAXRENFGLXFKEGELMARWDSALLLG

SEQ ID NO: 74910 - protein, 333 aa, Nitrosospira sp. PJA1
MTIKVGINGFGRIGRMVFRAAVQNFPDIEVVTINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRAGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 74911 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVSTNWLHQRSLS

SEQ ID NO: 74912 - protein, 324 aa, Ehrlichia ruminantium str. Welgevonden
MVKAVVIDKTGGVEVLKYVDCNVNEPKDDEVLIKHTAIGLNRYDLECCNGTRKIKKFPAVLGSEAVGIIEKLGKNVEVFNIGDRVGYCTVSGGAYSEKRIINQKYLVKIPDDITDQIAAAVLFKGMTAHYLTHVVYSTRPKSFALVHGATGGVGQILCQWASYKGSKVIGVTSSDDRANIALRSGCSYIVNSNSESFVKQVMEITNGAGVNVVYDPIGALVGKVSFESLGLFGIYISYGQISGPLVNISASMMSSRSLFFTAPLIFHYKRSSFDLSMTAMELFEVMRKGHIKVNINKIYRFDDIITAHQDLEKRNLTGSNVILL

SEQ ID NO: 74913 - protein, 336 aa, Desulfitobacterium hafniense DCB-2
MSVRVAINGFGRIGRLTLRAILKQSLPVEVVAINDLGSPDLLAHLFKYDSLHGILPNSVEIDGDTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSMIPTTTGAAKAVTLVIPELAGKMNGLAVRVPTPNVSLVDFVANLTKSTSKEGVNAALREAAEGKLKGYLEYTELPLVSRDFNGNSASSIVDGLSTMIIGERMVKVLAWYDNEWGYSNRIVDLVKLIVMKGL

SEQ ID NO: 74914 - protein, 333 aa, Nitrosospira sp. TCH711
MTIKVGINGFGRIGRMVFRAAVQNFPDIEVVAINDLLEPDYLAYMLQHDSVHGRFRGDVSIEDSTLIVNGKKIRLTAIKDPAELKWGEVGAEVVVESTGLFLTKESCQKHIAAGAKKVIMSAPSKDDTPMFVYGVNNDTYDGQAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 74915 - protein, 489 aa, Listeria monocytogenes EGD-e
MGKATGFMEYDRIPSPGRDPKSRTRDWNEYSLPMPVADLTIQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAAGIHFAVPYLSQSTRDNLDNGGIQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTDRHTIDAAKGFYRTSEEGVFACGDARHGQSLVVTAIAEGREAAREVDFYLMGETFLP

SEQ ID NO: 74916 - protein, 333 aa, Nitrosospira sp. TCH716
MTIKVGINGFGRIGRMVFRAAVQNFPDIEVVAINDLLEPDYLAYMLQHDSVHGRFKGDVSIEDSTLIVNGKKIRLTAIKDPAELKWGEVGAEVVVESTGLFLTKESCQKHIAAGAKKVIMSAPSKDDTPMFVYGVNNDTYDGQTIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMNGVLAYTDQKVVSTDFRGESATSIFDAEAGMALDGNFVKVVSWYDNEWGYSSKILEMVRVVASK

SEQ ID NO: 74917 - protein, 479 aa, Desulfitobacterium hafniense DCB-2
MKKEIRESLFIDGEWQEAINKEVKGVINPATGKVFCEIGYGEVDDALSAVDAADRAFGAWSKTSVRERADILNRTADLLRQRADHIGLILAAESGKPVPQAVGEVKFSAEYFQWFAEEIRRPYGQSIPSDAANKRHHVYTQPAGVALCLSPWNFPVSIQARKLAPALAAGCTVVARGSEVAPLSLIELFKCLQDAGIPKGVANSIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIREAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 74918 - protein, 297 aa, Aquifex aeolicus VF5
MREIRKVVLPVAGWGTRFLPATKAMPKEMLPIIDKPIIQFIVESFINIGIENIIFVTGRHKKAIEDHFDHNHELEEHLKKAGKEKLLREVVKISSLINPIYVRQKEQLGLGHAVLMAEPAVSQEPFFVALGDIIVENEEEELKKMIHLFRKFGNSIVALMEVPKEEVSKYGIAKVKKLDEETYIIVDLVEKPSPEEAPSNLAIVGRYIFTPTIFEKLKVTKPGKGGEIQLTDAMRLLLEEEAIYACKVNNTVYDTGNPKDYLKTVISFALRREDINGELIEFIRGLIKEEPKKEKAK

SEQ ID NO: 74919 - protein, 125 aa, Oryza sativa Japonica Group
MAGRLTAAGSRVLGGQGAAARAAVSALRHRAGMGLPVGRHIVPDKPLPTNDELVWDNGTPFPEPCIDRLAPHIGKYEALAWLCGGLGFFATLGLAATLNDKASKIPYTPKVYPFDNLREELGDRP

SEQ ID NO: 74920 - protein, 223 aa, Glycine max
ADACGDAALSVPTPTATLPFKYAIDSHHSKPNSLFSSSPQKLNTTHLILQVADSGKWSNMVSFFPGFITEGRDVQSLKVDLYEAIAPLDRGAEATPEDQQRVDQIARKLEAVNPVKEPLKSDLLNGKWELFYTTSQSILQTQRPKLLRPNGKIYQAINVDTLRAQNIETWPFYNQATANLVPLNSRRVAVKFDFFKIANLIPIKSAGSGRGQLEITYLNEDLR

SEQ ID NO: 74921 - protein, 245 aa, Hordeum vulgare subsp. spontaneum
GFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKA

SEQ ID NO: 74922 - protein, 427 aa, Vibrio fischeri ES114
MKLYNIKENDEQVSFGQAVRQGLGRNQGLFFPSELPKFDDVDALLAEDFISRSTKILSAFIKEELPQDTVRSMVENAFQFPAPIKAVKDDVYALELFHGPTLAFKDFGGRFMAQSLAAVTDSDEQITILTATSGDTGAAVAHAFYGMDNIKVVILYPKGKISPLQEKLFCTLGKNIHTVAVDGDFDDCQALVKQSFDDAELRKEVGLNSANSINISRLMAQICYYFEAVSQLPKEKRNDVVISVPSGNFGNLTAGLLAKSLGLPVKRFIAATNVNDTVPRYLETGQWEPKVTIPTISNAMDVSQPNNWPRIEELCQRLGWGLETLGKGAVTDEQSAETLKEMNQAGYLCEPHGAIAYRILNEQLSDGETGLFLCTAHPAKFKEVVEDILGNDIELPAPLAKHNAMELLSEDLDNDFDALKAVLRKVQ

SEQ ID NO: 74923 - protein, 213 aa, Zea mays
  misc_feature (78)..(78): Xaa can be any naturally occurring amino acid
GLSLAESGGFVKAPGGAPANVACAIAKLGGSSAFVGKFGDDEFGHMLVNILKQNNVNSEGCLFDKHARTALAFVTLKXRLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTT

SEQ ID NO: 74924 - protein, 105 aa, Actinobacillus pleuropneumoniae serovar 1 str. 4074
MTLQVTDATFEQEVLKSDVPVLLDFWAPWCGPCRMVAPILDELSEEFAGRAKIAKVNVDENQQIPAQFGIRSIPTLILFKNGEVVATQVGALPKSQLSAFVEQAL

SEQ ID NO: 74925 - protein, 538 aa, Saccharomyces cerevisiae
MSMPIASTTLAVNNLTNINGNANFNVQANKQLHHQAVDSPARSSMTATTAANSNSNSSRDDSTIVGLHYKIGKKIGEGSFGVLFEGTNMINGVPVAIKFEPRKTEAPQLRDEYKTYKILNGTPNIPYAYYFGQEGLHNILVIDLLGPSLEDLFDWCGRKFSVKTVVQVAVQMITLIEDLHAHDLIYRDIKPDNFLIGRPGQPDANNIHLIDFGMAKQYRDPKTKQHIPYREKKSLSGTARYMSINTHLGREQSRRDDMEALGHVFFYFLRGHLPWQGLKAPNNKQKYEKIGEKKRSTNVYDLAQGLPVQFGRYLEIVRSLSFEECPDYEGYRKLLLSVLDDLGETADGQYDWMKLNDGRGWDLNINEKPNLHGYGHPNPPNEKSRKHRNKQLQMQQLQMQQLQQQQQQQQYAQKTEADMRNSQYKPKLDPTSYEAYQHQTQQKYLQEQQKRQQQQKLQEQQLQEQQLQQQQQQQQQLRATGQPPSQPQAQTQSQQFGARYQPQQQPSAALRTPEQHPNDDNSSLAASHKGFFQKLGCC

SEQ ID NO: 74926 - protein, 470 aa, Mycobacterium sp. JLS
MLVATRIVIIGGGPAGYEAALVAAGPETHVTVIDSDGVGGACVLYDCVPSKTFIASTGVRTELRRATGLGFDISIEDAKISLPQIHNRVKTLARSQSADIGSQLLREGVTVIGGRGELVDDVPGLAQHRVRVRTHDGKTGVLKADVVLIATGASPRVLPNAEPDGERILTWRQLYDLTELPEHLVIVGSGVTGAEFCNAYTELGVTVTVVASRDQILPHEDSDAAAVLEEVFAERGVTLVKNARAESVTRTENGVKVQMADGRCVEGSHALMTVGSVPNTEGLGLERVGIELARGGYIPVDRVSRTPAAGIYAAGDCTGLLPLASVAAMQGRIAMYHALGEGVAPIRLRTVASATFTRPEIAAVGIPQTAIDDGSVPARTLMLPLNTNARAKMSLLRHGFVKIFCRPATGVVIGGVVVAPIASELILPIALAVQNRISVTDLAQTLSVYPSLSGSIVEAARRLMAHDDLD

SEQ ID NO: 74927 - protein, 105 aa, Glycine max
  misc_feature (48)..(48): Xaa can be any naturally occurring amino acid
  misc_feature (51)..(51): Xaa can be any naturally occurring amino acid
PRPPARVHAHMEDPVLDLVLNALEGATTMSIYEEHYAQDDAQNADRNXVAXRRMKYYMYYCVFYGDRFACPTPCATSYYTHYCYRARCPVQRYSKRCSAISRCLR

SEQ ID NO: 74928 - protein, 579 aa, Mycobacterium sp. JLS
MSDPIAGNGQTLLGPDQRAEAWRRLGSEQFDVVVIGGGVVGAGAALDAATRGLKVALVEARDFASGTSSRSSKMFHGGLRYLEQLEFGLVREALHERELSLTTLAPHLVKPLPFLFPLTNRWWERPYVAAGIFLYDQLGGAKSVPAQRHLTKSGALRLAPGLKRSSLIGGIRYFDTVVDDARHTMMVARTAAHYGAVVRTSTQVVNLLREGDRVIGVAVRDSEDGSVTDVHGHVVVNATGVWTDEIQALSRQRGRFRVRASKGVHIVVPRDRIVSEVAIILRTEKSVLFVIPWGTHWIIGTTDTDWNLDLAHPAATKADIDYILDHVNTVLATPLTHDDIDGVYAGLRPLLAGESEETSKLSREHAVASPAPGLVAIAGGKYTTYRVMGEDAIDAAAEFVPARVAPSITEKVPLMGADGYFALINQTQSVGAHYGLHPYRVRHLLDRYGSLISEVLAFADGRPDLLTPITAAPVYLKVEAAYAAAAEGALHLEDILARRMRISIEYPHRGVDCAREVAEVVAPILGWSAEDVSREVDTYCARVDAEVRSQQQPDDESADALRAAAPEARAEILEPVPLR

SEQ ID NO: 74929 - protein, 396 aa, Escherichia coli
MFENITAAPADPILGLADLFRADERPGKINLGIGFYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHAPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 74930 - protein, 455 aa, Debaryomyces hansenii CBS767
MVLPHEPEFQQAYNELVSALEDSTLFTEKPEYKKVIPVVSVPERIIQFRVAWENDNGDVEVNNGYRVQFNSALGPFKGGLRFHPSVNLSILKFLGFEQIFKNALTGLSMGGGKGGCDFNPKGRTDSEIRRFCVAFMRQLARYIGSDTDVPAGDIGVGSREVGYMFGAYKQMQNNWSGILTGKGLSWGGSLIRPEATGYGVVYFVEKMIEKATGGKESFKGKRVAISGSGNVAQYAALKVIELGSTVVSLSDSKGCIISQTGITPDQIKAIAAAKIHFKTLEEITKESASLFSGSNEVQYIAGVRPWTHCGQVDVALPSATQNEVSGEEAKALVEAGCKFIAEGSNMGSTKEAIDVFEANRSKAVWYAPGKAANCGGVAVSGLEMAQNSQRVTWAAEEVDEKLKNIMYTCFDNCYANAAKYSAEKDAENLPSLLKGANITGFIKVADAMFDQGEVF

SEQ ID NO: 74931 - protein, 210 aa, Petunia integrifolia subsp. inflata
MSAIVEPISPNKAQLIIDQQETMKMVRSSDGIEQEEEENKCNSPMNEEKDKDDERLSKEQPGSVDDSAVREDKDAEVQEPRLYIICPDRPDLELSEPFISTPKACLFTLKEGSRYKLKFSFTVSNNVVSGLKYINTTWKSGVRVDKSEVMLGTFSPRKEPYVYELEEDVTPSGVFARGLYSARTQVIDEKGTCYVDIKYYFDIQKQWLQL

SEQ ID NO: 74932 - protein, 303 aa, Vibrio halioticoli
GRIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKVVSWYD

SEQ ID NO: 74933 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTPIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 74934 - protein, 132 aa, Arabidopsis lyrata subsp. lyrata
AVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPS

SEQ ID NO: 74935 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTSSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPENDKMVTPPHELVDTCNPRIYPDFTWPMLLEFTQKHYRADMKTLEVFTNWLHQRSFS

SEQ ID NO: 74936 - protein, 730 aa, Oryza sativa
MNGRARRPAAAAHGAKAASTKSDRMMEKDQRKGAMPVKKGSSANAVDKLKKKLRHEENVHRALERAFTRPLGALPRLPPYLPSQTLALLAEVAVLEEEVVRLEEQVVNFRQGLYQEAIIFSSAKNTSLPGGEGCVPAQLMPSSPVPNSEVSPANCHSPPTRPSMNGVAGAKQTPRKPSPSAAVAQDDRSGAGKENQSCSNTPARNCRHSPLLQKASKSRLPTAAAPEKRRATAQTISTVPDRKRLADTVSNNSEKASQDDSSVPNRLSEELLRCLLAIFSQMGGSSASGQDEEQAALSPSVSGSCESSEDAYPQDPYGILEFGTRDVGSYKRFHVIDATSFDQTAMENDTMLTRKLKALIRRLSSVDLTGLSHQQKLAFWINIYNSCMMNAFLEQGIPTTPHMLVAMMPKATINVGGRTHSAMSIEHFILRLPYSVKHVNPGGVTKGAADDVTMRGVFGLEWPEPLVTFALSCGSWSSPAVRVYTARGVEEELEAAKRDYLQSAVVVSAPAKVAIPKLLHWYLLDFAKDVDSLMDWVCLQLPSELRQKAMRIVEDGRRGVAAESRRVQVLPYEFRFRVAGVLEGQAGMSQQGIWYGDVFPLTRSLAAKPIVPWDAATMQSAENLVLGKTVKGGPAAAMESATSRNEEMGVIGHDQSTDATAEHGVNISDTLVPGGGRIVTEFVPARMMAPPPSDSRNPSSASQTAEEACRDRKRALAVAGRPGMSPAWGR

SEQ ID NO: 74937 - protein, 295 aa, Vibrio halioticoli
RIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFV

SEQ ID NO: 74938 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKDDKMVTPPHELVDTCNPRIYPDFTWPMLLEFTQKHYRADMKTLEVFTNWLHQRSLS

SEQ ID NO: 74939 - protein, 319 aa, Azospirillum brasilense
MPGSEFRGKIYDSILDTVGATPLVRVNRLAEDAGAKAQIVGKLEFFNPLASVKDRIGFAMIDAAERAGTIEPGRTTLVEPTSGNTGIALAFVAAAKGYRLILTMPESMSVERRKMLKLLGAELVLTPAAEGMKGAIRRADEIVATDPNAYMLQQFKNAANPEIHRNTTAEEIWKDTDGKADFLISGVGTGGTLTGVSEVLKARKPGFRTIAVEPEDSPVLSGGMPGPHKIQGIGAGFVPDVLKKDLIDEVVRISNQRAFETARKVAKLEGIPVGISSGAALAAALEIGSRPENEGKLIVVILPSFAERYLSTALFEGLE

SEQ ID NO: 74940 - protein, 300 aa, Vibrio neonatus
GFGRIGRFVFRAAQERNDIEVVGINDLIDVDYMAYMLKYDSTHGRFKGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKV

SEQ ID NO: 74941 - protein, 385 aa, Populus tremula
MAIDCIKSMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKFPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 74942 - protein, 306 aa, Aquifex aeolicus VF5
MKRDFVDLWDLSPKEAWEIVKKTLKVKKGEEELGKPLSGKTIALLFTKPSTRTRVSFEVGIYQLGGNSLFFQEKELQVSRGEDVRDTARTLSKYVDGVIVRNHSHTWLKEFANFASVPVINALTNMSHPCQILSDVFTLYEHYGEELKNLKVAYVGDGNNVCNTLMVGAGMFGLKLFVATPEGYEPNSYYYKKALEFSKENGGSVELTNNPVESVKDADVVYTDVWVSMGEENKNIEAFLPYQVNEKLLSFAKSSVKVMHCLPAKKGQEITEEVFEKNADFIFTQAENRLHTQKTLMEFLFREPQA

SEQ ID NO: 74943 - protein, 248 aa, Aquifex aeolicus VF5
MEIKLQGKVSLVTGSTRGIGRAIAEKLASAGSTVIITGTSGERAKAVAEEIANKYGVKAHGVEMNLLSEESINKAFEEIYNLVDGIDILVNNAGITRDKLFLRMSLLDWEEVLKVNLTGTFLVTQNSLRKMIKQRWGRIVNISSVVGFTGNVGQVNYSTTKAGLIGFTKSLAKELAPRNVLVNAVAPGFIETDMTAVLSEEIKQKYKEQIPLGRFGSPEEVANVVLFLCSELASYITGEVIHVNGGMF

SEQ ID NO: 74944 - protein, 78 aa, Aquifex aeolicus VF5
MSLEERVKEIIAEQLGVEKEKITPEAKFVEDLGADSLDVVELIMAFEEEFGIEIPDEDAEKIQTVGDVINYLKEKVGG

SEQ ID NO: 74945 - protein, 245 aa, Hordeum vulgare subsp. spontaneum
GFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVIISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKA

SEQ ID NO: 74946 - protein, 169 aa, Arabidopsis thaliana
MTSSDKSLSHDVFVYGSFQEPSVVNLILECSPVMVPAQLHGYHVYRLKGRLHACISPSENGLINGKILTGLTDSQLENLDMIEGSEYVRKTVEVVLTDTSEKKQVETYVWANKDDPNLYGEWDFEEWRRLHMDKFIEASTKFIEWKKNPDGRSREEFEKFVFDDPPTAA

SEQ ID NO: 74947 - protein, 490 aa, Vibrio fischeri ES114
MGKPTGFLEHGRELPKKIDPSVRIQDNKEFVLNEEFGDKINTQASRCMDCGVPFCHNGCPIGNIIPEFNDAVYRDSWEEAWKILSSTNNFPEFTGRVCPAPCESACVLGINQDPITICNIEKTIVETAYREGYAQPKKPRSRTGKTVAIVGSGPAGLAAAEQLNSAGHSVTVYERDEKVGGLLRFGIPDFKLGMDIIDRKINLMADAGIKFEVNAHIGIDVNAQQLRQDFDVVLLTGGSTVPRDLPIPGRDLNGVHFAMEFLGQNNRRANNMDLKTKEIHAKGKHVVVIGGGDTGSDCVGTSNRHGAASITQVEIMPIPPEKRPANMPWPQYPMIMKTTTSHEEGCERHWNILTKEFISDDAGNVKGLRIADIVWQDAKPGERPGFDEVAGSERVIPCDQAFLAMGFLHPEPTGVLAQLDIKLDDRGNVATDGFATNQKGVFAAGDMRTGQSLVVRCINEGRECAREIDSYLMGGSNLEAKADSLMLSAS

SEQ ID NO: 74948 - protein, 472 aa, Symbiobacterium thermophilum IAM 14863
MSEPTGKILAIMGAVVDVEFPDGHLPKLNHALVIRNGGERGDINLTLEVAQHLGNNQVRCIAMDSTDGLRRGETVYDTQAPITVPVGEPVLGRIFNVLGETIDGKGPVNSPVSLPIHREPPGVANVDPATEMLPTGIKVIDLLCPYARGGKIGLFGGAGVGKTVMIQELIHNIAYKFGGYSIFAGVGERTREGNDLYHEMIEAGVIDKVAMVFGQMNEPPGARMRVALTGLTMAEYFRDEQGLDVLLFIDNIFRFTQAGSEVSALLGRMPSAVGYQPTLATEMGYLQERITSTKKGSITSVQAIYVPADDLTDPAPATTFAHLDATTVLSRAVFEKAIFPAVDPLDSTSRILDPNIVGREHYEVARGVQKVLQRYKELQDIIAILGMDELSDEDKLIVARARKIERFLSQPMFVAEKFTNLPGVFVDPKDTVKGFKEILEGKHDDLPEQAFYMVGTIEQAVEKGKKLLAEVS

SEQ ID NO: 74949 - protein, 519 aa, Physcomitrella patens
MEVPMPSAKLVEQPVFSLPVDSEHKAKSIQIFSFAQPHMRALHLSWISFFTCFLSTFAAPPLIPIIRDNLNLTKTDIGQASIASVSGSIMSRLMMGTVCDLVGPRYGSAFLIMINAPAVFSMSLVDDAEGFLICRFFIGFSLATFVSCEFWVSNMFTTKIMGTANGIAAGWGNLGGGATQIIMPLVFHLMLHSFHNPAFTAWRLSFFLPGTAHIVVGLLVLCLGQDLPDGNHSTQLQKQGGDVKDGFNKVLYFAVTSPKTWIFFILYGYSFGVELTVDNIIAEYFYDRFDLNLNTAGTIASAFGLMNIVSRPAGGYLSDCVARRFGMRGRLWILWTLQSLGGLLCIVLGLMSDLTAAIVAMIFFSICVQAACGAVFGIVPFISRRSLGVVIGLTACGGNVGSVLTQALFFTSSSYHTETGLIYMGVMILCCTLLIIAVYFPQWGGMFFPPSKSVSEEDYYVSEWTAQEQEQGLHLASLKFAVNARSERGGYCSSSSADPEGDHPTADGLGLSMWKSYSH

SEQ ID NO: 74950 - protein, 517 aa, Physcomitrella patens
MADKGGSMRASGDVEFLLPVDSEHKAKVVKVFSFAQPHMRSFHLSWISFFVCFLSTFAAPPLIPIIRDNLNMTKSDIGQAAVASVSGSILSRLMMGTVCDLVGPRYGSAFLIMVNAPAVFSMGVVDDAEGFMICRFFIGFSLATFVSCEYWVSSMFTSKIVGTVNGLAAGWGNLGGGVTQIMMPLIFALFRDSFHHPDFTAWRLAFFVPGSMHIILGLLVLCLGQDLPDGDHAQLQKQGGDVKQGFLRVLYFASTSYKTWIFFILYGYSFGVELTVDNIIAEYFYDRFNLNLNTAGLIAAASGLMNIYSRPAGGYLSDVAGRYLGMRGRLWFLWTVQSLGGLLCIILGKMSNLTGAIISMILFSIFVQAACGATFGIVPFVSRRSLGVIIGLTAAGGNVGSVLTQSLFFTSSSYHTEEGLVYMGIMIVCCTLLVTLIWFPQWGSMFFPPSKSASEEDYYVSEWTAQEQEQGLHLPSLKFATNSRSERGNHAGASSSDPEGDQPPAELGLSMWKSYSH

SEQ ID NO: 74951 - protein, 513 aa, Synechococcus sp. WH 8103
MLGDLWSFQGRYRTLHLTWIAFFLTFVVWFNLAPLATTVKADLGLTVGQIRTVAICNVALTIPARVLIGMLLDKFGPRITYSSILVFSAIPCLLFASAQDFNQLVVARLLLSIVGAGFVIGIRMVAEWFPPKEIGLAESIYGGWGNFGSAFSALTMVALAGFLSFSGGFEMPTGTVLNWRGAISLTGIVSAVYGLFYFFNVTDTPPGKTYQRPEKTAGLEVTSMRDFWGLLGMNVPFAAILCVLCWRLGKVGFLTPSTYPLALGAVAVWFAFQTWGIIRTNRDLILGNKVYPKEDRYEFRQVAILELTYIVNFGSELAVVSMLPTFFETTFDLPKATAGILASCFAFVNLVARPAGGLISDSVGSRKNTMGFLTAGLGVGYLVMSMIKPGTFTGTTGIAVAVVITMLASFFVQSGEGATFALVPLVKRRVTGQVAGLVGAYGNVGAVTYLTIFSLLPMWMGGGGEPTPEVIAAFNSAFFQILGVAGLIVAFFCFFFLKEPKGSFAELHEGETA

SEQ ID NO: 74952 - protein, 476 aa, Vitis vinifera
MYWSVWLCVVSLFIASITHWVYKWRNPKCNGKLPPGSMGFPLIGETIQFFIPSKSLDVSSFIKKRMKKYGPLFCTNLAGRPVVVSSDPDFNYYIFQQEGKLVELWYMDSFARLVGLDPSQSITSTGYIHKYVKNLALAHIGTEALKDGLLSKAEDMIRTRLHDWSKLPAFEFKACVSSMIFDFTATSLFGYDFKMKGAHFSEKFTNIVHALIAFPLNIPGTTFHKCLKDQKEAMKLIRDVLKEKKASSKTLEGDFLDQMVDDMKNEKFLSDDFVVFVVFGFLLASFETISSTLTLAIKLLIEHPLVMQELIEEHEAILKNREDPNSGISWKEYKSMTFTHQVINEALRLGSVAPGILRRAIKDIQVNGYTIPAGWTIMVVPAALQLNPNTFVDPLAFNPWRWKDMGVGVVAKNFIPFGGGSRLCVGAEFTKVLMTTFFHVLVTNYRLTKIKGGQIARSPALTFGNGLHINISKKHQ

SEQ ID NO: 74953 - protein, 476 aa, Vitis vinifera
MYWSVWLCVVSLFIASITHWVYKWRNPKCNGKLPPGSMGFPIIGETIQFFIPSKSLDVSSFIKKRMKKYGPLFCTNLAGRPVVVSSDPDFNYYIFQQEGKLVELWYMDSIAKLVGLDTSQSIAATGYVHKYLRNLALAHFGTEALKGRLLAKAEDMIRTRLHDWSKLPALEFKSCVSSMIFDFTATILFGYDFETKGAHFSEKFTNIIHVLMSFPLNIPGTTFHKCLKDQKEIMKLIHDALKEKKASPKTLQGDFLDQMIDDMKKEKFLSDDFVVFVMFGILFASFETISSTLTLAIKLLIEHPLVMQQLIEEHEAILKNREDPNSGISWKEYKSMTFTHQVINEVLRLGSVAPGILRRAIKDIQVNGYTIPAGWTIMVVPAALQLNPDTFVDPLTFNPWRWKDMGVGVVAKNFIPFGGGSRLCIGAEFAKVLMTTFFHVLVTNYRLTKIKEGQIARSPVLTFGNGLHINISKKHG

SEQ ID NO: 74954 - protein, 301 aa, Vibrio neonatus
RFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKVVSWDDNE

SEQ ID NO: 74955 - protein, 1612 aa, Debaryomyces hansenii CBS767
MYDDPESIANMGMPPSTQNRIASDGVIYSNQHMSGYMMHPNRNNEFIPHKDNLDNCIDERKLSLPYPSNDNFGTLLQDETSTPNKQNIQVTTNNSSSPIQSDHKDLKSFSFSEQNDSIQEFQVSPIKEDPPRLSRRAFDGFPRDEVSNENSRSARPYSPAPNSSGSDNSNAIGLIIGGYDYSKSSLELASKDNNNNFHNDRKSNTLIQRDDDPTGQFCLTNNPLQSNEVDINVKVHNRNSSESSTVSNTSTTSTITPSTISKGKRFVRYAMNTQSKSSMTNTSTKWHILNVLKWLDYYGFNSSWQETFRRNEISGNRFLELCNYEVDSMIWKQFSKYLVLDNENNSIERFIELLKGHLSTSEPVDDYNANKEYQMQSHSRKGSNESHLSPVLPNSTAENRKSVPIFHKRKSVSISAAYGSSSLNNNIASSGNQRPVSYVDIGSQKPSKDLQSHHKFFRKSKSSYSDIPQTYTGINNISIAPSNNQNISGHRKSNSRTSLSLNDDFIVDSNKIKYTGAPLLKTSSLQNFPTPNNEAIPATTYGRKSGLFSTLKKYSSDKAVGIVKQVQNTSSSSATKTSGINKSNSKNVVSPVSPVEFRELLLPKAKQNITQSNAEQESTNTTTMDDINTRSIAMSSDETLPSPLMNSSAKVINFNNNTYIDLIKKADLLDNLDEKYLPTLHDSFVDKKMILASKDNKHFTPINLTREEIRNIELIRNRVIQELELIDVGIITFHLTEFNSTEGIALKDDVLLDVIRTDILVKLFVNQELTSDTTTTFSTTSSDSKSFELIGENNDERSYPSTPQYLLQNARDPKVDYWNFKDTNNDKLSSISEINSTRAGRKSPSNPQFSMKLHLPENKKFSQDSKPPSLLINTTQIDNSLPSLSPNSSKLSDSHNSFKILRKEGREIDFDKRRKSPYESKAPKLIPNIYSSSVSNPSKSPISATTIATLKDENVESNHNKLSPSISSGSMDRDKSGSIVAKRIAPPPPLDRKLSVIGSHSLKKASILPSISTLSKTLSYSSRSPSGSERSMGSRKAFNKRKGSTSSKNSFVTDDSFAFRENDVSFDDVPTVQRDNNASSDDEDFFVKPIKNQKSNVNDDDNESDEDFFMKPIRSPDSEAPKETLKRRTLTDPISIKMNVRPPVEEVYRNLEKYFPNTNLDKPIIDDSPVSPVNKHQPSIEASNAIPMRKPTISRTFSNANMSPVHPKLDSGDEILYAENQEPTLSRRRMKTIRVVANEARKKRLERQNSPQAGRSLESSYCNTPNSGNFNSLNRTNTKLWGQKVVEVTSTEIEKGFVSKLKNGKHGEFEEFAWIKGELIGRGSFGAVYLALNVTTGEMLAVKQVIVPNDFQNGSPKVSEGIDALHKEVETMKDLDHLNIVQYLGFEQKKNIYSLFLEYVAGGSIASCMKSFGRFEEPLIKFIIKQVLLGLEYLHSNGILHRDLKADNLLLEIDGTCKISDFGISKKSKDIYVNNAEMSMQGTVFWMAPEVIDSIVADKKQGYSAKVDIWSLGCVVLEMFAGKRPWSNEAVVSAIYKIGKTKLAPPIPDDITHLISDEARSFIGRCFTIDPEERPTARDLLGDPFISNESKFSFETTRLAQMIKDNYKKYNI

SEQ ID NO: 74956 - protein, 476 aa, Vitis vinifera
MCRSVWLGVVTLFIAGITHWVYKWRNPKCNGKLPPGSMGLPLIGETIQFFIPSKSLDVPNFIKKRMKKYGPLFCTNLVGRPVVVSSDPDFNYYIFQQEGKLVEFWYLDSFAKLVGLDPSSNAATGYVHKYARNLILAYLGTEVLKDKLLSKAEDLIRTRLHDWSKLPAFEIKACLSSMVFDLTGMEVLSDDFKKMGAHFIEKFANILQALFSFPLNIPGTSFHECLKNQKEAKRLIRDLLIERKVTLESCKGDLLDKLVDDAKKEKFLSDDYIVIFVFGILLASFETISTATTLALKFLTEHPLAMQELIEEHEAILKNKENPNSGISWKEYKSMTFTHQVINETLRLANIVPGILRRAIKDIQVNGYTIPAGWIILLYPAALQLDPNTFADPLTFNPWRWKDIGAGVRAKNFMPFGCSSRSCAGAEFTKVLMATFLHVLVTNYRLTKIKGGKIARSPSLIFENGFHINISKKHGC

SEQ ID NO: 74957 - protein, 298 aa, Vibrio ezurae
GFGRIGRFVFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFV

SEQ ID NO: 74958 - protein, 205 aa, Auxenochlorella protothecoides
ARPPDDGTSEEEKTTLQRHIEFWDPKGTGVIWPRDVYAGFRRLGFSRAFSTAITPIISGGLSFNTQTSKIPDPRLPVYVERIHLGIHTSDTGSYDAKGHFDSKRFDEVLAQYDIGNKGGLTQEEVKALTRGQREPKDPKGWTGSWIEWNISFHLAARESPDGKLPLYKEDLLGIMDGTLFPKISKEVAEGTWVRHGHLSPGLRRP

SEQ ID NO: 74959 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 74960 - protein, 452 aa, Yersinia pestis CO92
MQTLPSEKIRMDDVPLNRFHIRIAGLTFGAHFIDGYILGLIGFALIQLKPIMALTPLWEGLLGSAALIGLFLGSLILGWISDYIGRQKIFSFSFVIITLASALQFFASTPEQLFILRVIVGIGIGGDYSVGHTLLAEFSPRKHRGVLLGAFSVIWTFGYVSASFVGHYLSMVSPEAWRWLLSSAALPALLILLVRIGTPESPRWLMGKGREDDAMAIVHKYFGPNVTLIDEEPATSTRRFLSLFGRKYWRRTAFNSLFFVCLVIPYFAIYTFLPSILNVMALSQNFATDLLLNGLLVVGALVGIVLTAFCSRRSFLISSFIFLATCLLLLSILPSNQTFWLIALFAAFTLVMSAVSNLVGVFPAESFPTEVRSMGVGFATSMSRLGSAIGTSLLPLAIVNYGMPVTTTLLAFVLIIGAIVSIAWAPETKGLTLVDASQSATTPRPPSSIIPN

SEQ ID NO: 74961 - protein, 297 aa, Vibrio ezurae
VFRAAQERNDIEVVGINDLIDVDYMAYMLKYDSTHGRFNGTVEVKDGNLIVNGNTVRVTAERNPEDLKWNEIGVDVVAEATGLFLTDETARKHITAGAKKVVLTGPSKDATPMFVNGVNFDTYAGQDIVSNASCTTNCLAPIAKVLNDTFGIESGLMTTVHATTATQKTVDGPSAKDWRGGRGASQNIIPSSTGAAKAVGVVLPEVNGKLTGMAFRVPTANVSVVDLTVNLKTGASYETICAAMKEASEGALKGVLGYTEDAVVSQDFIGETCTSVFDAKAGIALTDNFVKLYLGTT

SEQ ID NO: 74962 - protein, 397 aa, Bordetella bronchiseptica RB50
MLVHIPTIAMIRSKLPDVGTTIFTVMSRLAIEHKAINLGQGFPDFDPDPELCALVGKAMAAGHNQYPYMPGVAPLREAIAAKVKTLYGHAYDPETEITVTSGATEALMATVLAAVGPGDEVVVIEPCYDSYLPAIRLAGGTAVPVPLRAPTRDDPYYRIDWQRVRDAIGARTRLLMLNFPHNPTGAVLDESDLDALESIVRETGVLLLSDEVYEHIVFDGKPHASLSRRPLLAEHAFVISSFGKTYHTTGWKVGYCCAPRQLSAELRKVHQFMVFTVSSPMQFALAEYMANPKPYLDLPAFYQAKRDRLAAGLANTRFRPLPSPGTFFMLADYSEITKHAEADFARHLTIDHGVTVIPVSAFYQNPAAPESNHHLVRFCFAKQDATLDAAIERLAHV

SEQ ID NO: 74963 - protein, 385 aa, Populus tremula
MTIDCIKTMPSITAPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 74964 - protein, 108 aa, Triticum aestivum
  misc_feature (7)..(7): Xaa can be any naturally occurring amino acid
  misc_feature (24)..(24): Xaa can be any naturally occurring amino acid
  misc_feature (32)..(32): Xaa can be any naturally occurring amino acid
  misc_feature (88)..(88): Xaa can be any naturally occurring amino acid
  misc_feature (100)..(100): Xaa can be any naturally occurring amino acid
MAGRLTXMGSRIMGGHGAAARAAXSALRNRAXMGLPAGKAHRFPEQAPCPVNDEAWVVGQWAHPFPEPCVRPPWAPAHRAKYEASGVXCVAGLSFFPPLXRAWAALVK

SEQ ID NO: 74965 - protein, 335 aa, Oryza sativa
  misc_feature (155)..(155): Xaa can be any naturally occurring amino acid
MMRRSLVIVMVACSCATAIARGGGGGGGGLKLNFYSESERCPRAEEVVREEVRRLYEEHGNTAVSWLRALFHDCMVYSCDASLLLHTTTTTGVSEQSSHRSFGMRNFKYITAIKAAVERECPATVSCADILALAGRDGVAMLGGPSVAMRTGRRXTARESYYGVVEQYIPNHNDSVSTVSVEVRRPSGWNTEGAVALLGAHSVGRVHCFNLVGRLYPQVDGSMEAAYGEYLRGRCPTAAATEDTREVVYARNDRVTPMLIDNMYYRNLLAGRGLLLVDQQLASDARTAPYVRRMAADNDYFHQRFAAALLTMSENAPLTGAQGEVRKDCRFVNSS

SEQ ID NO: 74966 - protein, 569 aa, Zea mays
MELVYMERRNGSYDDGAVPEFSGRGAGGDQDQDPPAAASEVQSDSRQTPDEKKSKGCQSCRDPFCSCSGGTPHSELFPPHPAKMMILEFLIASLRHPTRTHNVSDLDDLIADGVSQGSVVNLGPSEKKVLESLHAMVNAKTRPKSPSPFMAGSKLRKIRSKSHVITQSEILKLISPETWEASSFPGASPMIGGGTAEDGVHGNKPPPPCCSSVSSNQHVLSRCPSSLSACLLQCIWKDGLPHFELSLDDHPIAVYAASPVRVLEKDRAFDYVYMIHSGEQGRKDWMGHSSNVSRLVGKVKVSSSLVLNPDKSGLLETEFVLYGSPDDYLRQMRSPYSVPKGKGLVRRVTEIMRAGNVSASPRHPWKLGKSSSHQFDDLAGVLEGEMISAGGSELRRKRRKEPVSGGWGLKFLEKAGLNRPQGTEETDVQNSDGATHCVTVVVPRGYHGGVVSKSSRPSGLVERWRSGGRCDCGGWDLGCPIRVLNGDGCGSLPEGESRDRRSVEISIKGWSDLYTSTLQGAKNETMLKLVNITEDLYILYFDSSISPLQCFSTGIAIVHSRAPELCPKL

SEQ ID NO: 74967 - protein, 430 aa, Arabidopsis thaliana
MAVISETSDEGSNGGAANKKPQEEEENIPPIPKELPEELIVIIVALVRRYHYPKLSLISKAYRDLISSPELFQTRSRLGFTEPVLYTSIGFPPFDLPSWYILHRISLQFKQITSLPSMLPGSAVVTIDYKMYVLGGFIGLNQPVSTMIVIDCRFHTYRELPSMQRDRGGAAAGVIDGKIYVIGGCKKRYNDWVEVFDVENESWETVPGPYPNVASESVEFSQYAVMEQKIYILDPLFCLTYEPRKRRFEAWGRRSQQRRYESCCVVNDMLCTVDSTCSHGYPIVVYDPKGMVWRPVKGVQSSDLPNLVYYESRMANFGGKLVILGGNQSRDRKDSYLEKDIWCIEIALEKREDGDIWGHVESRSVVLSSSKWPLIALSRSVTILSTTFADRDALRFLIYPENGSLSILFISVPVKTTRTKHLNYKRGISK

SEQ ID NO: 74968 - protein, 197 aa, Vitis vinifera
  misc_feature (41)..(41): Xaa can be any naturally occurring amino acid
  misc_feature (115)..(115): Xaa can be any naturally occurring amino acid
MVGQWTVTKPGRSDEVLEADQQQRITAQIRAHFDSITPKRXAKPSRSESDSPLSSPSHAANGTIPELHKFRTLQSQSQSESHAMISTDGSGMLQEEFVETHYYKELGSIDKQHHXTGTGFIKVERRGVEDGYGLQLQRRENREMMLRGFKSNPATNDWIPSLEEDEIKYADTEWSINCLLIAKEHGGENLSSNFLSF

SEQ ID NO: 74969 - protein, 517 aa, Physcomitrella patens
MAEKANAMQDPDEAEFMLPVDSEHKARTVKVLSIARPHMRAFHLAWISFFICFLSTFAAPPLIPIIRDNLNMTKPEIGQAAVASVSGSIMSRLMMGTICDLVGPRYGTAFLIMINAPAVFSMALVDDGEGFMICRFFIGFSLATFVSCEYWVSSMFTTKIVGTVNGLAAGWGNLGGGVTQIMMPLIFALFRDSFHNPAFTAWRLAFFVPGTLHVVLGLLILFFGQDLPDGNHSQLQRQGGDVKQGFLRVVYFAATSYRTWVFFILYGYSFGVELTVDNIIAEYFYDRFELNLNTAGLIAAASGLMNIFSRPAGGYFSDLAGHYFGMRGRLWFLWIVQSMGGLMCIVLGKMNSLTPSIIFMIFFSIFVQAACGATFGIVPFVSRRSLGVIIGLTAAGGNVGSVLTQSLFFTSSSYHTEVGLVYMGIMIICCTLPVTLIWFPQWGSMLFPASKGASEEDYYVSEWTAQEQEQGLHFPSLKFATNSRSERGCYGGVTSADPECDQPVAELGLSMWKSYSH

SEQ ID NO: 74970 - protein, 216 aa, Triticum aestivum
  misc_feature (78)..(78): Xaa can be any naturally occurring amino acid
  misc_feature (110)..(110): Xaa can be any naturally occurring amino acid
  misc_feature (124)..(124): Xaa can be any naturally occurring amino acid
  misc_feature (146)..(146): Xaa can be any naturally occurring amino acid
  misc_feature (155)..(155): Xaa can be any naturally occurring amino acid
  misc_feature (162)..(163): Xaa can be any naturally occurring amino acid
  misc_feature (166)..(166): Xaa can be any naturally occurring amino acid
  misc_feature (177)..(177): Xaa can be any naturally occurring amino acid
  misc_feature (183)..(183): Xaa can be any naturally occurring amino acid
MERPEWSLSDFEIGKFIGEGKFGKVYLGREKQSGYVVALKVTYKAKLQKYRFHAHLRREIEIQHGLDHPNVLRLFAWXFHDAERVVLRPPSMPPRGELYKLLRSVGHFSXERTAATYVASLAGXALAYWHKKQVIHRDIKPENLLXLDIQGRLKXANFGWAXXKCXNSQLCGTIDYXAQEMVXKRSRLPLTLDLGICHNFVGELRKIPDYQMARPK

SEQ ID NO: 74971 - protein, 445 aa, Burkholderia sp. 383
MGIHVIKMPDIGEGIAEVELVAWHVEVGQTIKEDQPLADVMTDKAAVEIPSPVTGKVIELGGRIGEMMAVGSELIRLEVEGDGNLKAGAPVRESKVATAPVAAAPSKAVADAAAESSAKPAPKHAPAEPRRAKHAEHAERVEPPRAALAPGERPLASPAVRQRAWDMGVELRYVRGTGEAGRILHADLDAYAGSGSGAARGSRGAHAHGYGERNDETEVPVIGLRRAIARKMQEAKRRIPHFSYVEEIDVTELESLRTDLNRRYGDTRGKLTPLPLLIRAMVIALRDFPQINARFDDEAGVVTRYGAVHMGVATQTDGGLTVPVLRHAEARDVWSISAEIARLADAVRANRAQRDELSGSTITISSLGALGGIVSTPVINHPEVGIVGVNRIVERPMIRDGAVVARKMMNLSSSFDHRVVDGADAAEFIQAVRAVLERPALLFVE

SEQ ID NO: 74972 - protein, 463 aa, Burkholderia sp. 383
MKNEHTTLLVIGGGPGGYVAAIRAGQLGIPTVLVERDRLGGTCLNIGCIPSKALIHVADAFEQARGHAGEGALGIRVRTPEIDIGKSVAWKDGIVDRLTRGVGALLKKNGVRVLHGDAQVVDGKTVDVVAGGHTTRISCEHLLLATGSEPVALPSMPFGGHVVSSTEALSPETLPKRLVVVGAGYIGLELGIVYRKLGVDVSVVEAAERVLPAYDAELVRPVADSLARLGVRLLLGHKVLGPAEHGAVRVQAADGAEQTLQADRVLVAVGRRPRVDGFGLESLPLDRNGRALWIDDECRTSMRNVWAIGDVAGEPMLAHRAMAQGEMVAELIAGKRRKFMPASIPAVCFTDPEIVTAGWSPDDARAADVDCVSASFPFAANGRAMTLQATDGFVRVVARRDNHLIVGWQAVGRGVSELAAAFSQSLEMGARLEDIGGTIHAHPTLGEALQEAALRALGHALHV

SEQ ID NO: 74973 - protein, 510 aa, Arabidopsis thaliana
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGLKQKSYDYLGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 74974 - protein, 594 aa, Arabidopsis thaliana
MENYEVLEQIGKGSFGSALLVRHKHEKKLYVLKKIRLARQTGRTRRSAHQEMELISKIHNPFIVEYKDSWVEKGCYVAEAIKKTNGVHFTEEKLCKWLVQILLALEYLHANHILHRDVKCSNIFLTKDQDIRLGDFGLAKVLTSDDLASSVVGTPSYMCPELLADIPYGSKSDIWSLGCCMYEMTAMKPAFKAFDMQGLINRINRSIVPPLPAQYSAAFRGLVKSMLRKNPELRPSAAELLRQPLLQPYIQKIHLKVNDPGSNVLPAQWPESESARRNSFPEQRRRPAGKSHSFGPSRFRGNLEDSVSSIKKTVPAYLNRERQVDLSTDASGDGTVVRRTSEASKSSRYVPVRASASPVRPRQPRSDLGQLPVSSQLKNRKPAALIRRASMPSSRKPAKEIKDSLYISKTSFLHQINSPDVSMNAPRIDKIEFPLASYEEEPFVPVVRGKKKKASSRGSYSPPPEPPLDCSITKDKFTLEPGQNREGAIMKAVYEEDAYLEDRSESSDQNATAGASSRASSGVRRQRFDPSSYQQRAEALEGLLEFSARLLQDERYDELNVLLRPFGPGKVSPRETAIWLSKSFKETTTTKLGD

SEQ ID NO: 74975 - protein, 338 aa, Xanthophyllomyces dendrorhous
MAVKVGINGFGRIGRIVLRNAIIHGDIDVVAINDPFIDLEYMVYMFKYDSTHGVFKGSVEIKDGKLVIEGKPIVVYGERDPANIQWGAAGADYVVESTGVFTTQEKAELHLKGGAKKVVISAPSADAPMFVCGVNLDKYDPKYTVVSNASCTTNCLAPLGKVIHDNYTIVEGLMTTVHATTATQKTVDGPSNKDWRGGRGAGANIIPSSTGAAKAVGKVIPSLNGKLTGMAFRVPTPDVSVVDLVVRIEKGASYEEIKETIKKASQTPELKGILNYTDDQVVSTDFTGDSASSTFDAQGGISLNGNFVKLVSWYDNEWGYSARVCDLVSYIAAQDAKA

SEQ ID NO: 74976 - protein, 801 aa, Vitis vinifera
MGGSRVQVNKAHKTRFSSKSSRQVHKTSLQEKSRITKPGSNVAKGAKAARLQRNKMIRDQKRAAILKEKRASSGSTSPPRVIVIFGLSASVNVNSVEDDLLTLLSSKGNEPVFSTVASSEYKLRTTVLKAPHGDLSSCIEMVKVADLIAFVASASCSCEEGTSNYYIDSFGTQCLSVFRALGLPSTVVLIRDLPPEQKQRHELKKMCSSSLSSEFPEDCKFYPADTKDELHKFMWLFKEQRLSVPHWRNQRSYLMAQKVDLVPDDCNSGNCTLLLTGYLRAHGLSVNQLVHISGAGDFQLSKIEILKDPFPLNARKGQDLMDSDELNDEQVIRSLAPDKLKQEPLIIENVPDPLAGEQTWPTEAEMAEADRNQKQKNLKKRILPRGTSEYQAAWIVDDTDVEDSDRSDDDDAGDGMVLDENESCLPGHEGNNNFDLDDDQASLSLDSRDNDEQTDVDSVMMEGENLTREQIEDEIKKLKDAHAEDEEYPDEVDTPLDVPARKRFAKYRGLKSFRTSSWDPKESLPPEYARIFSFDNFARTQKHVLAKALDMEQGYMDDCLPAGTYIRLHIREVPVSVASKLCMLGKRMPVIACGLLQHECKMSVLHFSIKKHDAYDAPIKSKEELVFHVGFRQFVVRPIFSSDNMNSDKHKMEKFLHAGRFSIASVYAPISFTPLPLIALKSVNDVAASPAVVAFGSLRCVDPDRIILKKIILTGYPQRVSKLKAAVRYMFHSPDDVRWFKPVEVWTKCGRRGRVKEPVGTHGTMKCIFNGVLQQHDTVCMSLYKRTYPKWPEHGFPLLYA

SEQ ID NO: 74977 - protein, 132 aa, Vitis vinifera
MSRSLGIPVKLLHEAAGHVVTVELKSGELYRGNMIECEDNWNCQLESITFTGKDGKVSQLEHVFIRGSKVRFMVIPDMLKNAPMFKRLDARIKGKGSALGVGRGRAVAMRARAQAAGRGAPPGRGVVPPVRR

SEQ ID NO: 74978 - protein, 308 aa, Vibrio superstes
GFGRIGRFVFRAAQERNDIEVVGINDLIDVEYMAYMLKYDSTHGRFNGTVEVKDGNLIVNGKTVRVTAERNPEDLKWDAIDVDVVAEATGLFLTDETARKHITAGAKKVVLTGPSKDATPMFVSGVNFNTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLKEGASYEAICAAMKEASEGEMAGVLGYTEDQVVSQDFIGEVCTSVFDAKAGIALNDKFVKVVSWYDNQV

SEQ ID NO: 74979 - protein, 413 aa, Corynebacterium glutamicum ATCC 13032
MLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 74980 - protein, 304 aa, Vibrio superstes
GFGRIGRFVFRAAQERNDIEVVGINDLIDVEYMAYMLKYDSTHGRFNGTVEVKDGNLIVNGKTVRVTAERNPEDLKWDAIDVDVVAEATGLFLTDETARKHITAGAKKVVLTGPSKDATPMFVSGVNFNTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLKEGASYEAICAAMKEASEGEMAGVLGYTEDQVVSQDFIGEVCTSVFDAKAGIALNDKFVKVVSWY

SEQ ID NO: 74981 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGHASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 74982 - protein, 300 aa, Vibrio superstes
GFGRIGRFVFRAAQERNDIEVVGINDLIDVEYMAYMLKYDSTHGRFNGTVEVKDGNLIVNGKTVRVTAERNPEDLKWDAIDVDVVAEATGLFLTDETARKHITAGAKKVVLTGPSKDATPMFVSGVNFNTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLKEGASYEAICAAMKEASEGEMAGVLGYTEDQVVSQDFIGEVCTSVFDAKAGIALNDKFVKV

SEQ ID NO: 74983 - protein, 696 aa, Triticum aestivum
  misc_feature (498)..(498): Xaa can be any naturally occurring amino acid
  misc_feature (633)..(633): Xaa can be any naturally occurring amino acid
FVAVTRTEKRGKTCDRCGKRKWESKESCIVCDKRYCGYCLLRAMGSMPEGRKCITCIGRPIYEGKRSKLGKSSRILSRLLSSLEVRQILKAEKECQANQLRPEQLIVNGFPLCQEEMSDLLSCPRPPQNLKPGRYWYDKESGLWGKEGEKPNRVVSTNLNFNGKIQPNASNGNTQVYMNGREITSIERKILRFAQVQCPRDTHFWVYHDGGYEEEGQNNIKGKIWESPLTRFVCTLVSLPVPPANSVEPRDDAPYSARTVPEYLDQKRIQKLLILGSPGAGTSTRPKQAKLLYGSRFTPEELDNIKLMIQSNMFKYLGILLEGRERFEEEALAISNNPNSEDQDTQQDGNESSGLNSCIYSINAKLKKFSDWLLDIIAMGDLDAFFPAATREYAPVVDELWKHPAIQATYKRKDELYFLPDVAEYFLSRAIEVSSNEYEPSEKDVLYAEGVSQGNGLAFIDFTLDERNPMSELYGDSHDPSSQAQNKYQLIRVNAKGXNEGCKWVEMFEDVRAVIFSVALSDYDQLGAPASGTSRRLENKMIQSKDLFEATIRHPSFRDTPFVLVLNKFDIFEEKIGRSPLTACEWFSDFDPLRTHNNQSMAQQAFFYVAMKFKNLYAAHTGDRKLFVWQARXRDGPTVDEAFRYIREVLRWEDEKEYGGFCPDESFYSTTELSSSRLVEQDWQQHPAADQRQGST

SEQ ID NO: 74984 - protein, 254 aa, Pyrococcus abyssi GE5
MSVKAWRKIALDIINDFDQNVMPLFGDARAGETVGISPSGDETKVVDKVAENVVVSKFKALGVNIVSEEMGVIEQGSEYTVLIDPLDGSYNFISGIPFFALSVAIFKGEEPVYAFIYEPVVKKLYEGIPGQGAYLNGQRIKVRKLGEKPSISFYTRGKGIELLNHVKRTRTLGAIALELAYLARGALDGVVDIRNYLRPTDIAAGVIIAKEAGALVKDSNGDEIEVSFSATDKVNLVAVNDEELLKMVLSLIEK

SEQ ID NO: 74985 - protein, 371 aa, Glycine max
MAGVNPNGVADFPATPTHGGQFIQYNIFGNLFEVTAKYRPPIMPVGRGAYGIVCSLLNTETNELVAVKKIANAFDNHMDAKRTLREIKLLRHLDHENVIGLRDVIPPPLRREFNDVYIATELMDTDLHHIIRSNQNLSEEHSQYFLYQILRGLKYIHSANVIHRDLKPSNLLLNSNCDLKIIYFGLARPTLESDFMTEYVVTRWYRAPELLLNSSDYTSAIDVWSVGCIFMELMNKKPLFPGKDHVHQMRLLTELLGTPTEADLGLVKNEDARRYIRQLPQYPRQPLAQVFPHVHPAAIDLVDKMLTVDPTKRITVEEALAHPYLEKLHDVADEPICMEPFSFDFEQQQLDEEQIKEMIYREALALNPEYA

SEQ ID NO: 74986 - protein, 327 aa, Ehrlichia ruminantium str. Welgevonden
MKISILGAGSFGTAIAIALSAHGISVNLWGRDHRNTTHINTYRKNLKYLPTYHLPDNIYATSNIDEVLSDNNTCIILTIPTQQLRTICTQIQHKQHMCKNTPILICSKGIEITSLKFPSEIAEEILQYNPIFILSGPSFAKEIAEHLPCSIVLAGDNKELGESLIEKISNDVLKIIYHQDIIGVQIGAALKNIIAIACGIIAGKNLGNNAVATVITKGMNEIKTLYIAKNHSIDLHTLIGPSCLGDLILTCTTEHSRNMAFGLEIGKGRNINTLIDHNLKLVEGTSTVKPLISLAKKLNVELPICISIYNLLHENISLDKAISNILS

SEQ ID NO: 74987 - protein, 546 aa, Actinobacillus pleuropneumoniae serovar 1 str. 4074
MQNINPTQTAAWSALEQHKADNLNIPQLFAEDANRFDKYHLNFEQQILVDFSKNAINQKTLELLRQLANECGLASATEAMFSGQKINRTENRAVLHTALRNRSNTPVLVDGKDVMPEVNAVLAKMKDFCERIISGSWKGYTGKAITDVINIGIGGSDLGPYMVTEALRPYKNHLNMHFVSNVDGTHIAEVLKKVNPETTLVLVASKTFTTQETMTNALTAREWLLAAEKDESAVAKHFAALSTNAKEVAKFGIDTANMFEFWDWVGGRYSLWSAIGLSIALSLGFENFEALLSGAHAMDNHFRTAPIEKNIPTTLALIGIWNSNFLGAETEALLPYDQYLHRFAAYFQQGNMESNGKFVGRDGSPVTHQTGPIVWGEPGTNGQHAFYQLIHQGTKLIPCDFIAPAQTHNPVGDHHAKLLSNFFAQTEALAFGKSKETVEAEFVAAGKNLADVAEIVPFKVFTGNKPTNSILVQKITPFTLGALIAMYEHKIFVQGVIFNIYSFDQWGVELGKQLANRILPELQNAEKISSHDSSTNGLINQFKAWR

SEQ ID NO: 74988 - protein, 254 aa, Debaryomyces hansenii CBS767
MTHVAILTGASRGIGSSIAEIYLKKDSSNKLVAVSRSEKELKKLSEEYGSDRVQFVVGDVAKPETSTKVLKLAIEKFGQINSIIANAGVLDPVDQVSKADVDGWRGLFDINFFAVVDLVQQCIPELRKTKGNIIAVLSGASTTAYNGWGAYGASKAALNHFVLSVASEESDISAISVAPGVVDTNMQNDIRNKFGRNMTKDSLKKFVDLHKNNELLPPEVPATCYVNLALNGWDKTINGKYLRINDDAMKPYLQ

SEQ ID NO: 74989 - protein, 430 aa, Gloeobacter violaceus PCC 7421
MQIAVIGLSHRTAPVEIRERVSIAEGQVPEYVSRLRSCSQVAECAILSTCNRLEIYTVLRDSEHGLREVTRFLAESKGVLLPTLQRHLFVLLHQDAVMHLMRVAAGLDSIVLGEGQILAQVKMTQSLAQQGKGVDRVLNQLFKTAITAGKRVRSDTNIGTGAVSVSSAAVEMALRKKGPLHNQRCLVVGAGKMGELLVRHLLAKGARQIIVLNRSLEKAAQMVEQFGLMLPVATVDELTNYVPCSDLIFTCTGATEPLLTLEKMSSLRRDQSLMIFDIAVPRNVATEVDELPNVQLFNVDHLKQVVEENRAYRQLMVTQCEEILLEQLDEFLDWWRGLEAVPTINQLRQKVETIREQELEKALSRLGTEFAEKHQGIIDSLTRAIVNKILHDPMVQLRAQRDIEARRRALQTLQTLFNLEAQSNPEPPTL

SEQ ID NO: 74990 - protein, 522 aa, Neisseria meningitidis Z2491
MKHRTFFSLCAKFGCLLALGACSPKIVDAGAATVPHTLSTLKTADNRPASVYLKKDKPTLIKFWASWCPLCLSELGQTEKWAQDAKFSSANLITVASPGFLHEKKDGDFQKWYAGLNYPKLPVVTDNGGTIAQSLNISVYPSWALIGKDGDVQRIVKGSINEAQALALIRDPNADLGSLKHSFYKPDTQKKDSKIMNTRTIYLAGGCFWGLEAYFQRIDGVVDAVSGYANGNTKNPSYEDVSYRHTGHAETVKVTYDADKLSLDDILQYFFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKTAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSYNMRRTEVRSHAADSHLGHVFPDGPRDKGGLRYCINGASLKFIPLEQMDAAGYGALKSKVK

SEQ ID NO: 74991 - protein, 483 aa, Burkholderia sp. 383
MDEQLITGRLLIDGELVDSETGEWAASINPATEAVIGRAPAGSRRDVARAVDAAQRAWPAWAERTGEERGELLRGFGERLLERAEELSRIEVLDSGNTYVPTLASMHETVRSLRYYAGLVHGLHGETIPATGRNLHMTVYEPYGVVGRIAAFNHPAMFSAARTASALVTGNTVVVKPPETSPLSVLVLGEVARDTLPAGVFNIVNGTGAEVGDALVRHPDVKRLALIGSVATGQAIQRSAAEVGVKHVTLELGGKNPMIVFPDADPDAAADSAVRGMNFSWQGQSCGSNSRLLVHDDIYDDVLARVVERVAAIRVGDPMSPDTGMGPINSRKSYDHVMSFLDPAQTHGARLMTGGRRPPGHAFEKGFWVEPTVYADVTPGMRLWREEVFGPILSVARWRDVDEVVAMANDTEYGLSAAIWTNDIRQALNTARRIRAGSVFVNGSNTHFLGVPWGGFKNSGVDREEGIEEMYSYVEKKVINVML

SEQ ID NO: 74992 - protein, 478 aa, Nitrosomonas europaea ATCC 19718
MTIPDGYHDHVDTTGSVHTPLWRDFLQNCQRLIEPANSFLVSGTLTRVAGLVMEAVGLKLAVGTSCIVFLPNGNSVTAEVVGFSGERLFLMPSGDIYGLTPGAKVVPTEYTGAVPRIGTLQHPRRRAADRTKHISVGPELLGRVLNGSGDPLDRYGPLHCGHSVPLYSRPFNPLERAPIEKTLDVGVRAINTLLSVGRGQRMGLFAGSGVGKSVLLGMMARYTSADVIVVGLIGERGREVQEFIEHILGPEGLARSVVVAAPADTSPLMRLHGAAYATAIAEYFRDEGKHVLLIMDSLTRVAMAQREISLAIGEPPATKGYPPSVFARLPQLVERAGNGRRGSGSITAFYTVLTENDDPNDPIADNARAILDGHIVLSRRLAEAGHYPAIDIEASISRVMASLVTREQLGQAQRFKALYSRYQRSHDLISVGAYASGSDPQLDRAIELYPVLESFLQQGMFEQESYIESMEKLSALQL

SEQ ID NO: 74993 - protein, 248 aa, Azoarcus sp. EbN1
MLLEGKTALVTGAGNGIGRTIALTYAAEGANVVVSDISDEWGRETLALIEGKGGKAVFQHADTAHPEDHDELIAAAKRAFGRLDIACNNAGISGEFTPTAETTDAQWQRVIGINLSGVFYGVRAQIRAMLETGGGAIVNISSIAGQIGIEGITPYTAAKHGVVGLTKTVAWEYGSKGIRINSVGPAFINTTLVQNVPLETRRQLEQMHALRRLGETEEVANLVAWLSSDKASFVTGSYYAVDGGYLAR

SEQ ID NO: 74994 - protein, 267 aa, Azoarcus sp. EbN1
MKQNLSGKVAYVSGAASGIGAAIARVFAAEGASVLLGDVQVERGETVAAHIREQGGRALFIHHDVSDERQWESALACAVEEFGGMDLLVNNAGIEQTGLLADVELADINKLLAVNVAGVILGHKHAIRTMRPGGSAGKGGSIINLSSVAGLIGTPALGVYSATKGAVRLLSKAAAVECGRLGYGIRVNSIHPGLVDTDMGVKLVDDFVGLGVFADRETALRQMLETYPIGRTGVPGDIAGTALFLASEQSSWITGTEIVVDGGMTIS

SEQ ID NO: 74995 - protein, 351 aa, Vitis vinifera
MFTFAELKSATRNFRPHTMLGEGGFGRVFKGWVDEKTYAPTKVSVGIPVAVKKSNPESEQGLKEWQSEVKFLGKFTHPNLVKLLGYCCEDQQFLLVYEYMHKGSLENHLFKLGGAESLTWEIRLKIAIGAARGLAFLHTSEKTVIYRDFKSSNILLDGDYNAKLSDFGLAKLGPSDGDSHVTTQIVGTYGYAAPEYIATGHLYVKSDVYGFGVVLLEMLTGKQTLDINRPPGQLNLVEWTKPLLPNKRKLKKIMDPRLRDQYPLKAATQVAELILKCLESDPKNRPSMEEVLETLKRINEIKEKPNSKEAKAATTQPQPHHHRSPHRPKHGGTGAGIGARTPPHGRTGRRG

SEQ ID NO: 74996 - protein, 78 aa, Pseudoalteromonas tunicata D2
MSNIQERVKKIIIEQLGVKEEEVKNESSFVDDLGADSLDTVELVMALEEEFDTEIPDEEAEKITTVQAAIDYVTAHAE

SEQ ID NO: 74997 - protein, 358 aa, Vitis vinifera
MFTFAELKSATRNFRPDTMLGEGGFGRVFKGWVDEKTYAPTKVSVGIPVAVKKSNPESEQGLKEWQSEVKFLGKFTHPNLVKLLGYCWEDKQFLLVYEYMQKGSLENHLFRVGAEPLTWEIRLKIAIGAARGLAFLHTSEKTVIYRDFKSSNVLLDGDYNAKLSDFGLAKLGPSNGDSHVTTRIVGTYGYAAPEYIATGHLYVKSDVYGFGVVLLEMLTGNQALDLNRPPGQQNLVEWAKPSLTNKRKLKKIMDPRLRDQYPLKAAAQAAELILKCLESDPKNRPSMEEVLETLKRINEIKEKPNSKEVKVATNQPQLHHHRSPYHPKHGGAGAGIGARTPRHGRMDRRGRQLTPKVG

SEQ ID NO: 74998 - protein, 302 aa, Vibrio gallicus
GFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVKVVS

SEQ ID NO: 74999 - protein, 499 aa, Oryza sativa Japonica Group
MGALALALVVVVVVHVAVNAFGRRRLPPSPASLPVIGHLHLLRPPVHRTFHELAARLGPLMHVRLGSTHCVVASSAEVAAELIRSHEAKISERPLTAVARQFAYESAGFAFAPYSPHWRFMKRLCMSELLGPRTVEQLRPVRRAGLVSLLRHVLSQPEAEAVDLTRELIRMSNTSIIRMAASTVPSSVTEEAQELVKVVAELVGAFNADDYIALCRGWDLQGLGRRAADVHKRFDALLEEMIRHKEEARMRKKTDTDVGSKDLLDILLDKAEDGAAEVKLTRDNIKAFIIDVVTAGSDTSAAMVEWMVAELMNHPEALRKVREEIEAVVGRDRIAGEGDLPRLPYLQAAYKETLRLRPAAPIAHRQSTEEIQIRGFRVPAQTAVFINVWAIGRDPAYWEEPLEFRPERFLAGGGGEGVEPRGQHFQFMPFGSGRRGCPGMGLALQSVPAVVAALLQCFDWQCMDNKLIDMEEADGLVCARKHRLLLHAHPRLHPFPPLL

SEQ ID NO: 75000 - protein, 301 aa, Vibrio gallicus
GFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVKVV

SEQ ID NO: 75001 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNEDDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 75002 - protein, 303 aa, Vibrio gallicus
GFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVKVVSW

SEQ ID NO: 75003 - protein, 303 aa, Vibrio gallicus
VGINGFGRIGRFVFRAAQERNDIEVVGINDLIDVDYMAYMLKYDSTHGRFNGTVEVKDGNLIVNGNTVRVTAERNPEDLKWDAIGVDVVAEATGLFLTDETARKHITAGAKKVVLTGPSKDATPMFVNGVNFDTYAGQDIVSNASCTTNCLAPIAKVLNDKFGIETGLMTTVHATTATQKTVDGPSAKDWRGGRGASQNIIPSSTGAAKAVGVVLPEVNGKLTGMAFRVPTANVSVVDLTVNLVNGASYEAICAAMKEASEGEMAGVLGYTEDAVVSQDFIGETCTSVFDAKAGIALNDKFVK

SEQ ID NO: 75004 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 75005 - protein, 492 aa, Oryza sativa Japonica Group
MGYLSCRADSSVATCRSITAISPLPLSRRSGVGGRRRALPAAAREGDGGEASSAAATIERFAYDELEAATSHFADAALLGRGSHGAVYKAVLASGRAVAVKRPSPRRPEVDNEIRILSSVRGPRLVNLLGFSDSGAGAGADQQQQQHRPRLLVVEYMPNGTLYELLHSNPRPPGWPRRVRLALQTARALRALHDADPPVIHRDVKSANVLLDANLDARLGDFGLALRVPKRLPGDAAANAAATPAPAGTLGYLDPAYVTPESLSTKTDVFSFGILLLEIMSGRKAIDVQHSPPSVVEWAVPLLRKGKVASLFDPRVAPPRDPVTRRDLAALAASCVRSCRERRPSMADIVDRLVVLSKAVSGKMWNGLAVVGNPCAVVDVQKTIAKRAAAAAAGDRAASQRELTSALAFDDDEKKEEEDAPNAGALEEDEVPLVGAKKAPRPLKNGKMFSEPGARERRNLLELMARIDGVAGQRFGITRARTIALLARASVS

SEQ ID NO: 75006 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 75007 - protein, 873 aa, Ehrlichia ruminantium str. Welgevonden
MSERLIYYFSKNKCDGNLKLNHILGSKGANLAEMCNIGISVPPGFTISTAVCSHYNDNKLPDQISYLIQNAIEFLNNEVNLKFGDENNPLLLSVRSGSVSSMPGMLDTILNVGLNDKTVIGLAKKSGDLFAYDSYRRLIQMYAHTVLQVENSFFEEAIYKKKSVSTSKNEKISDPNIFKELIDEFKRIVKLHTNKDFPQDVNEQLYTAIYAVFRSWMNKRAITYRKIHNIPDNLGTAVNVQSMVFGNMSENSATGVVFTRNPSTGTKEIFGEFLISAQGEDVVSGTHSPLPLNKMKDLMPITHNELEQVCKKLELYYRDMQDIEFTIENGKLWILQTRSGKRSIQSAVKIATDMVKEKLISKEEAITRIDHKSFSKLFHPTLESSTNTDIIAYGLPASPGAATGQVVFTPSDAEQLKKEGKNVILIRQETNPEDINGMNSAVGIITLRGGMTSHAAVVARGMGKPCICSVNNIFIDKSEQFFYTNTGIKVYKGDNITINGCNGEVILGVIKTTLPKLDESFYDLMEWVDEIRTLKVMANADTPEDAEISMNFKADGIGLCRTEHMFFSDKRISIVQEMIVSDKKEERAVALEKLEIMQKEDFKKIFTHTLDKQVTIRLLDPPLHEFLPDNDDAIQEISSRTGKSLEKLKNRILYLLEKNPMLGHRGCRLAISYPEIYEMQVKAIFLAIKELQEETGIKEIIPEIMIPLIMSEEEIIVIKELVNNIAKQFDNPKYLLGTMIELPKAALIADKIAKHVQFFSFGTNDLTQTTLGVSRDDSASFIGTYRDLGIIKHDPFETLDIDGVGKLISIAVSLGKKESPDIKIGVCGEHGGNFESIQFFSRLNINYISCSPYRIPIARLIAAQCTIFNKDIN

SEQ ID NO: 75008 - protein, 415 aa, Vitis vinifera
MCRGSTSSDVSDESTCSSFSSSINKPHKANDSRWEAIQAVRARDGVLGLSHFRLLKRLGCGDIGSVYLSELSGTKSYFAMKVMDKGSLASRKKLLRAQTEREILQSLDHPFLPTLYTHFETEKFSCLVMEFCPGGDLHTLRQRQPGKHFTEQAVKFYVAEVLLALEYLHMLGIVYRDLKPENVLVRDDGHIMLSDFDLSLRCAVSPTLVKTCSLESDPFRKNPPACIEPSCIQPSCQIQKGPQTQKRISPLPELIAEPTGARSMSFVGTHEYLAPEIIKGEGHGSAVDWWTFGIFLYELLFGKTPFKGSGNRATLFNVVGQPLRFPESPVVSFSARDLIRGLLVKEPQHRLAFKRGATEIKQHPFFEGVNWALIRCATPPEIPKPVEIERIPAPTASTIVPDQKSSDNYLEFDFF

SEQ ID NO: 75009 - protein, 425 aa, Zea mays
MQNPRLKQQQQQQQQQQQAMMQQALMQQHHSLYHPSLMAPPPPPPQMEPLPSGNLPPGFDPTTCRSVYAGNIHTQVTEVLLQEIFASTGPVESCKLIRKDKSSYGFVHYFDRRSAGLAIMSLNGRHLFGQPIKVNWAYATGQREDTSSHFNIFVGDLSPDVTDAALFESFSAFNTCSDARVMWDQKTGRSRGFGFVSFRNQQDAQNAINEMNGKWLSSRQIRCNWATKGATFGDDKHSSDGKSVVELTNGSEDGREISITNEEAPENNPQYTTVYVGNLAPEVTQLDLHRLFHTLGAGVIEEVRVQRDKGFGFVRYNTHDEAALAIQMGNSQPFLFNRQIKCSWGNKPTPIGTASNPLPPPAPVAVPGLSPMDLLAYERQLALAKMHPQAQHSLRHANAAGASAAMYDGGFQNVAAAHQQLMYYQ

SEQ ID NO: 75010 - protein, 452 aa, Desulfitobacterium hafniense DCB-2
MDYELQKKYGLFTAIAMVIGIVIGSGVFFKAEKILLATGGDLPLGILAWVIGGMIMIVCAYVFATMATRYEKVNGVVDYAEATMGRGYAYILGWFMTTIYYPAITSVLAWVSARYTCVLLGWDIVGAEAMAIAGFYLVGSYALNALSPKLAGKFQVSTTIIKLIPLILMAILGTITGLSNGVLVKNFTSGVIADVSTTNPLFTAVVATAFAYEGWIIATSINAELRDAKKNLPRALTFGTMFVALIYILYYTGLAGAVENSVIMEGGETGAKIAFSTVFSNLGGSVLFVFVVISCLGTLNGLMLGCTRGFYSLAARDLGPQPHIYKNIDANTNMPTNSAIMGLLFTAGWLLYFFGANLVPESWFGPFSFDSSELPIVTLYVMYIPIFIMMMVKEQSLGGFKRFIMPTLAIFACIFMVIAAIYAHRWAVLYYLILFIVVMAVGGIFYFTKKPH

SEQ ID NO: 75011 - protein, 234 aa, Thiomicrospira crunogena XCL-2
MAKKENWIAPSILSADFAQLGTDVKDVIAAGADVVHFDVMDNHYVPNLTIGPLVCESLKNFMVKEDVKAPIDVHLMVKPVDRLIGDFASAGADIITFHPEASEHIDRSLQLIKAEGCQAGLVFNPGTSLSYLEHVMDKIDMILIMSVNPGFGGQAFIPQALEKLKAARKMIDESGRDIRLEIDGGVKVENIAEVAAAGCDTFVSGSGIFGKASASDANRYDTVIQQMRDELAKV

SEQ ID NO: 75012 - protein, 442 aa, Debaryomyces hansenii CBS767
MGCAASVPEMDENDPFIQDKKINDAIEQRLRTSKQNEKNQVKLLLLGAGESGKSTVLKQMKLLHKGGFTQQERMQYSQVIWVDVIQSMKILIIHARKLGIRLECDQDNSPLIPYKQIILRANALDQIDTGVAGGTNFLNDYVLKYSEGNKNKRKLSSTGVASLSFWDDETIESPRRKDSNGVEQFNNGLSEISIHGNKGHDNSLMNSRRKIADAISKLWELDSGIQNCFDRSNEFQLESSAVYYFECIHKFADPNYLCNDMDILKGRIKTTGITETNFNINSFKFKVLDAGGQRLERKKWIHCFDNITAILFVLAISEYDQMLFEDEKVNRMHESIILFDSLCNSKWFLNTPFILFLNKIDLFESKLSKSPLRKYFPDYTGKATDLDEAVKFFEKIFLNLNATKKPIYVHRTCATDSKSMKFVLSAVTDLIVQQNLMKSGII

SEQ ID NO: 75013 - protein, 505 aa, Brassica napus
MTSINVKLLYHYVITNLFNLCFFPLTAIVAGKAYLTIDDLHHLYYSYLQHNLITIAPLLAFTVFGSVLYIATRPKPVYLVEYSCYLPPTHCRSSISKVMDIFFQVRKADPSRNGTCDDSSWLDFLRKIQERSGLGDETHGPEGLLQVPPRKTFARAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGQTGVSLSKDITDVAGRTVKKNIATLGPLILPLSEKLLFFVTFMGKKLFKDEIKHYYVPDFKLAIDHFCIHAGGKAVIDVLEKNLGLAPIDVEASRSTLHRFGNTSSSSIWYELAYIEPKGRMKKGNKVWQIALGSGFKCNSAVWVALNNVKASTNSPWEHCIDRYPVKIDSDSGKSETRVPNGRS

SEQ ID NO: 75014 - protein, 341 aa, Picea sitchensis
MSAYFDYIANSAAELKTLNRGRTLYTNNKGKWGGGPGWTGVPFKHPSSFDSLALDPTHKNKIIRDLDRFRQGKEFHSRVGRPWKRGYLLYGPPGTGKSSLVAAIANYMKYNVYDLELTKVTDNSELRTLLIQTTNKSMIVIEDIDCSLDLSNRLSKPPKLDGGNMDDEEKSGSRVTLSGILNFTDGLWSCCGEERIIIFTTNHKDRLDPALLRPGRMDMRIYLSFCTFPAFKCLAFNYLQIEDHPLFSAVEERMSGGAEMTPAEISEILIEHLDDSLKALNAVISALNGKEPSAIPNSLERQEAVEERISTSHIHEEEGVRFRGRGVGQKGPEVLELSNGY

SEQ ID NO: 75015 - protein, 149 aa, Triticum aestivum
  misc_feature (87)..(87): Xaa can be any naturally occurring amino acid
MRFDRARLGRIAFGDQQTVVLTFCGAVPRARGCPCDIFSCQFAVQDRANMVIPAATGGKSFLQDMWQVTGEGQVRFRVVQMEGLSVXRSIRHCEEFASVLVAGELFGGAVGSILKVSVGFRFRMRADVEEEDAVWRNSGLAMVRCLEGG

SEQ ID NO: 75016 - protein, 354 aa, Rickettsiella grylli
MNYYLKIFNKLISDYANKFSGYNKNRLTPLLYNHQMSMDFNINLYIKREDTIDNIGSGNKYRKISYIIDDAVSKKSTVLVTTGSVASNQCKAVSYFAAANQLKAHVVYGGDTQKKPHHAQGNYLLTSLFNPSVTWFEESKWEDISNKMDEIVDALLDRGESVYRINSGASEWPGIVGSIELGFELAGQCFENNIDGEVNIVLPFGSGGTCLGLHVAADILGLSWNIYGMCIGDEPDIGMKRLENMKFDLLKRIPFLSNNIQNVFLLKLPSNGKYDEPSKIELDAMQKALQNYALLLDTNYMIKAYLGLNFLTSLDQSTRKKVTILLHTGGSIGIFNLNNNMMNWHANQFKDWVV

SEQ ID NO: 75017 - protein, 181 aa, Arabidopsis thaliana
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 75018 - protein, 389 aa, Ralstonia solanacearum GMI1000
MNADARPTGVIYLDHCATTPCLPEVVDAMRPYMDREFGNPASAHVMGRRARHAIENATQQVASLIGARPEEIVFTSGATEANNIALFCGFAHDERAPAGALLCPIDHKSTLDVGKELKRRGLAVDYLPVAANGRVRPADVMARLTAATRIVSIAHVNSELGTIQPVDEIARVTRQSGAWLHVDAVQSVGKLPVDARACGIDMLSLSAHKLRGPKGVGALFVDARVAPRLRPFIFGGGQNRLRSGTLPTPLIVGFGLACEIAQSALAQRHRKAMALRSHFIARLCQSVPDTVLNTDVACSSPYVVNVRFGDIASEALVSGLHQVAISTGSACNSAELQPSHALIGVGLSADQARASVRFCLDPDLDTETLDTAIGHFVFRLNSLRQEHYA

SEQ ID NO: 75019 - protein, 319 aa, Brassica napus
METPTMKPDTVLILDFGSQYTHLITRRIRSLNVFSLVLSGTSSLKQISSHNPRVVILSGGPHSVHAHDAPSFPEGFVEWAEGNGVHVLGICYGLQLIVQRLGGVVVEGESKEYGKMEIEVKGGESEIFGKGRVGEKQVVWMSHGDEALKLPDGFEVVAQSAQGAVAALENRERRIYGLQYHPEVTHSPKGMETLKHFLFDVCGVSADWKMEDLMEEEIKVINKTVAADEHVICALSGGVDSTVAATLVHKAIGDRLHCIFVDNGLLRYKEQERVMDTFERDLHLPVTCVDASEQFLSQLKGVVDPEAKRKIIGKEFINI

SEQ ID NO: 75020 - protein, 362 aa, Zea mays
  misc_feature (273)..(273): Xaa can be any naturally occurring amino acid
  misc_feature (329)..(329): Xaa can be any naturally occurring amino acid
MAAASLLEATRFLSTPHPRSRSRPLPFPPGSGLHPHLLRTPRLSTLRVHLHRPAPLGAQEPARPGALLAVDALRRSVLDSLAALKRPALALLLAGVLLAAASAGGPHAAALAASGGRVGGSAFSSRSSSPRSYGYSAPAPRGGYTAAPFYSPSPFVSVGPALGIGFGGSGFLVTLMGFAAFLYLAGFLSDSSGATSVLTETEKTTVLKLQVGLLGMARSFQKELDQIAEKADTSTPAGLSYVLTETTLALLRHPDCCISAYSSVDVKRSIDNXIKRNKGGSQRSSGFSNEYIVITILVAAEGVHKVPVINSSNDLKTALQKMGAIPSRXKILAVEVLWTPQNENDTLSERELLEDYPLLRPL

SEQ ID NO: 75021 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGEPCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 75022 - protein, 197 aa, Thiomicrospira crunogena XCL-2
MLLMIDNYDSFTYNLVQYFGELGQEVEVYRNDQITIEAIEKMKPDYLVISPGPCTPNEAGISIAAIQHFAGKIPILGVCLGHQSIGQAFGANVIRAKEVMHGKTSPVYHHDIGVFRGLPNPVETTRYHSLVLEQESLPDCLEVTAWTQCDEGGVDEIMGVRHVSLPIEGVQFHPESILTEQGHAMLKNFLEQKDQRP

SEQ ID NO: 75023 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 75024 - protein, 509 aa, Zea mays
MVGSGAAGGGADHARSKEAAGMMALHEALRNVCLSSDWTYSVFWTIRPRPRCRGGNGCKVGDDNGSLMLMWEDGFCRPRVAECLEDMDGEDPVRKAFIKMSIQLYNYGERWVLDYDWVTVTAPTSRRHPPLISPATSRETVALLFPVLRLGLRGNPKLIVISTDPRGSRRLMGKVASDKCHKWVFKEPSECEPNISNYWQSSFDATIAVIQAGHGLLQLGSCKIIPEDLHFVLRMRHMFESLGYQSGFFLSQLFSSSRGASPTPTPPFPLKQPPAAPAARAPPQLFSWPGHHQPQQLPSPAGASPLFPPGPGAFHPSSARPMPPFPGGKDEGHMFHLPPAAHHGTNKQPPQHMDEHHHHQQQPMVGAGGDAPDGDLRWPNGLSFFTALTGRADDAKLLFGGPGAGAGAADDDDKAAPDAHGGAENVEEYLSLESHSNKARKVESPAAQSTNKFKRSFTLPARMSSSSSTSAFPSVSASTAPPQQQQAGMEYRGPHEGGVYSDLMETFLE

SEQ ID NO: 75025 - protein, 352 aa, Streptomyces coelicolor A3(2)
MTHQWRGIIEEYRDRLPVSDSTPVVTLREGGTPLVPAQVLSERTGCEVHLKVEGANPTGSFKDRGMTMAISKAKEEGAQAVICASTGNTSASAAAYGVRAGMVSAVLVPQGKIALGKMGQALVHGAKILQVDGNFDDCLTLARALSDNYPVALVNSVNPVRIEGQKTAAFEIVDMLGDAPDIHVLPVGNAGNITAYWKGYQEYAADGVSTKKPRMWGFQASGSAPIVRGEVVKDPSTIATAIRIGNPASWDFALAARDESGGAIDEVTDREILRAYRLLASQEGVFVEPASAASVAGLLKAAEQGKVDPGQRIVCTVTGNGLKDPDWAVAGAPQPVTVPVDAATAAERLGLV

SEQ ID NO: 75026 - protein, 561 aa, Nitrosomonas europaea ATCC 19718
MTTLKITGMTCDSCATHVKQALEKVPGVQSAVVSYAKGAAQLDLDPGTAPDALTAAVAGLGYKATLADAPPTDNRTGLLDKVRDWMGAADKGSDGEHPLQVAVIGSGGAAMAAALKAVEQGAKVTLIERGTIGGTCVNVGCVPSKIMIRAAHIAHLRRESPFDGGIPATAPAIDRSKLLAQQQARVDELRHAKYEGILDGNPAITVLHGEARFKDDQSLVVRLNAGGERVVVFDRCLVATGASPAVPPIPGLKESPYWTSTEALVSDIIPERLAVIGSSVVALELAQAFARLGSQVTILARSTLFFREDPAIGEAITAAFRAEGIKVLEHTQASQVAHVDGEFVLTTARGEIHADKLLVATGRTPNTRSLALEAAGVAVNAQGAIVIDKGMRTSAPHIYAAGDCTDQPQFVYVAAAAGTRAAINMTGGDATLDLTAMPAVVFTDPQVATVGYSEAEAHHDGIETDSRTLTLDNVPRALANFDTRGFIKLVIEEGSGRLIGVQAVAPEAGELIQTAALAIRNRMTAQELADQLFPYLTMVEGLKLAAQTFNKDVKQLSCCAG

SEQ ID NO: 75027 - protein, 122 aa, Glycine max
  misc_feature (96)..(96): Xaa can be any naturally occurring amino acid
APSLISTAAVTTVNRAGARMDAPFTGLKSMAGYPTRKTNHDITSIASNRGRVQCMQVWPPLGKKKMETLSYLPHLDDAQLATDVEYLLRNGGIPCXEFQLQHGIEYREHNRSPAYYNGRYWT

SEQ ID NO: 75028 - protein, 499 aa, Shewanella sp. MR-4
MTTQVKHYIDGEFTTGTGTSQIVVTNPANNEPIALINSATADEVHAAIASAKAAFKTWKEVPVSERARVMLRYQHLLKEHHDELATILAKETGKTFEDAKGDVWRGIEVAEHACNIASLLMGETVENVARSIDTYSYTQPLGVCAGITPFNFPAMIPLWMFPLAIACGNTFILKPSEQDPMTPQRLVELFVEAGAPKGVLQLVHGDKTAVDILLADPAVKAISFVGSVAVGQYIYKTGTDNLKRVQAFAGAKNHCVIMPDANKQQVINNLVGASVGAAGQRCMAISVAVFVGAAKEWIPELKEALAKVRPGLWDDKEAGYGPLISPAAKARVLKLIAQGKEEGAECLLDGSDFSVAGFESGNWVGPTMFTKVTTDMSIYKEEIFGPVLCCMESDSLEDAIELVNASPYGNGTSIFTASGAAARKYQHEIEVGQVGINVPIPVPLPFFSFTGWKGSFYGDQHAYGKQAVRFYTETKTITSRWFESDIAVAAGPNMSINLR

SEQ ID NO: 75029 - protein, 195 aa, Clostridium perfringens ATCC 13124
MASLLLIGCGGKGKKAKENIPEDKLPIATIEVKNFGTIEAELYPNKAPNTVDNFISLANSGFYDGLTIHRIVKGFVLQGGDPKGTGTGGPGYMIKGEFSSNGVENDIKHEEGILSMARSQNPDSAGSQFFIVTKEAPHLDGQYAAFGKVTKGLDVVHEIEKVSVGANDKPVEDVVIESIKVDTKGIEYNEPEKVK

SEQ ID NO: 75030 - protein, 399 aa, Clostridium perfringens ATCC 13124
MKKFNLVEEAIEDIKNGKMVIVIDDEGRENEGDLVMAGELVTGEKINFMATYGKGLICAPVSERIAENLGLNPMVLNNTDNHETAFTVSIDYKDTTTGISAFERAHTIKELINEESKAEDFRRPGHVFPLIAKNGGVLKRAGHTEAAIDLAKLAGLKEVGVICEIMKDDGTMARTDELLEFANSHNMKIITIEDLIAYRTERDNFVYRVVETNMPTKYGEFKAIGFIDKLTGEHHVALVKGEIKSEEPVLLRVHSECLTGDVFGSRRCDCGEQFHRAMEKINEEGKGILLYMRQEGRGIGLINKLKAYKLQDEGLDTVEANIALGFPEDLRDYGVGAQILKELSVREIRLMTNNPKKITGLEGYGLKIVERVPIEIKCNEENEFYLKTKKEKMHHLIMQ

SEQ ID NO: 75031 - protein, 420 aa, Fulvimarina pelagi HTCC2506
MSIDTIPDERTRDVVRYDVEAVRRDFPILSKEVYGKPLVYLDNGASAQKPRQVIDRITHAYENEYANVHRGLHFLSNAATDAYEASREAVRRFLNAGSSDEVVFTRSATEAINLVAYGYGMQEIGEGDEIVLTQAEHHSNIVPWHFLREKKGAKLIWVPVEDDGSIPVESFEKAITPRTKLVATTHMSNVLGTVVDVEAVTRLAHSKDIPVLVDGSQGAVHLPVDVADIGCDWYVFTGHKVYGPSGIGVLYGKREMLEQMQPFNGGGEMIVEVTEEGVTYNAPPHRFEAGTPPIVQAIGLGAALEYVDRVGREAIAVHEAELGAYAHQRLKQINSLRIYGEAPGKGAIVSFDIEGIHAHDISMVIDREGIAVRAGTHCAMPLLKRFGTTSTCRASFGMYNTMAEVDKLAEALEKARRFFA

SEQ ID NO: 75032 - protein, 519 aa, Zea mays
MDTSNAFAVVTLLLLPLLLALAQLVRRGSPQYPPGPMALPVIGHLHLHLFERPLHRTLACLAARHGTVFQLWFGSRRVIVVSSADAAKECLATLDVAFANRPRLPSGRILSYDWTTMGTSNYGPYWRRVRRITVTHILSVHWVQQFADVHERETRAMVRGLYRPTARNGVRRARVELKSRLFELLMNAMMGMVCAKRYYGCDGKENETEAEVSEEARWFREMVEETMELSGASTVWDFLPAWARWLDVGGVGRRLWRLRESRTKFLQGLIEEQRKEMENGPQPQARKTMIGVLLTLQNEDPDACPDNLIRTMCISSLEAGTSTSADAVEWAMSLLLNNPGALAKAQEEIDACVGQPARLIEAADLPKLQYLWCIIMETLRLYPPTPLLLPHESANDCTVSGFHVPMGTMLLVNTFAIHRDPEIWDRPGSFMPERFLGENSEGKMFNPFGMGRRRCPGENLGTQMVGLALGTMIQCFNWERVGDDLVDMTEGAGLTIPKKVPLEAFYEPRASMANLLSKI

SEQ ID NO: 75033 - protein, 495 aa, Symbiobacterium thermophilum IAM 14863
MQGARATVAGEKQLSLNLAQRIGLVLGPTLCLLIYLFFRPAGLGPEGVAALAGTAWIAAWWVTEAIPIPITSLLPVILFPVLGLGSVGEVVSAYADPTLFLFLGGFIIAVAIERWNLHRRIALAVISAVGTSPSRLVLGFMLATGVLSAFISNSATAMMMLPIGIAVVKQITELRVRNGEKVYPDQEPFSALILLAIAYAASIGGVGSIIGSPPNAIMVGVAASTLGVEISFFDYMLVGVPMFLVFTLVAWRILLWVMPPGFAEVAGSREWVRRQMAELGPMSGEERKVLGVFCATALLWITYPFLLKGVVPGISDAMVAIFGASLLFLIPGGEGGFLLDESALKELPWGVLLLFGAGFCIAEVFQSTGVAVWLAGFLQVLAGAPYFLIVIAVAAMVTFLTEITSNTAIAAIFMPIMASLATALGAAPTGLMVVAALAGSLAFMLPVGTPPNAIVFSSGRVTIRQMIRVGFFLNLAAIATITLIGCFWVPLVWGR

SEQ ID NO: 75034 - protein, 397 aa, Clostridium perfringens ATCC 13124
MILSRKAQNIGASLTLALTAKAGELKKEGIDVVSFGVGEPDFNTPKNIIEAATRAMEEGNTKYTATSGIVELKEVIAKKLHDDNGLNYGTKNIIISTGAKQSLANVFMAILNPGDEVIIPVPYWVSYPELVKLSDGVPVFIETKKENDFKVTYDELKSVLSKNTKAIVINSPNNPTGTVYSKKDLEVIAKFAEENDLIIISDEIYEKLIYGKEEHISIASLSEDAFKRTVVINGFSKAYAMTGWRIGYAACYNEELIKVMNNVQSHMTSNTNSIAQFAALEALNGDQETIKNMVKEFSLRRELMIELISEIEDLTFIEPKGAFYVMIDVSKVLKKANIKGSMEFANLLLKEENVVVIPGIAFGEDNFIRLSYATSKEEIIKGLKRIKEFVNKLMNRD

SEQ ID NO: 75035 - protein, 453 aa, Vitis vinifera
MASHAALASSRIPTTNTRHPSKASHSFPTQFFAKRLEVAEFSGLRSGGCVTFAKNAREPSFFDVVASQLTPKAGGPAPVRGETVAKLKVAINGFGRIGRNFLRCWHGRKDSPLDVIVVNDSGGVKNASHLLKYDSMLGTFKAEVKIVDNETISVDGKPIKVVSSRDPLKLPWAELGIDIVIEGTGVFVDGPGAGKHIQAGAKKVIITAPAKGADIPTYVVGVNEGDYSHEVSNIVSNASCTTNCLAPFVKILDEELGIVKGTMTTTHSYTGDQRLLDASHRDLRRARAAALNIVPTSTGAAKAVSLVLPQLKGKLNGIALRVPTPNVSVVDLVVNVEKKGITAEDVNAAFRKAADGPLKGILAVCDVPLVSVDFKCSDVSSTIDASLTMVMGDDMVKVVAWYDNEWGYSQRVVDLAHLVAAKWPGFAAEGSGDPLEDFCKTNPADEECKVYEA

SEQ ID NO: 75036 - protein, 305 aa, Zea mays
  misc_feature (296)..(296): Xaa can be any naturally occurring amino acid
ACIDLCARAWYRCTAAAGDDVKKPDCVPGMDPRSFPGTGGGHGITPVTPSHGGSSSPTPSHGGGGGYVPTPSHGGTLPFPSHGGSGSGSSPTSPSTGGGSYGGSPSTPGGGAYGGSPPSTPSGGGAYGGSPSTPSGGGAYGGGSPSPAHGAGGAYGSSPTPAYGDSPLHGGIGTSSPTTFVPMDPHSFGTCDYWRSHPMEIWSAVGGRFPSTSSSMGHFFGAAAGSVGGADVMSIQDAVGNTRADGTGALLREGAAALLNSMTRAGFPYTTEQVRDAFAAAAAAGSDGAAAAQAAXFRKANEGKA

SEQ ID NO: 75037 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLPLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCDPRIYPDFTWPMLLEFTQKHYRADMKTLEVFTNWLHQRSFS

SEQ ID NO: 75038 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGVYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 75039 - protein, 519 aa, Oryza sativa
MGDMVLLATRQGVVCHRHRLPVISCATNTKPSRLKLPPGPSTLPLIGSIHHFVSSSESVHSVMRRLAREHGPVMQLWFGEVPTVVASSPEAAQEILRSKDLAFADRHLTSGTDAFSFGGRDVALAPYGERWRHLRRLLTQELLTAARVRSFQRIREEEVARLVRDVSAAAAAAPGTAVNLTEMITRLINDIVLRCSVGSRSKYSDEYLAALNDMVGQTFSLSVADLFPSSKLASMVATAPRRALETRNKMERVIQQIIQERRDQIEADMASGDQVTAAAGSKSCSLDVLLRLQKEGGAPMPITNDVIVVLLMDIFAGGTDTSSTTLPWTMAELIRSPRVMAKAQAEVRQAFEGKNTITEDDLAQLSYLKMVIKESLRLHCPAPLLAPRKCRETCTIMGYDVPKGTSVFVNAWAICRDSKYWEDAEEFKPERFENNNIEYKGSNFEFLPFGSGHRICPGINLGLANMEFALANLLYHFDWKLPNGMLHKDLDMREAPGLIAAKHTSLNVCPVTHIAPSCS

SEQ ID NO: 75040 - protein, 430 aa, Thiomicrospira crunogena XCL-2
MTHWQALLQFDQEHIWHPYAKMPSDTPAIGVAKTQGSIITLSDGNELVDGMSSWWAALHGYNHPVIQKAMIDQIETMPHIMFGGLTHEPAIELAKRLIKLTPPPLQKVFFTDSGSVAMEVAIKMAMQYWISLEQPQKNKLLALKNGYHGDTFATMSICDPDNGMHRLFNSTLPQHFFAPAPQKGFDIDSDNQDIAEFETLLEKHHAEIAAVTLEPIVQGAGGMRFYRPDYLRQVRELCDEFNVLLIADEIATGFGRTGKLFACEWANISPDIMALGKTLTGGNITLAATLATEKISDTISQGNPGLLMHGPTFMANPLACRAASANIDVLLNSPWQDNIQRIESHFLNELMPLNALPGVDDTRVLGAIGVIELERNDLGETIQNLAVQNGVWIRPFGKLIYTMPAYNIPTNQLTQLTEGLKTAIVQALQH

SEQ ID NO: 75041 - protein, 438 aa, Oryza sativa Japonica Group
MEKERKMEGERRVEATRRWVIAVGFWVQGFRLFPWLGVNFFLKDGMGVAASSLQILQASANLPMVAKPLLGLLSDAVPIRGHRRLPYVAIGALLQAISWLAIALWPAISLPVLTIFLLLSNFGASICEVANDAIVAEAGKQATLSSGSGQLQSFAWMFGSSAGALGNLVGGIALSYFSPKIMFLFFAILLVLQFCTTVAIPESSLQLPKADTNLSAVSSVRKQIKELSYALCMPEIFWSVIWFSLSYAAIPFLLGTMFFYQTEVLRLDSSVIGLSKVFGQVTLLAWSVAYNKYFKTTPAQKVLSVLQFLTALVMLSDVLFVQGIYRNFGIPDSMYTIVFSGLLEGLMLFKVLPFSVLVAKLCPSGCEGSLMAFVMSALALATIISGYLGVALAEFMGVSGGDFSALPTCLLIEAACTMLPLFFSSLIKERREKEKKEE

SEQ ID NO: 75042 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFRNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 75043 - protein, 310 aa, Staphylococcus gallinarum
GFGRIGRLAFRRIQNVEGIDVVAVNDLTDDEMLAHLLKYDTMQGRFTGEVEVEKDGFRVNGQEVKSFSEPDPSKLPWGDLDIDVVLECTGFFADKTKAEAHINAGAKKVLISAPATGDLKTIVFNTNHNELDGTETVVSGASCTTNSLAPVAKVLNDDFGLVEGLMTTIHAYTGDQNTQDAPHAKGDKRRARAAAENIIPNSTGAAKAIGKVIPEIDGKLDGGAQRVPVATGSLTELTVVLEKDVSVEDVNNAMKNASNESFGYTEDEIVSSDVVGITYGSLFDATQTRVMTVGDRQLVKVAAWYDNEMS

SEQ ID NO: 75044 - protein, 573 aa, Nitrosomonas europaea ATCC 19718
MANTLPPTDRSCDISQPLERLSPDESLKAESDYLRGTIALGLLDRITSAVPGNDIKLMKFHGIYEQDDREIRDERRRQKLEPAFQFMIRVRLPGGICTTERWLKISELACAHGNETLRMTTRQTFQFHWVLKQNIVPLIRGLHEVLLDTVAACGDDSRGVMATVNPQFPALQAELAALAKTVSDHVIPKTRAYHEIWYGEERIASSEPEEPFYGQTYMPRKFKIGFVIPPNNDIDIYAQDLGYIAIIGENGKIAGFNVAIGGGMGRTDKAPHTYPRTASVIGFITPDRLISVTEAVMGVQRDYGNRADRSRARFKYTIDDKGLDWIKLAIEDRAGPLESARPYDFTSNADIYGWIESGDGFHHFTLFIENGRLNRDMLDKIAQIAHVHKGHFRLTPNQNLMIANVATADKPEIEALLRETGLIAFNERSVLRLNSMACVALPTCGLAMADSERYLPDLITKIEGILTRYNLQNEPITLRMTGCPNGCSRPFIAEIGLTGRAPGKYNLYLGGGFHGQRLNRLYRENIGEPAILETLNEVLGRYATERLPDEHFGDFTIRAGIIREVTEGRFSND

SEQ ID NO: 75045 - protein, 119 aa, Triticum aestivum
YYRGTKLSPAKMSTVTRAYLDQRLALANRCSREAAMAGAKAAAVATVAAAVPTCLCLQLASVRMLPWARAHLNPTGQALIISTIAGMAYFIVADKTILSMARKHSFDDAPDHLKNTSFN

SEQ ID NO: 75046 - protein, 310 aa, Staphylococcus haemolyticus
GFGRIGRLAFRRIQDVEGIEVVAVNDLTDDEMLAHLLKYDTMQGRFTGEVEVVDGGFRVNGKEVKSYEEPDASKLPWGDLDIDVVLECTGFYTDKEKAEAHINAGAKKVLISAPAKGDVKTIVFNTNHNDLDGSETVVSGASCTTNSLAPVAKVLSDEFGLVEGLMTTIHAYTGDQMTQDGPHKKGDKRRARAAAQNIVPNSTGAAKAIGKVIPEIDGKLDGGAQRVPVATGSLTEVTVVLEKDVTVEDVNKAMKNASNESFGYTEDEIVSSDVVGMTYGSLFDATQTRVMSVGDRQLVKVAAWYDNEMS

SEQ ID NO: 75047 - protein, 274 aa, Saccharomyces cerevisiae
LADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDL

SEQ ID NO: 75048 - protein, 310 aa, Staphylococcus hominis
GFGRIGRLAFRRIQDVEGIEVVAVNDLTDDEMLAHLLKYDTMQGRFNGDVEVVEGGFRVNGKEVKSFEEPDASKLPWGDLDIDVVLECTGFYTEKEKAEAHINAGAKKVLISAPAKGDVKTIVFNTNHKDLDGSETVVSGASCTTNSLAPVAKVLNDEFGIVEGLMTTIHAYTGDQMTQDGPHRKGDKRRARAAAQNIVPNSTGAAKAIGKVIPEIDGKLDGGAQRVPVATGSLTEVTVVLEKEVTVEDVNKAMKNAADESFGYTEDEIVSSDIVGMNFGSLFDATQTRVISVGDKQLVKVAAWYDNEMS

SEQ ID NO: 75049 - protein, 551 aa, Vibrio fischeri ES114
MFGQRFDNINLKGDLFGGVTTAIISLPLALAFGVASGAGAEAGLWGAIMVGLFASLFGGSSTLISEPTGPMTVIMTAVLTSMVAKYPETGMAMTFTVVMMAGAFQILLGTLKLGKYITLMPYSVISGFMSGIGVILIILQLSPLLGHAAPPGGVIGTLSALPDTLSNLDIKELFLGGLTLGVLFLFPDKYRKYVPAQLVALVAVTLLSVLFFDMESIRRIGEIPAGLPSLVIPTINFEMFTTMVIDALVLGTLGCIDTLLTAVIGDSLTRKEHDSDKELRGQGLANMISGLFGALPGAGATMGTVTNIQVGARSPLSGVFRAAVLALVVLVAGGLTEPIPMAVLAGIAVYVGFNILDWSFIQRAHKVSFAGMAIMYGVMLLTVFVDLIVAVGLGVFISNIIIIERLSREQARQVKAISDADEDDVPLTDSERALLDKANGKVLFFYLSGPMIFSVSKAISRQHSSISDYEVMILDLTDVPMIDVTVGLALENAINDALDANCKVYLLCPNEQTKEQLDKFHVTDLIPSENTYKFRYEALKSAIKYVSPSED

SEQ ID NO: 75050 - protein, 302 aa, Shewanella sp. MR-4
MKQHQIRKAVIPVAGLGTRMLPATKAIPKEMLPVVDKPLIQYVVSEAIDAGIKEIVLVTHASKNSIENHFDTSFELEAQLERRVKRQLLEAVQSICPKDVTVISVRQSQAKGLGHAILCAKSVVGDAPFAVLLPDVIIDDASCDLKTDNLAAMVNLFDETQVGQIMVEGVPHHLVNQYGIADVNGHDLQPGESEPLVELVEKPPVDEAPSNLAVVGRYVLPAAIWPLLAKTPAGAGDEIQLTDAIAMLMKQETVNAYYMQGKSHDCGNKQGYMRANVEYALRHSEIGEDFAHYLKTVVKGIK

SEQ ID NO: 75051 - protein, 337 aa, Shewanella sp. MR-4
MTILVTGGAGYIGTHTVVELLNAGSEVIVLDNLSNSSIEALNRVERITGKAVTFYQGDILNKALLQKVFSDHNIDAVIHFAGLKAVGESVAKPLKYYENNVTGTLILCQVMAEFKVKNLVFSSSATVYGDPASLPITEDFPTGATNPYGQSKLMVEHILADLHHSDPSWNIARLRYFNPVGAHASGLIGEDPNDIPNNLMPFIAQVAVGKRKALSVFGNDYPTHDGTGVRDYIHVVDLALGHLKALEKLATKPGLVTYNLGTGQGYSVLDMVKAFEKACGKSIAYQIAPRRPGDIAACYANPDHAKTDLGWQATHSLEDMANSSWHWQSTNPNGYKG

SEQ ID NO: 75052 - protein, 127 aa, Pichia pastoris
MTNWKAILTPAQYQVLRLGGTERPYTGQYVNFKKNGTYLCSGCQTPLYKSGTKFDSSCGWPAFYEALPGAVKRIEDNSLGMRRIEIRCSKCDGHLGHVFEGEGFDTPTDSRHCVNSISLKFQGEEEN

SEQ ID NO: 75053 - protein, 273 aa, Clostridium perfringens ATCC 13124
MDKIIIKDFEVFGNHGVFEEEKRLGQKFVLSIELFLDTREAGVTGDLSKSVHYGELAHKVEEEFKKQSYDLIETAAEKLCEFILLEYPLVKKVKVSLKKPWAPILRSLDTVSIEIERGWNEAYLSYGSNIGDKKYYIEEALNEINKAYHTEIIKKSNLIETEPWGYTEQDEFLNGACKIKTLLNPKELIKFLLSVEQKLKRERKIKWGPRTIDLDVIFFNDLISEDEEIILPHPRMHERSFVLEPLNEIAPYKIHPLYRKRVFELLEELNKNK

SEQ ID NO: 75054 - protein, 148 aa, Brassica napus
MPMTIAVTPSRQTDRSASPFATAAKTVTPVAVVSDGQGKDALISWFRGEFAAANAIIDAVCSHLREAVPGSEYDAVFAAIHRRRLNWIPVLQMQKYHSIAEVAIELQKLEAKKAGDLVGEMKTETAEDLKQSRTETGEMKSVCFNGEK

SEQ ID NO: 75055 - protein, 270 aa, Symbiobacterium thermophilum IAM 14863
MAIGFIGMGNMGRLLVTALVRAGALQPDEVLIYSRSPEKRRRVTAALPGVQEAYGGGDLARRAGVVFLCVKPPETAGVLEEIGPYITADHLLVTINNTVTLAMLEARTPARAAKVIPSVVHAVRRGVSLLVFGGRCTHRDRALLMRLMGAVSRPFVVPEEAVRTASDLTACGPAFLSLVLHAMAEAARGKAPALSREAVMAMVRETARATCELMEQTGYDFADVAARVATPGGVAAAGVDALHPRLDGFWEAVLAATAAHEAAKRAQLVL

SEQ ID NO: 75056 - protein, 475 aa, Vibrio fischeri ES114
MSKQVKAQVVVLGSGPAGYSAAFRCADLGLETVLIERYSTLGGVCLNVGCIPSKALLHVSKVIEEAKAMAEHGVVFGEPQTDINKIRIWKDKVVTQLTGGLGGMAKMRNVTVVNGYGKFTGPNTIEVEGEENTTVTFDNAIIAAGSRPIKLPFIPHEDPRIWDSTDALELKEVPEKLLIMGGGIIGLEMGTVYHSLGSKVEVVEMFDQVIPAADKDIVKVYTKRIKDKFKLMLETKVTAVEAKEDGIYVSMEGKKAPAEAERYDAVLVAIGRVPNGKLIDAEKAGIEVDERGFINVDKQMRTNVAHIHAIGDVVGQPMLAHKGVHEGHVAAEVISGKKHYFDPKVIPSIAYTEPEVAWVGKTEKEAKEEGLNFEVATFPWAASGRAIASDCADGMTKLIFDKETHRVIGGAIVGTNGGELLGEIGLAIEMGCDAEDIALTIHAHPTLHESVGLAAEVFEGSITDLPNKKAVKKKK

SEQ ID NO: 75057 - protein, 628 aa, Vibrio fischeri ES114
MTIEINVPDIGADEVEVTEILVKVGDRVEEEQSLITVEGDKASMEVPASQAGIVKEIKIAEGDSVTTGSLIMIFEAEGAAEAPAAPAVEAAPVAAPAAASVAELKEVHVPDIGGDEVEVTEIMVAVGDTVEEEQSLLTVEGDKASMEVPAPFAGTVKEIKIASGDSVSTGSLVMIFEVAGSAPAAPEVEAAAPVAAAPAASAEKEVNVPDIGGDEVEVTEIMVAVGDTVEEEQSLITVEGDKASMEVPAPFAGTVKEIKIAAGDKVSTGSLIMTFVVEGTAPAAPQAAAAPAAQAAPAAAPVATASAPASTGEFEANNDYAHASPVVRRLAREFGVNLAKVKGTGRKNRILKEDVQGFVKDALKRLESGAAASGKGGDGSALGLLPWPKVDFSKFGETEVQKLSKIKKISGANLHRNWVMIPHVTQWDNADITELEAFRKEQNAIEAKNDTGMKITPLVFIMKAVAKALEAFPAFNSSLSEDGESIILKKYVNVGIAVDTPNGLVVPVFKDVNKKGIYELSEELMAVSKKARAGKLTASDMQGGCFTISSLGGIGGTAFTPIVNAPEVGILGVSKSEIKPVWNGKEFAPRLQLPLSLSYDHRVIDGAEGARFITFLNSALSDIRRLVL

SEQ ID NO: 75058 - protein, 476 aa, Glycine max
MKKENSVMLKAGELPGRLTRARAAAALRAYGQLPPLKERAQQNQNQLSRVNSKRAVSDNTCVQRKRKAVLQEVTNVCCENAYKACLNSTNIQARKSKLAKAGQINVSKVAPSVTVEPRQFQVDSKAKETALQSEDTMCSINLENNELLQLNANDCSKDFRLPESQMSGISAHPLISQKKDTKDNLPKLLTALKDSDITNIDDDDLEDPQSCSLYAADIYDTIRVAELARRPYPNFMETVQRDITQSMRGILVDWLVEVSEEYKLVTDTLYLTVYLIDWFLSKNYIERQRLQLLGITCMLIASKYEEINAPRIEDFCFITDNTYTKAEVLKMESQVLKSSEYQLYTPTIQTFLRRFLRAAQASYKDQSLELECLANYLAELTLMDYGFLNFLPSIIAASAVFLARWTLDQSNHPWNPTLQHYACYKASDLKTTVLALQDLQLNTDGCSLTAVRTKYRQDNFKCVAALSSPKLLETLF

SEQ ID NO: 75059 - protein, 147 aa, Oryza sativa Japonica Group
MYQAIPYSSTRPWLRPEPAASVVDVVKVETTTAVAGRGGEAEVVGEEEAAEVRRAVAESPVLVVGRRGCCLIHVVKRLLQGLGVNPAVHEVAGEAALKGVVPAGGEAAALPAVFVGGKLLGGLDRLMAVHISGELVPILKKAGALWL

SEQ ID NO: 75060 - protein, 339 aa, Escherichia coli
MVIFVTGGAGYIGSHTILELLNNGHDVVSIDNFVNSSIESLKRVEQITNKKIISYQGDIRDKNLLDEIFSRHHIDAVIHFASLKSVGESKLKPLEYYSNNVGGTLVLLECMKRYNINKMIFSSSATVYGNNSIPPHTEDRRIGETTNPYGTSKFIIEIILSDYCDSDNNKSVIALRYFNPIGAHKSGMIGENPNGIPNNLVPYISKVAQNQLPVLNIYGNDYPTKDGTGVRDYIHVCDLAKGHVKALEYMFLNDVNYEAFNLGTGQGYSVLEIVKMFEIVTKKSIPVAICNRREGDVAESWASADLAHKKLSWKAEKKLKEMIEDVWRWQTNNPNGYKK

SEQ ID NO: 75061 - protein, 827 aa, Oryza sativa Japonica Group
MEAATANIFHLSLTFFFMVLLTLGTSAAGVASDTLSNGRNLTDGNTLVSAGGSFTLGFFSLGLPNRRYLAIWFSESADAVWVANRDSPLNDTAGVLVNNGAGGLVLLDGSGRAAWSSNTTGKSSSATAAQLLESGNLVVRERDQLNTGVFIWQSFDHPSNTLIAGMRLGNNRQTGDAWFLSSWRAHDDPATGDCRRVLDTRGLPDCVTWCGGAKKYRTGPWNGQWFSGVPEMASYESIFSSQVVVTPDEIAYVFTAAAAAGSPFSRLVLDEAGVTERLVWDPSSKVWIPYMKAPRGVCDDYAKCGAFGLCNEDTASTLFCSCMAGFSPVSPSRWSMRDTSGGCRRNAPLECGNGSTTDGFVPVRGVKLPDTDNATVDTGATLDECRARCLANCSCVAYAAADISGRGCVMWIGDMVDVRYVDKGQDLHVRLAKSELVNNKKRTVVKIMLPLTAACLLLLMSIFLVWLYKCRVLSGKRHQNKVVQKRGILGYLSASNELGDENLELPFVSFGEIAAATNNFSDDNMLGQGGFGKVYKGMLDDGKEVAIKRLSKGSGQGAEEFRNEVVLIAKLQHRNLVRLLGYCIYGDEKLLIYEYLPNKSLDAFIFDHANKYVLDWPTRFKIIKGVARGLLYLHQDSRLTVIHRDLKPSNILLDVDMSPKISDFGMARIFGGNQHEANTNRVVGTYGYMSPEYAMDGAFSVKSDTYSFGVILLEIVSCLKISLPRLTDFPNLLAYAWNLWKNDRAMDLMDSSISKSCSPTEVLLCIQIGLLCVQDNPNNRPLMSSVVSMLENETTTLSAPIQPVYFAHRAFEGRQTGENSISLLEGR

SEQ ID NO: 75062 - protein, 326 aa, Nicotiana attenuata
ISKNGLFQSVSAAMWRTRAPDDSRSTTNGDSARGETAESEKDPDLVVQSKPPEQITMPKSEQKEEEPAKKEEGPEKPKKPVQMKRVGSAGLRTDSVLQKKTGNLKEFFSIGKKLGQGQFGTTFKCVEKATGKEYACKSIAKRKLLTDDDVEDVRREIQIMHHLAGHPNVISIKGAYEDAVAVHVVMEYCAGGELFDRIIQRGHYTERKAAELTRTIVGVLETCHSLGVMHRDLKPENFLFVNQKEDSLLKTIGFGLSIFFKPGDRFNDVVGSPYYVAPEVLKKRYGPEADVWSAGVIVYILLSGVPPFWAENEQGIFEEVLHGDLD

SEQ ID NO: 75063 - protein, 482 aa, Escherichia coli
MSDVPLIAVVMAGGTGSRLWPLSREHYPKQFLQLSGENTLLQSTLLRLSPLSCETPLVITNEQHRFVVAEQLRQINQLSDNIILEPCGRNTAPAIALSAFTALKRNEQQDPILLVLAADHVINKTDVFCNAIKNSISIVEQGNILTFGIIPDYAETGYGYIEKGSIVKESQRGVGNTFYHVEQFVEKPNRSRAEEYISSGKYLWNSGMFMFKASVYLEELKKYRPDIYDICEKTVSSSYHDLDFIRLSKDVFQNCPSESIDFAVMEKTKRCIVYPVDIGWNDVGSWQSLWDVSDKTPTGDVCKGDILTYNTKNNYIHSESALVAAVGVEDIVIVQTKDAILVSKKSEVQDVKKIVQMLKMQERSEYLSHREEFRPWGKFDAIEQGDRYKVKKIVVKPGEGLSLRMHHHRSEHWIVLSGTAKVTLNNKTFLVTANESVYIPLGATYSLENPGVIPLNLIEVSSGDYLGEDDIVRQKERYKIDD

SEQ ID NO: 75064 - protein, 402 aa, Rickettsiella grylli
MKTQPPNINSALEDLRLGKMVILFDHENRENEGDLVLAAEKVTPRAINFMAQHARGLICLALAEEDIKRLQIPMMVENATNPFNTAFTASIEAAKGVTTGISAADRAHTIHVAIDPKSGPQDIVMPGHIFPIRARKGGVLARMGQTEGSTDLVRLAGLNSAAVICEIMNPDGSMARFPDLERFAKQHQITLLSIRDLIQYRLQTESLVKEIASIHLPTKDYGDLTIKLFESQLDKHHHLAIIKEKIKKSYHPTLVRIHSECFTGDLFGSTRCDCGWQLHESLTQISEHGGALLYLRQEGRGIGLLNKLKAYALQDQGFDTVEANQKLGFGSDDRNYWIGAQILQRLKILKIKLLTNNPQKIIDLKQYGIEITERVPLIATPSPTNLTYLKTKQSKLGHLLNL

SEQ ID NO: 75065 - protein, 161 aa, Fragaria x ananassa
NLFGVAIGYTIASSISMVAIKRSNCFHSSDGKDECHVNSNPYMIAFGIAEIIFSQIENFDQLWWLSIVAAVMSFTYSTIGLGLGIGKVVETGTIRGSMTGVDIGTVTEAQKIWRSFQALGDIAFAYSYSLILIEIQDTVESHHREAKTMRKHSNQCAPHPF

SEQ ID NO: 75066 - protein, 313 aa, Nicotiana attenuata
NSNTPSTTTTNVNVHHNRPSTTTTTTTVTSRKQEGSNYNREKGNINTKNSHQKQQPRSSQQNVVVKPNSRRQSGGVIPCGKRTDFGYDKDFDKRYTIGKLLGHGQFGYTYVATDKSSGDRVAVKKIEKNKMVLPIAVEDVKREVKILKALAGHENVVQFYNSFEDDNYVYIVMELCEGGELLDRILSKKDSRYTEKDAAIVVRQMLKVAAECHLHGLVHRDMKPENFLFKSSKMDSPLKATDFGLSDFIRPGKKFQDIVGSAYYVAPEVLKRRSGPESDVWSIGVITYILLCGRRPFWDKTEDGIFKEVLRNK

SEQ ID NO: 75067 - protein, 266 aa, Nicotiana attenuata
DLGRELGRGEFGVTYLCTEVDTGDKYACKSISKKKLRTAVDIDDVRREVEIMKHLPKHPNIVTLKDTYEDDNAVHIVMELCEGGELFDRIVARGHYTERAAAGILRTVVEVVQMCHRHGVMHRDLKPENFLFGNKKETAPLKAIDFGLSVFFKPGERFNEIVGSPYYMAPEVLKRNYGPEVDVWSAGVILYILLCGVPPFWAETERGVAQAIIRSVIDFKRDPWPKVSDNAKDLVKKMLDPDPSRRLTAARVLEHPWLQNIKKAPN

SEQ ID NO: 75068 - protein, 446 aa, Yersinia pseudotuberculosis IP 32953
MSESPALDHALKSIENIHLARVAGRLVRVTGLLLESVGCRLAIGQRCRIESVDETFIEAQVVGFDRDITYLMPFKHPGGVLGGARVFPSEQDGELLIGDSWLGRVINGLGEPIDGKGQLGGSTPLQQQLPQIHPLQRRAVDTPLDVGVNAINGLLTIGKGQRVGLMAGSGVGKSVLLGMITRYTQADVVVVGLIGERGREVKEFIEHSLQAAGMAKSVVVAAPADESPLMRIKATELCHSIATYYRDKGHDVLLLVDSLTRYAMAQREIALSLGEPPATKGYPPSAFSIIPRLAESAGNSSGNGTMTAIYTVLAEGDDQQDPIVDCARAVLDGHIVLSRKLAEAGHYPAIDISQSISRCMSQVIGSQQAKAASLLKQCYADYMAIKPLIPLGGYVAGADPMADQAVHYYPAITQFLRQEVGHPALFSASVEQLTGMFPSFAPTDEA

SEQ ID NO: 75069 - protein, 441 aa, Escherichia coli
MGLARFGRLIEYIPVSVTLGFTSGIGITIGTMQIKDFLGLQMAHVPEHYLQKVGALFMALPTINVGDAAIGIVTLGILVFWPRLGIRLPGHLPALLAGCAVMGIVNLLGGHVATIGSQFHYVLADGSQGNGIPQLLPQLVLPWDLPNSEFTLTWDSIRTLLPAAFSMAMLGAIESLLCAVVLDGMTGTKHKANSELVGQGLGNIIAPFFGGITATAAIARSAANVRAGATSPISAVIHSILVILALLVLAPLLSWLPLSAMAALLLMVAWNMSEAHKVVDLLRHAPKDDIIVMLLCMSLTVLFDMVIAISVGIVLASLLFMRRIARMTRLAPVVVDVPDDVLVLRVIGPLFFAAAEGLFTDLESRLEGKRIVILKWDAVPVLDAGGLDAFQRFVKRLPEGCELRVCNVEFQPLRTMARAGIQPIPGRLAFFPNRRAAMADL

SEQ ID NO: 75070 - protein, 123 aa, Thiomicrospira crunogena XCL-2
MAITKDDILEAVANMSVMEVVELVEAMEEKFGVSAAAVAVAGPAGDAGAAGEEQTEFDVVLTGAGDNKVAAIKAVRGATGLGLKEAKSAVESAPFTLKEGVSKEEAETLANELKEAGIEVEVK

SEQ ID NO: 75071 - protein, 380 aa, Gibberella zeae PH-1
MDSAARQQPQVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYFESDAADLVRATLSAVAYLHDHGIVHRDLKPENLLFRTPEDNADLLIADFGLSRIMDEEQFHVLTTTCGTPGYMAPEIFKKTGHGKPVDLWALGVITYFLLCGYTPFDRDSDFEEMQAILNADYSFTPIEYWRGVSAHAKDFIQRCLTIDSTKRITAHEALQHPFVAGFINAEGESQNLLPNIKKNFNARRTLHAAIDTVRAINKLREAQSGLMDGARSKEPSRGAAQQTPTNRKHPTSHPRCNPATTEIELSKLPKVSGAQRRAVRIR

SEQ ID NO: 75072 - protein, 126 aa, Magnetospirillum magnetotacticum MS-1
MTDRILVHRIAVFARHGLLPEEERLGQRFYISLDCRLDLSEAGRSDDVAATVSYADLTQIVLDIATNRRFALIEALAEAIASACLSHSPRLDTVTVRIDKPSAPIPAVLDYAAIEIVRGRATTERT

SEQ ID NO: 75073 - protein, 530 aa, Cucumis sativus
MGDVEGSPGSSMHGVTGREQTFAFSVASPIVPTDTTAKFALPVDSEHKAKVFRIWSLANPHMRTFHLSWVSFFTCFVSTFAAAPLVPIIRDNLNLTKVDIGNAGVTSVSGSIFSRLVMGAVCDLLGPRYGCAFLIMLSAPTVFCMSFVSDAAGYIAVRFMIGFSLATFVSCQYWMSTMFNSQIIGLVNGTAAGWGNMGGGATQLIMPLLYEVIQRAGATPFTAWRIAFFIPGFLHVLMGILVLTLGQDLPDGNLASLQKKGNVAKDKFSNVLWYAVTNYRTWIFVLLYGYSMGVELSTDNVIAEYFYDRFDLKLHTAGIIAATFGMANLVARPFGGYASDVAARYFGMRGRLWALWILQTFGGVFCMWLGKATKLPIAIAAMILFSIGAQAACGATFGIIPFISRRSLGIISGLTGAGGNFGSGLTQLVFFSTTKYSTDTGLFLMGIMIVCCTLPVTLVHFPQWGSMFLPPTKHVEKSTEEFYYGSEWTEDEKKKGLHQQSIKFAENSRSERGRRVASAPTPPNTTPSRV

SEQ ID NO: 75074 - protein, 310 aa, Staphylococcus kloosii
GFGRIGRLAFRRIQNVDGIDVVAVNDLTDDEMLAHLLKYDTMQGRFTGEVEVEENGFRVNGQEVKSFSEPDPSKLPWGDLDIDVVLECTGLFADKDKASAHIDAGAKKVLISAPATGDLKTIVYNTNHNELDGSESVVSGASCTTNSLAPVAKVLNDEFSLVEGLMTTIHAYTGDQSTQDAPHRKGDKRRARAAAENIIPNSTGAAKAIGLVIPEIDGKLDGGAQRVPVATGSLTELTVVLEKDVSVEDVNNAMKNASNESFGYTEDEIVSSDVIGMTYGSLFDATQTRVMTVGDRQLVKVAAWYDNEMS

SEQ ID NO: 75075 - protein, 255 aa, Desulfitobacterium hafniense DCB-2
MQHKFSRTELLIGKSALAKLSQSTVIIFGIGGVGSYTAEALARAGVGHLILVDYDEICLTNINRQLHALHSTIGKAKVDVMKNRILDINPKAKVDAVKEFFSAENAESFLGQKPDYVVDAIDTVSSKVALAKECSQRNIPLIASMGAGNRLSAENYRITDLSKTSGDPLAKAVRKLLRKEGITKGIKVVYSPDLPLTPLDTEADCRSNCICPGGDAHCALKRQIPGSISFVPPVSGLLMAGQVVNDLIADCPREA

SEQ ID NO: 75076 - protein, 310 aa, Staphylococcus lentus
GFGRIGRLAFRRLQEVENIEVVAINDLTDDAMLAHLLKYDSTQGRFKDEVEVIEGGFRVNGKEIKTFENPNPKELPWGDLDIDVVLECTGFFADKEKAHAHIDAGAKKVLISAPASGDLKTIVYNVNHDELDGSEEIVSGASCTTNCLAPMAKVLNDEFGIVEGLMMTIHAYTGDQNTLDAPHAKGDFRRARAAAENIVPNSTGAAKAIGLVIPELKGKLDGSAQRVPVATGSVTELTAVLDKEVSIEEINEAMKNATNDSFGYTEDEIVSSDVIGITYGSLFDATQTRVMRVGDRQLVKTAAWYDNEMS

SEQ ID NO: 75077 - protein, 259 aa, Neisseria meningitidis Z2491
MNGIIIKTPEEIEKMRELGKLVAEALDYIGQFVKPGVTTDEIDKLVYDYHVNVQGGYPAPLHYGNPPYPKSCCTSVNHVICHGIPDDKPLKEGDIINIDLTIKKDGFHGDSSRMFTVGKVSPIAQRLIDVTHASMMAGIEAVKPGATLGDVGYACQQVAENAGYSVVQEFCGHGIGRGFHEAPQVLHYGKKGQGSVLKPGMIFTVEPMINQGKRHLRILNDGWTVVTKDRSLSAQWEHEVLVTETGYEILTVSPASGKP

SEQ ID NO: 75078 - protein, 389 aa, Fulvimarina pelagi HTCC2506
MRKHGSGPSDRSGIEPFHAMTFLAEANRLKAEGADVLSLAVGQPASPAPLPAREAATTMIGRGAVGYTDAMGRPALRSALAAHYRQAYGVTIDPARVMITSGASGGFNIAFLAAFEAGDRIAIAAPGYPAYRNIMRALGIAPVEIEVGPSDDYILTSDRLEAYFRREPFQGVLIASPANPTGTMTPPDEIRRIADFCRTNGVWLISDEIYHRLSFGQEERSALQDLEEAIVVNSFSKYYCMTGWRIGWMILPPSLTDAAERLGQNLYISASDLSQTAALAALSAGDELDAVRESYRRNRLTMRERLPEIGFRTIAPIDGAFYAYAQIPEGFPSATVFAKTLLKQSHVAVTPGTDFDLRRGDGFVRLSYAGAEADVARALDRIADFVSKA

SEQ ID NO: 75079 - protein, 310 aa, Staphylococcus muscae
GFGRIGRLAFRRIQDVENIEVVAVNDLTDDDMLAHLLKYDTMQGRFTEEVEVIDGGFRVNGKEVKSFSEPEPSKLPWADLGVDVVLECTGFFTSKEKAEAHIEAGAKKVLISAPGTGDLKTIVYNVNHELLDGSETVVSGASCTTNSLAPVAKTLQDSFGIVEGLMTTIHAYTGDQNTQDSPHRKGDKRRARAAAENIIPNSTGAAKAIGLVIPEIAGKLDGGAQRVPVATGSLTELTVVLEKEVTVDEVNQAMKNATNESFGYTEDEIVSSDVVGMTFGALFDATQTRVMTVGNRQLVKVAAWYDNEMS

SEQ ID NO: 75080 - protein, 574 aa, Oryza sativa Japonica Group
MEVAGMRKASSHASMAAAAADPDDFDLTRMLNHRPRINVDRQRSFDDRSLAELSISGTASRGGGGGGYPAMMESYESMYSPGGGLRSLCGTPASSTRLSFDPHPLVFDAWDALRRSLVCFRGQPLGTIAAVDHSSDEVLNYDQVFVRDFVPSALAFLMNGEPEIVKNFLLKTLLLQGWEKRIDRFKLGEGAMPASFKVLKDAKRGGAERLVADFGESAIGRVAPVDSGFWWIILLRAYTKSTGDLSLAETAECQRGIRLIMNQCLAEGFDTFPTLLCADGCCMIDRRMGVYGYPIEIQALFFMALRCALLMLKPDAPEGKETMDRVATRLHALTYHMRSYFWLDFQQLNDVYRYRTEEYSHTAVNKFNVIPESIPDWVFDFMPSRGGYFVGNVSPARMDFRWFALGNFVAILASMATPEQAAAIMDLIEERWEDLIGEMPLKISFPAIESHEWEFVTGCDPKNTRWSYHNGGSWPVLLWLLTAACIKTGRLKIARRAIELAEARLARDGWPEYYDGKLGRYVGKQARKLQTWSVAGYLVAKMMVEDPSHLGMISLEEDRAMMKPVLKRSASWTV

SEQ ID NO: 75081 - protein, 337 aa, Triticum aestivum
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 75082 - protein, 310 aa, Staphylococcus saprophyticus
GFGRIGRLAFRRIQNVDGIDVVAVNDLTDDEMLAHLLKYDTMQGRFTGEVEVEKDGFRVNGQEVKSFSEPEPSKLPWKDLDIDVVLECTGFFADKEKAEAHINAGAKKVLISAPATGDLKTIVYNTNHQELDGSETVVSGASCTTNSLAPVAKVLNDDFGLVEGFMTTIHAYTGDQSTQDAPHRKGDKRRARAAAENIIPNSTGAAKAIGLVIPEIDGKLDGGAQRVPVATGSLTELTVVLEKNVSIEDVNAAMKNASNESFGYTEDEIVSSDVIGMTYGSLFDATQTRVMTVGDRQLVKVAAWYDNEMS

SEQ ID NO: 75083 - protein, 648 aa, Shewanella sp. MR-4
MEHGFLIQILLMLVIAIIAIALLRRIGLPAILAYLLTGVLSGPSGFHWFTQQQMQSVAELGVVLLMFTLGLEFSVPRLWAMRRTVFGLGSAQVLVTTVLTMLVALACGQNWIESLVIGAAIALSSTAIVLKLLNEQGWLRRRHGELSVSVLLFQDLAVVPLLILLPLLGQNDEPLMLAAIALALLKGILAFFLLMALGKWALPRLFDEVARSRSNELFVLSTLVVALVTGAFTQWLGLSMALGAFMAGMLLGESQYRRQLEADIRPFRDLLMGLFFISIGMMLDFALVIQFWWQILLILLAVVVGKALIIHGLLRLVGEPFRIAISTALSLAQVGEFSFVVLALAVSYGLLSNETSTMLVMVAVLSMSIAPWLVRHSVDIAKWLLGIRQSGHVDEVVPIVTDDHDLVLILGYGRVGQTIARFLKTEAVPYLVLDLDPTRVSEARRAGEPIYFGDVCKRAILKQVGIKHAKMIVITFCETRSLEEALPLCKQLAPDAKILVRTRDDSELDMLQKAGANQVIPESLEGSLMLVSQVLHQCGVPLARILKRLESERRNHYQFLHGFFSGTETDFTLESLHAVLLHRGADAVGKQVADIDWELLRVELRAIRRSGQEIEHPASDWIFRAGDILLIVGKPRRLEKAEAKLLHG

SEQ ID NO: 75084 - protein, 492 aa, Flavobacteria bacterium BBFL7
MTNPPKPNQKNMDIKNFINNNEHIPLSGLWLDNYEPASGLVYGQIPNSNEDDVEKAYQAANAAFKDWSTTSIDERSRIMLRIADLIEENLEELAAAESRDNGKPLWLATAVDIPRASSNFRFYGNAITQYSSDAHETTGKNTMNFTMRKPIGVVGCISPWNLPLYLFSWKIAPAIAAGNCVVAKPSEVTPATAFLLGEIVKKAGLPAGVLNIVHGLGGSCGQAIVAHPGIKAISFTGGTTTGEHIARTAAPMFKKLSLELGGKNPNIIFADCNYDKMLTTTLRSSFANQGQICLCGSRILVEQSLYEKFKTDFVARVQQLKVGHPNQSDTKVGAVVSAAHRDKILDYIAFAKANPKEYTILSGGNSVLIEGHEGGYYLEPTVIEVQSNDCKLNQEEIFGPVVTIIPFKDEAQALELANGTRYGLSATLWTSDLSRTMRMSNELEAGIVWVNTWLNRDLRTPFGGVKDSGVGREGGFEALNFFTEPKNVCIEY

SEQ ID NO: 75085 - protein, 564 aa, Brassica juncea
MASTPKLTTTISSSPSLQILCRKLPTAINLPSSPTSRSLPKTLSHLSSLRLRAASVSNHRYYSSSSSSRRFSVRAQNDNGADSDRHYDFDLFTIGAGSGGVRASRFATSYGASAAVCELPFSTISSETAGGVGGTCVLRGCVPKKLLVYASKYTHEFEDSQGFGWKYDTEPSHDWSTLIANKNAELQRLTGIYKNILNNANVKLIEGRGKVIDPHTVDVDGKIYTSRNILIAVGGRPFIPDIPGREFAIDSDAALDLPSKPEKIAIVGGGYIALEFAGIFNGLGSEVHVFIRQKKVLRGFDEDVRDFVGEQMSLRGIEFHTEESPEAIIKAGDGSFSLKTSKGTADGFSHVMFATGRKPNTKNLGLENVGVKLAKNGAIEVDEYSRTSVPSIFAVGDVTDRINLTPVALMEGMALAKTLFQNDPTKPDYRAVPCAVFSQPPIGTVGLTEEQAIEQYGDIDVFTSNFKPLKATLSGLPDRVFMKLIVCANTNKVLGVHMCGEDSPEIIQGFGVAVKAGLTKADFDATVGVHPTAAEEFVTMRTPTRKIRKESSEGKASVEAKTAV

SEQ ID NO: 75086 - protein, 192 aa, Nitrosomonas europaea ATCC 19718
MLMNLPNFLTWLRIMAIPLFVGIFYLPTDWMSPATQNLVATIVFAGAALTDWLDGYLARVLNQTSAFGAFLDPVADKLMVAAALIVLVYLDRLDAPVALIIIGREITISALREWMAQIGKSKSVAVSFLGKIKTAAQMVAIPLLLYHDRINDAFDSQTAGTWLIYIAAILTLWSMIYYLRAAIPHVIHHSQH

SEQ ID NO: 75087 - protein, 158 aa, marine gamma proteobacterium HTCC2143
MTVKVGDKLPAGSLKVMGAEGPQEFTISDLFDGKKVVMLAVPGAFTPGCSMTHLPGFVVSADKIKANGIDSIICLSVNDAFVMGAWGTAQNADEIIMAADGSADYTKALGLEMDASGFGMGLRSKRYAMIVDDGVITYLGVDAKAIEASAAEAVLEQL

SEQ ID NO: 75088 - protein, 321 aa, Nicotiana attenuata
FEIDTKYVPIKPIGRGAYGIVCSSVNRETNEKVAIKKINNAFENRIDALRTLRELKLLRHLRHENVIALKDVMMPIHRRSFKDVYLVYELMDTDLHQIIKSSQTLSNDHCQYFLFQLLRGLKYLHSANILHRDLKPGNLLINANCDLKICDFGLARTSSGKDQFMTEYVVTRWYRAPELLLCCDNYGTSIDVWSVGCIFAELLGRKPVFPGTECLNQPKLIINILGSQREEDIEFIDNPKARKYIKSLPYSPGTPFSRLYPHAHPLAIDLLQRMLVFDPSKRISVIEALQHPYMSPLYDPNTDPPAQVPINLDIDEDLGEE

SEQ ID NO: 75089 - protein, 283 aa, Zea mays
EDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRS

SEQ ID NO: 75090 - protein, 487 aa, Solanum chacoense
MELGDNKILNVGLLLVATLLVAKLISALIMPRSKKRLPPVIKALPIVGGLIRFLKGPIVMLRQEYPKLGSVFTLNLLNKNITFFIGPEVSAHFFKAPETDLSQQEVYQFNVPTFGPGVVFDVDYTIRQEQFRFFTEALRVTKLKGYVDQMVTEAEEYFSKWGESGEVDLKYELEHLIILTASRCLLGEEVRNKLFDDVSALFHDLDNGMLPISVIFPYLPIPAHRRRDNARKKLAEIFANIINSRKRTGKAENDMLQCFIDSKYKDGRPTTEGEITGLLIAALFAGQHTSSITSTWTGSYLLTNNKYMSAVVDEQKNLMKKHGNKVDHDILSEMDVLYRCIKEALRLHPPLIMLLRSSHSDFSVTTREGKEYDIPKGHIVATSPAFANRLPHIFKNPESYDPDRFGPGREEDKAAGAFSYISFGGGRHGCLGEPFAYLQIKAIWSHLLRNFEFELISPFPEIDWNAMVVGVKGEVMVKYKRRKLSAE

SEQ ID NO: 75091 - protein, 504 aa, Flavobacteria bacterium BBFL7
MNKKTILMILDGWGITQDPKVSAIAQAQTPFIDSLYDQYPHATLRTDGEHVGLPEGQMGNSEVGHMNLGAGRIVYQDLAKINKAIKEDTLKDEQVLVDALAFAKANSKKVHFLGLLSDGGVHAHIDHLKALLDVAESHEIEDVFIHAFTDGRDVDPKSGASHVANLEKHISGTNAQLATVTGRYFAMDRDQRWERVKKAYDVIVHGMGQPSHDATDSIKEFYNQGVTDEFIEPIVVLNGTEPVATVEDGDVIIFFNYRTDRGRELTQMLSQQDYHEQNTHALDLYYVTMTKYDDSYNNVKVIFEKDNLKNTLGEVLADAGKTQIRIAETEKYPHVTFFFNGGQEKPFKGEQRIMCNSPKVATYDLQPEMSIDCVSSSIIPEINRQVADFICLNFANPDMVGHTGSMEAAVKACEAVDQAAHDVITAAMEQDYTIIVIADHGNCEVMLNPDGSVNTAHTTNPVPIILVDKDLKEVKDGILGDIAPTILKLIGVKQPEEMTQNSLL

SEQ ID NO: 75092 - protein, 334 aa, Burkholderia sp. 383
MNTPHAHIHSLPPEGAGASPGAEAPNDVIHDAPAFVANAASWYEASARQRIDGLLDAGSFSEFLGPAERVTSPHLPLFDLPQQFDDGMVVGHGRLDGQPVFVAAQEGRFMGGAFGEVHGAKLTGLLRAARETGKPVLILFDTGGVRLQEANAGELAIAEIMRALVEARTAGVPVIGLIGGRAGCYGGGGLLAACCSALAVSEQGRISVSGPEVIETNRGVEEFDAKDRALIWRTMGGKHRRLIGGADRYVADTPDAFRAVALELIGRAPKFDAAMLRAEQARLEARVERFGACNDALDVWRALGASAPEAIPGMPDDAFAALADQLQESPHDAR

SEQ ID NO: 75093 - protein, 415 aa, Nitrosomonas europaea ATCC 19718
MAFLVQKYGGTSVGSTERIKQVAHRVAEFRAQGHELVVVVSAMSGETNRLISLAKEIQPNPDPRELDVILSTGEQVTIGLLAMALRELGIKAKSYTGPQVSITTDSAHTKARILKIDEDPIRADLAAGYVIIVAGFQGVDETGDITTLGRGGSDTTAVALAAALKADECQIYTDVNGIYTTDPRVVPEARKLDTITFEEMLEMASLGSKVLQIRSVEFAGKYKVKLRVLSSFEEGEGTLITFEEDNKMEQPIISGIAFNRDESKITVVGVPDHPGIAYQILGPVADANIDVDMIIQNVGHDDTTDFSFTVHRNEYARTMDVLKQQVLPHIGAREVIGGDKIAKVSVIGVGMRSYAGIASKMFRVLAEEGINIRMIATSEIKISVVVDEKYMELAVRVLHKAFDLDQVNNTSTKTC

SEQ ID NO: 75094 - protein, 453 aa, Rickettsiella grylli
MSKKVKQQKLGLWMLTALVTGNMIGSGIFLLPASLAAYGSISLLSWVVTAVGALLLALVFAKLSNVMPLIGGPYAYCREAFGEFVGFQMAYNYWIALWVGNAAIVVALIGYLSFFWPKLAHDTRWTCLVSISVVWLVTFINILGVRQAGIFQLLTTVLKLIPLLLIALVGIFYIHPHFLSAFNLSGQSNLKAFSGAATLTLWSFIGLESASVPAGHVNNPHRTIPKATILGVVITTVVYLLSSTAAMGVMPLTVLAHSNAPYADAARIMFGPIGSILVAIGAVISCLGALNGWVLLQGQIPLAAAQDKLFPAVFLKKSKSGTPIVGLIVSSILISLLLLMTLNHSLVKQFTLIILLATLASLIPYFLTTMSELVIFYKYPGLFKKDRKLLRSVIIAILAGIYSFWVIIGSGKEIVFYGTLLLLSSVPVYVWMKWRSSSNGNVINVNEQSLPLP

SEQ ID NO: 75095 - protein, 92 aa, Brassica oleracea
MNFTSGGGQDQVLSKVIELVKKYDTTSASKVTETADFKKDLSLDSLDRVEIVMAIEEEFSVEIPDEKADKLTCCADIASFIVSETQSKAPES

SEQ ID NO: 75096 - protein, 335 aa, Nicotiana attenuata
YVEYNVLGNFFEVTSKYIPPIQPVGRGAYGMVCCATNSETKEEVAIKKIGNAFENRIDAKRTLREIKLLSHMDHENIIKIKDIVRPPDREEFNDVYIVYELMDTDLHQIIRSSQALTDDHCQYFLYQLLRGLKYVHSANVLHRDLKPSDLLLNANCDLKICDFGLARTTSEADFMTEYVVTRWYRAPELLLNCTEYTAAIDIWSVGCILMELIKGEPLFPGRDYAQQLGLIIALLGSPEDSDLGFLRSDNARKYVKQLPRVPRQPFSQKFPDVSPLALDLAERMLVFDPAKRITVEDALNHPFLISLHEINEEPVCDSPFNFDFEQASLSEDDIK

SEQ ID NO: 75097 - protein, 118 aa, Ricinus communis
MAAEEGQVIGCHTVEAWNEQLQKGNDTKGLIVVDFTASWCGPCRFIAPFLAELAKKLPNVTFLKVDVDELKTVAHEWAVESMPTFMFLKEGKIMDKVVGAKKDELQQTIAKHMATAST

SEQ ID NO: 75098 - protein, 483 aa, Oryza sativa
  misc_feature (191)..(191): Xaa can be any naturally occurring amino acid
MEPRIGNKFRVGRKLGSGSFGEIYLGTNVQTNEEVAIKLENVKTKHPQLLYESKLYRILQGGTGIPNVKWFGVEGDYNVLVMDLLGPSLEDLFSFCNRKLSLKTVLMLADQMINRVEFVHSKSFLHRDIKPDNFLMGLGKRANQVYVIDFGLAKKYRDTSTHQHIPYRENKNLTGTARYASVNTHLGIASXTVLCFSIEQSRRDDMESLGYVLMYFLRGSLPWQGLKAGNKKQKYEKISERKIATSTEALCRGYPTEFASYFHYCRSLRFEDSPDYQYLKRLFRDLFIREGFQFDYVFDWTILKYQQSQMTSAPPRAIAPATGQSSAMAPIANNNRLSATEEGRRSGWSDMDAMRRQVPPPAINAGSLAKQKSPIGHEQSTSKDAVFSSSTFLGRSSGSSRRPAVSSSREPSTEADQSRSRTTDASPGAFQRSGAPRWSPQMVDSSDNRRTPSGRHPSNAKNYESTIRGIQGLNFDGDDRIQY

SEQ ID NO: 75099 - protein, 328 aa, Nicotiana attenuata
SSKVSGSNSNTPSTTTTTTTVNVRRNTANPPSTSTITSTKQEGSHCNKQKVKDNHRSQHQKQQPRNSQQNVKKHKNGRRQKSGVIPCGKRTDFGYDKDFDKRFTIGKLLGHGQFGYTYVATHKSNGDRVAVKRIEKNKMVPTIAVEDVKREVKILKALSGHENVVQFNNAFEDDNYVYIVMELCEGGELLDRILAKKDSRYAEKDAAIVVRQMLKVAAQCHLHGLVHRDMKPENFLFKSPKEDSPLKATDFGLSDFIRPGKKFQDIVGSAYYVAPEVLKRRSGPESDVWSIGVITYILLCGRRPFWDKTEDGIFKEVLRNKPDFRRKP

SEQ ID NO: 75100 - protein, 442 aa, Polaromonas sp. JS666
MDNTSMVQRSLRHVWHPCTQMKLHESQPLIPVSRADGVWLHDFEGHRYLDGISSWWVNLFGHNHPHIRAALIDQLGRLDHVMLAGFTHQSVVELSEKLAQLTGLGHAFYGSDGASATEIALKMSAHYWRNTGRPGKCRFVGLAGGYHGETVGALAVTDIAIFREAYAPLVRLAATVPSPDARCARPGESAVDVAGRAAGALQAWLEQHHAETAALIVEPLVQCAAGMAMHDASYLRGVRALCDRYEVHLVVDEIATGFGRTGTMFAHQQAGIRPDFICLSKGLTGGTLPLSAVLTTDTVYQAFYDDDVARGFLHSHSYTGNPLACRAALATLELFEQNDVLAGNVAVARSLTAAFAPLTAHPRVRNARQLGMIWAWDVADALPGFSRRYYQHALAQGVLLRPIGNTIYAMPPYVMDEESSGFLARGALAALQATLAEEAAHG

SEQ ID NO: 75101 - protein, 125 aa, Brassica oleracea
MAGRLSGVASRIMGGNGVVARSAASSLRQRAGMGLPVGKHIVPDKPLSVNDELMWDNGTAFPEPCIDRIADTVGKYEALGWLCGGLSFFAALGMLAVLNDKASKVPFVSEKLSTFYVIYAFIVVS

SEQ ID NO: 75102 - protein, 587 aa, Brassica oleracea
MEMESCKLFIGGISWETTEDRLREYFQSFGEVLEAVIMKDRATGRARGFGFLVFSDPIVAERVVFLRHVIDGKLVEAKKAVPRDDHVVLNKSYNTSLQGSPGPANSKKIFVGGLASSVTEAEFKKYFAQFGVITDVVVMYDHRTQRPRGFGFISFESEDAVDKVLQRTFHELNGKMVEVKLAVPKEMALNPIRNQMNVNSFGSSRISALLMNEYTQGFSPSPISGYGVKPEVRYSPGLGNRGGGFSPFGHGYGIELNFEPDQSQNFGSGSSAGFGRPLSPGYAPSLGRYGSQIESGGAGNGPVLNAATKNHLWGNGGGLGYMSNSPISRSSFNGMSSLGSIGDNSRRNSYRSEGGGGLGLEAMRGGHVGGYSSGSSSLETDSLYSDSAWLSLPAKAEERMGAFDFMSRGPAGYINRQPNGEVAAASPLSSASSECNSNSCRWKPYSNSTDFQANASVLLILIFSSLICALSLCAAIRCFLRPTTPETDDNDHKSDLEADSSFTIPTPTLVYSSDLELAGAEAECAICLSEFEQGESIQVLEKCHHGFHVKCIHKWLSSRSSCPTCRTSIFLQSTLDSTPSTEAPSTN

SEQ ID NO: 75103 - protein, 219 aa, Castanea crenata
MAGKVVLLDFWPSLFGMRVRIALAEKGIKYENKEEDLSKKSPLLLEMNPVIKQIPVLIHNGKPVCESLIIVQYIDEVWNDKCPLLPSDPYQRAQARFWADFVDKKVYVASRKIWRPKKEEQEAGKKEFLETLKTMEGELGGKPYFGGETFGYVDLSLIPFYSWFHAYKVLDNLNIEAECPKIIAWAKRCMQKEAVAKTFHDPKKVLEFVAQTRKKYVTA

SEQ ID NO: 75104 - protein, 324 aa, Oryza sativa Japonica Group
MTMPFAVSDPSASVEEMVAAAAADDECVCVWLEEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVTLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 75105 - protein, 176 aa, Candidatus Carsonella ruddii
MLNTRIKPFKNISYYKKKFYEIKEIDLKSNWNVFFFYPYSYSFICPLELKNISNKIKEFKNLNTKIYAISNDSHFVQKNWIENELKFINFPFISDFNHKISNNFNILNKKDGNCLRSTIIIDKNLIIKYINIVDDSIGRSIDEILKNIKMLQFINTNENKLCPYSWNNDSKSIEIN

SEQ ID NO: 75106 - protein, 219 aa, Castanea crenata
MAGEVVLLDFWPSMFAMRVRIALAEKGIRYESKEEDLSNKSPLLLEMNPINKQIPVLIHKGKPVCESLIIVQYIDEVWNDKSPLLPSDPYQKRSSQVWADFVDKKVSGAAKKVWSTKGEEQEAGKKEFLEALKTMEGELGDKPYFGGETFGYVDLSFITFYSWFHAYEVLGNFNIEAECPKIITWAKRCMQKEAVANTLPDQKKVYEFVVQLRKMFVSE

SEQ ID NO: 75107 - protein, 144 aa, Arabidopsis thaliana
  misc_feature (12)..(12): Xaa can be any naturally occurring amino acid
  misc_feature (47)..(47): Xaa can be any naturally occurring amino acid
  misc_feature (52)..(52): Xaa can be any naturally occurring amino acid
MASSMLSYAAEXTSPAQATMDAPFTGLKPSDALPDTHKANIASVASXNGGRXICRKARPPSGKKKKETLSYLPDLTDVELAKEVDYHLHNKRMTCAENEMEHGFVYREHGNSPGYYDGRYWTLWKLPLIGCTDSAEVLKEDEEC

SEQ ID NO: 75108 - protein, 171 aa, Triticum aestivum
  misc_feature (116)..(116): Xaa can be any naturally occurring amino acid
MRSPVPAMLTAPSAAAAVAKPLPAARSNTTAALHATAASSRRDVITGTGVGAALLLALWPQRARAASDDEYLTETTEVIGKVRSTISMDKTDPKVADAVTELREMSNSWVAKYRRXKALLGRQSFRDMYSALNAVSGHYISFGPTAPIPNKRRIRILEEMDAVEKSLKRGR

SEQ ID NO: 75109 - protein, 219 aa, Triticum aestivum
  misc_feature (153)..(153): Xaa can be any naturally occurring amino acid
  misc_feature (211)..(211): Xaa can be any naturally occurring amino acid
RPVLFNIADHEAEHYLEMIRNHASGWLPEMRKDDYAVVEKRSLTTWMKGGLDYIVLKYLDTDGIRIISSVLGQSIALDHYIRQVDDMVEEFTEINRIMEKTGDFTMKRKKLFQLVGKANSNLADVIIRLGLFDRSEIAWKNANYAQILEYLRXEEYELNQRFGSLDFKLKFVEHNVHFLQEVLQNRRSNFLEWGVIILLAIEIVISLYEIXIKDSSMMS

SEQ ID NO: 75110 - protein, 617 aa, Magnaporthe grisea 70-15
MNQAAPTTAIDIAQIEEGIKMANLDTLRGYSNTTPAPVQQAIKTEYTPMSQAAGYQVIREPMWNKGLMFTPEERVSKNLTGLLPHTMETEDIACARAMKMIRSRSTNVDRYLYLSSLKSSNTDLFYRLLMDNVRELMPLVYTPTIGDVCLQYSSLFTRPEALYISIKQRKSIKTMLANWPYPNPEICVITDGSRILGLGDLGINGVGISIGKLALYTAAAGIHPSKQLPIVIDCGTNNEENLRDPLYLGLRSKRPSVQEQQDFCDEVMHSIKEVYPNMVVQFEDFETEKAFNYLDRYRFDPKLNCMFNDDIQGTGAVVLAGYINAVKLSNVPVEEQRLVFMGAGSAGAGVARQLVDYYRNAHGMSEQEAKDKFYLVDTKGLITSDRFDGAKLPSHKRYFARDDNNGHQFQTLEDVIEFARPSALVGLTATFGVFTESIVRGLKASVDAAGHRNRRPILFPLSNPLTKAECTFSQAIDWTDGTVIFASGSPFAPHTVKNGDSATTYYPNQGNNVYVFPGIGLGAILAKASRVTDEMVYTSAEALANCLNADEIATGLIYPRIDRVQDASLVVAREVMKCCRRQGFSKLDDELWKSWEEWGDNALMAWIKTKLYKPLKE

SEQ ID NO: 75111 - protein, 310 aa, Staphylococcus schleiferi
GFGRIGRLAFRRIQDVENIEVVAVNDLTDDDMLAHLLKYDTMQGRFTEEVEVIDGGFRVNGKEVKSFSEPEPAKLPWGDLGVDVVLECTGFFTDKEKAEAHIQAGAKKVLISAPAKGDLKTIVYNVNHDDLDGSETVVSGASCTTNSLAPVAKTLHDEFGIVEGLMTTIHAYTGDQNTQDAPHRKGDKRRARAAAENIIPNSTGAAKAIGLVIPEIAGKLDGGAQRVPVATGSLTELTVVLDKEVTVEEVNKVMKAATNESFGYTEDEIVSSDVVGMTYGALFDATQTRVMTVGDRQLVKVAAWYDNEMS

SEQ ID NO: 75112 - protein, 269 aa, Flavobacteria bacterium BBFL7
MIVTKTREELEIMRRAALMVSKTLAMVAAEIKPGVTTLKLDTMAEEFIRDHGAIPGFKGLYDCPSTLLISPNEEVVHGIPKDVEIKDGDVLSVDCGAIVDGFYGDHAYTFAVGEIPQETQDLLDRTKNSLYLGIEQFRVGNRVGDVGYAIQNYCEGFGYGVVRELVGHGLGRTMHEDPQMPNYGKRGRGKKFVEGMTVAIEPMINLGTKDIKHYPDGWTIKTRDMKPSAHFEHDIAIVDGEPRLLSTFDYIYEVLGITSNEEDPYRWKD

SEQ ID NO: 75113 - protein, 310 aa, Staphylococcus warneri
GFGRIGRLAFRRIQDVEGLEVVAVNDLTDDDMLAHLLKYDTMQGRFTGEVEVIDGGFRVNGKEVKSFDEPDASKLPWKDLDIDVVLECTGFYTDKDKAQAHVDAGAKKVLISAPATGDLKTIVYNTNHDELDGSETVVSGASCTTNSLAPVAKVLSDEFGLVEGLMTTIHAYTGDQNTQDAPHRKGDKRRARAAAENIIPNSTGAAKAIGKVIPEIDGKLDGGAQRVPVATGSLTELTVVLEKDVTVEQVNEAMKQASDESFGYTEDEIVSSDVVGMTYGSLFDATQTRVMAVGGRQLVKVAAWYDNEMS

SEQ ID NO: 75114 - protein, 310 aa, Staphylococcus xylosus
GFGRIGRLAFRRIQNVDGIDVVAVNDLTDDEMLAHLLKYDTMQGRFTGEVEVENDGFRVNGQEVKSFSEPDPSKLPWKDLDIDVVLECTGFFADKEKAEAHINAGAKKVLISAPATGDLKTIVYNTNHQELDGKETVVSGASCTTNSLAPVAKVLNDDFGLVEGFMTTIHAYTGDQNTQDAPHAKGDKRRARAAAENIIPNSTGAAKAIGLVIPEIDGKLDGGAQRVPVATGSLTELTVVLEKNVSVEDVNAAMKNASNESFGYTEDEIVSSDVVGMTYGSLFDATQTRVMTVGDRQLVKVAAWYDNEMS

SEQ ID NO: 75115 - protein, 439 aa, Schizosaccharomyces pombe 972h-
MARKRTNKRNNSDKENGNVGVVQNKDSASSKTTEPARLTKHKSLARKPSQNFITRTIWTFLLLGIFFTALAMGHFWVVLLVTIVQIGVYKEVIAIASVPSREKDLPWTRFINWYFLMTTLYYAYGESIYAYFHHLFIMDSFMLPLVLHHRFISFMLYIIGFVLFVASLKKGNYKFQFSQFCWTHMTLLLVVGQSHFMINNLFEGLFWFFVPVCYVVCNDVFAYLCGKMFGKHPLIQVSPKKTVEGFLGGWICTVVIGSLISYVLMHFKYFICPTRDLSTSAFSGLNCTPNSVFLPHTYTIPAVFVDTFRLPETITLAPIYFHLAIFATFSSLIAPFGGFFASGLKRAFKIKDFGASIPGHGGLTDRMDCQFLNGVFVYMYFQSFIAEKSTSVADLLDTAVYSLTTTQQVQLVEDLQNYLISHGKTSVQAICSKLLQNSK

SEQ ID NO: 75116 - protein, 306 aa, Solanum lycopersicum
MGGGDHGGKSDISFAGIFASSAFAACFAEACTLPLDTAKVRLQLQKKAVEGDGLGLPKYRGLLGTVGTIAKEEGVASLWKGIVPGLHRQCIYGGLRIGMYEPVKNLYVGKDHVGDVPLSKKILAALTTGALGITVANPTDLVKVRLQAEGKLPAGVPRRYSGALNAYSTIVKQEGVRALWTGLGPNIGRNAIINAAELASYDQVKEAVLRIPGFTDNVVTHLIAGLGAGFFAVCIGSPVDVVKSRMMGDSAYKNTLDCFVKTLKNDGPLAFYKGFIPNFGRLGSWNVIMFLTLEQAKKFVKNLESP

SEQ ID NO: 75117 - protein, 379 aa, Desulfotalea psychrophila LSv54
MRMKDIFEFADELGPLKVIHVYEPSVNLRAVLVVDNIARGPSLGGVRMATDVSVEECVRLARAMTYKNSAAGLPHGGGKAVLYGDPKMAKVEKEKMIRALAKVLRNEDSYIFAPDMGTDEECMAWVQDEIGRVVGLPREIGGIPLDEIGATGFGLSHAVDVALNYCDFQLEGARVVVQGFGAVGKHAARYLSQRGAVLVAVADSRGAIYNPDGLDVQQLIALKAAGGFVGDYPEARKMTGDDLLDVACDIWIPAARPDVIHEANVHRLNTRLVVEGANIPLTHGAERILHERGILCLPDFIANAGGVICAAMEYQGASQVAALAMIEEKLRANTEQVLAMVKDRDMLPREAAMEMALGRLKKAMSYRRFSLFSSGPKFI

SEQ ID NO: 75118 - protein, 236 aa, Escherichia coli
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 75119 - protein, 495 aa, Streptococcus suis 89/1591
MSSHVLFTIFGASGDLAKRKLYPSLFRLYKAGHIKENFAVIGTARRPWTKEFFEQTVIESLGDLPDTPRQAHEFASHFYYQSHDVNDTEHYVALRKLQDDLCEKYNTQHNKVFFLSMAPEFFGTIAKHLKSEQIVDGQGFERLIIEKPFGTSLETASKLNDELAAAFNEDQIYRIDHYLGKEMVQNIFAVRFANIIFEHIWNRDYIDNVQITFAEAIGVEDRGGYYDHSGALKDMVQNHALQVLSLLAMDKPASFKEEDVRAEKIKVFQHLRQPSDEDLKRNFIRGQYAAGSIDGKDYVSYLDEPNIAEGSQTETFAGGVFFVDTDRFRDVPFFFRTGKRLTEKGTRVTITFKHAEDIFGQPSEANVLTIFIQPTEGFMLSINGKEVGSHFALTPAKLNFRHNATALGNSPEAYEKLFFDVLNGDSTNFSHWEEVKASWSLIDRIVDLWASNQVPLHTYPAGTMGPEATFDLLESYGCKWVWTPDVWYRERGLLK

SEQ ID NO: 75120 - protein, 384 aa, Triticum aestivum
MALRAASPPCAAGRCLPSSPPPRVGGRHFFRPLSSAAPAPLRKSAVCTKAISNSDGTPGTSDSPHVVCFGELLIDFVPTVSGVSLADAPAFKKAPGGAPANVAVGIARLGGSAAFIGKVGDDEFGYMLSDMLKENNVNNQGLLFDTHARTALAFVTLRSDGEREFMFYRNPSADMLLEEKELDLDLIRKAKIFHHGSISLITEPCKTAHIAASKAAKDAGVLISYDPNLRLPLWTSADDARDGILSIWDTADLIKVSAEEVSFLTNGENPYDDSVVKKLIHPNTKLLLVTEGPDGCRYYSKEFSGKVGGLKVTAVDTTGAGDAFVAGILSQLAADFSLLQDEARLREALKFANICGALTVTERGAIPALPTRQQVADALTNVVA

SEQ ID NO: 75121 - protein, 195 aa, Zea mays
  misc_feature (166)..(166): Xaa can be any naturally occurring amino acid
  misc_feature (177)..(177): Xaa can be any naturally occurring amino acid
  misc_feature (185)..(185): Xaa can be any naturally occurring amino acid
MSLADELLADLEEAAEEEEGGSYGEEEEEPALEDVQEETQLDLSGDSVKSIAKLWDSKMFAEIMMKIEEYISKQANASEVMGPVEAAPEYRVIVDANNLTVEIENELNIIHKFIRDKYSKRFPELESLVPNALDYIRTVKELGNSLDKCKNNENLQQILTNATIMXVSVTASTTQGXQLSDEELXRVEEACDMAL

SEQ ID NO: 75122 - protein, 175 aa, Triticum aestivum
  misc_feature (63)..(63): Xaa can be any naturally occurring amino acid
MAPTVMATSVTSVAPFQGLKSTAGLPVSRRSSSAGLGSVSNGGRIRCMQVWPIEGIKKFETLXYLPPLSTEALLKQVEYLIRSKWVPCLEFSKVGFVFREHNSSPGYYDGRYWTMWKLPMCGCTDTTQVLKEVEDVKKEYPDAYVRVIGFDNLRQVQCVSFIAFRPPGCEESDKA

SEQ ID NO: 75123 - protein, 319 aa, Oryza sativa Japonica Group
MAAAQGSGVPAALALSSGHTMPSVGLGVWRMDSPAIRDLIHSALRIGYRHFDCAADYQNEAEVGDALAEAFQTGLVKREDLFITTKLWNSDHGHVVEACKDSLKKLRLDYLDLYLIHFPVATRHTGVGTTASALGDDGVLDIDTTISLETTWHAMEDLVSMGLVRSIGISNYDIFLTRDCLAYAKIKPAVNQIETHPYFQRDCLVKFCQKHGILVTAHTPLGGSTANTEWFGSVSCLDDPVIKSLAEKYGKTPAQLVLRWGLQRNTVVIPKTSKEERLQENFAVFDFAISDEDMEKMRSIDRKYRTNQPAKFWGIDLFA

SEQ ID NO: 75124 - protein, 339 aa, marine gamma proteobacterium HTCC2143
MPTINRRRFLQFGAATAVVASATACSSDGPQATIDKQLPVGPYGADATAESVTKDMDLSGKTAVVTGCNSGIGYETMRVLALRGAHVIGTGRTLEKAQIACASVEGITTPVALELSDFQSAVDCANRIKAMNTPIDIVICNAGINTFGELELIDGIERIFRVNHLGHFVLINNLLPALASANAGRIVHVGSVSGYVQAPAVGIDFDNLRGEKIFDAGEAYGRSKLANALFSLQLSKNLADTTTTSNVIHPGLVLTNIARTAPAFLRKGFEWVGPLFAKTPAQGAATQVYVATHPSLEGISGAYFEDCNPVTISGDHHMFDEAMADKLWSVSMEMTRGFI

SEQ ID NO: 75125 - protein, 337 aa, Mesorhizobium loti
MLEKFERYPLTFGPTPIEKLDRLGKHLGGNVEIYAKREDCNSGLAFGGNKLRKLEYIIPDAIASDADTLVTIGGVQSNHTRMVAAVAAKIGMKCLLVQESWVPHEDVVYDRAGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPEGSRILYAHLGGAPAINGYGYTFRNG

SEQ ID NO: 75126 - protein, 364 aa, Pseudomonas fluorescens Pf-5
MSEQELKALRLRIDALDEKVLELISERARCAQEVARVKMGSLAEGEVPVFYRPEREAQVLKRVMERNQGPLGNEEMARLFREIMSSCLALEQPLKVAYLGPEGTFTQAAAMKHFGHAVISKPMAAIDEVFREVAAGAVNFGVVPVENSTEGAVNHTLDSFLEHDMVICGEVELRIHHHLLVGENTKTDSISRIYSHAQSLAQCRKWLDAHYPNVERVAVSSNAEAAKRVKGEWNSAAIAGDMAAGLYGLTRLAEKIEDRPDNSTRFLMIGNQEVPPTGDDKTSIIVSMSNKPGALHELLVPFHDNGIDLTRIETRPSRSGKWTYVFFIDFVGHHRDPLVKGVLEKISQEAVALKVLGSYPKAVL

SEQ ID NO: 75127 - protein, 517 aa, Oryza sativa
  misc_feature (17)..(17): Xaa can be any naturally occurring amino acid
VIDGAGRRRRRRGGSGXVWRPYAVARAFGRQRIRGPAYRLFVGSDGEANAMRAATRGDVLDRRCHDIVPRVMPHYRAWMSRYGKVFVSWSGATPALCVGDYAMVKQILSDRTGLYGKPEPEPSILALIGNGLIFIGGDDWARHRRVVHPAFAMDKLKMMAKTMADCAREVIREWEARATADGERRVQVEVGGQLQELTADVISHTAFGSSYREGKEVFVAQRELQSIAFSAINSTRFPGSQYIPTKTNLRRRHLAKKVRGTLMAIIRERQAAAAKEDSGHGNDLLGLMLEANATDACGSGGEKSMTMDEIVDECKTFFFAGHDTTSHLLTWAMFLLGTHPEWQHRLREEVLRECGGGGDTEALPNGDALNKLKLMTMVLYETLRLYGPVSLMARTATADAELGGVRVPKGTMTMIPMAILHRDADVWGAGAGEFDPLRFRGGVNKAAAHAGALLAFSLGQRSCIGQDFAMMEAKTTLAMILRRFAFEVSPEYVHAPLDLLTLQPKCGLPMVLKLLDQ

SEQ ID NO: 75128 - protein, 323 aa, marine gamma proteobacterium HTCC2143
MATSNFGYRSTALDVVSGINLSNKNAIVTGGYSGIGIETVVALATAGANVTIAGRDLSRAERTADELNSKGLLGVVDAMSLDLGSLQSVKGFVESYCASHASLEILVNNAGVMACPFETTTDGFELQFGTNHIGHYALSRLLLPLLLNAESARVVCLSSTGHMISPVIFDDINFSQRKYDAWSSYGQAKTANSLTAVALQQLYGSKGVDAFAVHPGGIMTSLQRHMEQKDIEARGWVDAEGNINERFKTVEQGASTSTWAATASELTAKGGVYLEDCDFAEVVASRPDYPKGVIAYAVDSEAARQLWQISESMILDKFSDYFA

SEQ ID NO: 75129 - protein, 376 aa, Brassica oleracea
MEGLLSYRSNVLRNIMREREKDRKKMLISEIFSENEDEEVVIIGGLVMVQFVYAGNSLLMSYLMSLSLGPLTIVIFSTFATFLILSPFAILFERKQWPDELSPRLIGKLVLISFAGVTLFQTLFLEGIRLTSPAMATAMPNLAPGLIFFIAWMVRLEKMDMKCVYSKLKILGTLLCVFGALTMSLMHSASIIQDEKDNASIFVFDRDRVVGCMYLLGAVFILSSNVVLQASTLAEFPAPISLSAITSLIGVVITTMLQLLQNPNTKVVTRSLISISNLVGFSLLGGMVSGACVSFNGWAMKKRGPVMVSMFSPIATVISVGLSVVTLGEPVRIGSVGGMALMFIGLYLVLWAKGKEGFSQIDSFESEYDPKKPLLS

SEQ ID NO: 75130 - protein, 1812 aa, Oryza sativa Indica Group
MADPFVADDQTDADFFDKLVDDDDDLSPAPAPAPVPAQQSAEAALLPALSDLSLADDDTDPSPAPPPVEAPPEGASPESGKGAVHTTVKQVQWASFGGAADDGADPFSDLSGGAADDGFLGTMAGNQSFQTSVIGSVGASAHGIFGGSQSLTAEVTDQDFFGGTSDQNTDTQQQQLEQSGSGAFDSTDPKYLESIYPGWKYDEATQQWYQVDNSDTHGNATQVDTSTENIQQQQLAASYMHNPTQSSLETIAEEGTTTGSVSTWGQGGTSEYPPNMVFYTEYPGWYFDTNTQQWQSLESYQQAVTASAVQDGANNGVVASSAETNYSVKQTEDLPVHNQVAQHNSFSNNYSYQSQWQTNSFSNSMQPESATASLPDSFQSLGQHAISESFNSSTNSQVSFNTAETATSHYGNVNLDSSSTQGGYTASGGQQTGYKGFEPFTGHQAGYKGFEPSTGHQTSHKLFDPSAGQQAGYTGSLPSTGHQSSYMGFETSSNQGYGDANNVANSQGFVPMESMYGSHNQAHTNPQVPLSNSYLSADNSKNFSQQQFLGPNASHLQFGQSPHEERSSAGRPPHALVAFGFGGKLILMKETNSMATNYDSGNQGNSSGTVSVLNLSEVVTDKADALSASNGSALSYFHALCRQPVPGPLVGGSAASKDVNKWLDDMIALYESSTSEFQRGDPRKLLISLLKILCHHYGKLRSPFASDPSHEDTDGPEMAVTKLFSSCKRSSFQMGDFGSHVRCMKNIPSENQMQAVAQEVQNLLVSGRRKEALQCAQEGQLWGPAIILALQLGDKFYVDTVKKMAHCHFLSGSPLRTLCLLIAGQPADVFNADNNISSNYGSQQPMEPSPNGMLDDWEENLAIITANRTKGDDLVITHLGDCLWKEKNEVAAAHSCYLVAELNIDPYSESARLCLLGADHLKCPRTFASPEAIQRTEIYEYAKVLGNSQYILLPFQPYKLIYAYMLAEVGRVADSLRYCQASMKVLKASGRAPELEAWKQLFSTLEDRIRTHQQGGYGTNLAPAKLVGKIFTSLDKSISRMMGTPSAPLPPLPQGAVSDRESYTAPGATKFANSQSVMTMSSLMPSASVQSMSEMSDSGRKIAHNRSVSEPDFGRTPKQGAGSDSTQSTAPGSGSSRFGWLGSTLQKTMGFVSKSHRQAKLGQQNKFYYDEKLKRWVEEGAEIPAEEPPLPPPPSKPSFQNGVVDYKLNGPMSASHTPNGFMEGKSSTSSEHGSGMPPIPPSQNQFSARGRMGVRSSMRDERGQYHVVVWFDVIHLLRTLRDALDYDRSALVRYFSAASASFPTTGGAAAGVEKRIGGARFPQCKQPGKELETFKVSLGGLNGRYACRRAPNNCIPTTITGLNGSLSCGQVSSARSFSSSADLPPHQEIGMPSLSPTMTEGNIARWLKKEGDKVSPGEVLCEVETDKATVEMECMEESYLAKIIHGDGAKEIKVGEIIAVTVEEEGDLERFKDYKPSTSAVPAAPSELKAQPEPAEPKVKETEPSRIPEPKAPKTEEASQPGGRIFSSPLARKLAEDNNVPLSSVMGTGPDGRILKADIEDYLASVAKGGKREALAAPGLSYTDVPNTQIRKVTANRLLSSKQTIPHYYLTVDARVDKLIKLRGELNPLQESSGGKKISINDLVIKAAALALRKVPQCNSSWMSDFIRQYHNVNINVAVQTEHGLFVPVIRDADKKGLGTIAEEVKQVAQRARDNSLKPEDYEGGTFTISNLGGPFGIKQFCAIINPPQSAILAIGTAEKRVIPGSVDGQYEFGSFMSATMSCDHRVIDGAIGAEFLKAFKGYIENPNSMLL

SEQ ID NO: 75131 - protein, 177 aa, Candidatus Carsonella ruddii
MLNTKIKPFNAISYFNKKFYNINLNDLKNKWNIFFFFPFSFTFVCPTELKDISNYNLKFKEKNCNIFAISTDSHYTHKKWIDEELTFVNFPLISDFNKLISKNFNIYNKKDGNCERSTFILDKNLNIKYIEILDTNIGRSILNIYQKLLMMQFTYKNINKLCPFSWNNDNKYIEINL

SEQ ID NO: 75132 - protein, 93 aa, Nostoc sp. PCC 7120
MSVETIEKRSTSRKLAPRYRVLLHNDDHNSMEYVVQVLITTVPSLTQPQAVSIMMEAHTNGLALVITCAQEHAEFYCETLKDHGLSSTIEPDE

SEQ ID NO: 75133 - protein, 530 aa, Saccharomyces cerevisiae
MSATKSIVGEALEYVNIGLSHFLALPLAQRISLIIIIPFIYNIVWQLLYSLRKDRPPLVFYWIPWVGSAVVYGMKPYEFFEECQKKYGDIFSFVLLGRVMTVYLGPKGHEFVFNAKLADVSAEAAYAHLTTPVFGKGVIYDCPNSRLMEQKKFVKGALTKEAFKSYVPLIAEEVYKYFRDSKNFRLNERTTGTIDVMVTQPEMTIFTASRSLLGKEMRAKLDTDFAYLYSDLDKGFTPINFVFPNLPLEHYRKRDHAQKAISGTYMSLIKERRKNNDIQDRDLIDSLMKNSTYKDGVKMTDQEIANLLIGVLMGGQHTSAATSAWILLHLAERPDVQQELYEEQMRVLDGGKKELTYDLLQEMPLLNQTIKETLRMHHPLHSLFRKVMKDMHVPNTSYVIPAGYHVLVSPGYTHLRDEYFPNAHQFNIHRWNNDSASSYSVGEEVDYGFGAISKGVSSPYLPFGGGRHRCIGEHFAYCQLGVLMSIFIRTLKWHYPEGKTVPPPDFTSMVTLPTGPAKIIWEKRNPEQKI

SEQ ID NO: 75134 - protein, 554 aa, Tetragonia tetragonioides
MAFDLSYFVSNKLGMLATSDHASVVSMNLFVALLCGCIVLGHLLEENRWMNESITALIIGLGTGVVILLISGGKSSHLLVFSEDLFFIYLLPPIIFNAGFQVKKKQFFRNFITIILFGAVGTLISFTIISLGAMEFFKKLDIGSLDLGDYLAIGAIFAATDSVCTLQVLNQDETPLLYSLVFGEGVVNDATSVVLFNAIQNFDLTHIDHRIALQFAGNFLYLFFTSTLLGAMTGLLSAYIIKKLYFGRHSTDREVALMMLMAYLSYMLAELFYLSGILTVFFCGIVMSHYTWHNVTESSRVTTKHAFATLSFVAETFIFLYVGMDALDIEKWRFVSDSPGISVAVSSILLGLLMLGRAAFVSPLSFLMNFFKKSQAEKVSLRQQVIIWWAGLMRGAVSMALAYNQFTRSGHTQLRGNAIMITSTISVVLVSTVVFGILTKPLILFLLPQPKHFNSTSTVSSENLGSPKSFTLPLLGNHQDSETDIGNHQDSTDRGLGRPSSLRMLLNAPSHTVHHYWRKFDNAFMRPVFGGRGFVPYVPGSPTEQSTNNLTERT

SEQ ID NO: 75135 - protein, 457 aa, Treponema denticola ATCC 35405
MNQDIETIVKNCRIFFETNKTKSYEFRISQLLKLQEVLNQNKKELLNALYSDLHKTEMEGFFSEFAIVRGELKFAIKHLKKWIKPKRVPTSIAHFKSSSKIMYEPFGTVLIMSPWNYPLNLTLAPLVGAIAAGNCAVVKPSNYSPATSEVIKKIISENFPPEYISVITGGREENSKLLEQRFDYIFFTGGTTVGKLVMEAAAKYVTPVTLELGGKSPCVVEKSANLKVAARRIAFGKYLNAGQTCVAPDYILIQDEVKEKFIEELKEALKEFFPTETYLDMHLPHIVNEKHFDRLMGLIEGEKIITGGKGEKGRKFIEPTVLDNITFDSKIMQEEIFGPILPVISFKTIEEAIKLIKSREKPLASYLFTTDSNIEKKFLNEVSFGGGCINDTIVHLASDYLPFGGVGFSGIGKYHGDESFKVFSNAKSILKKSNLIDIKLRYHPYSEKKLNIINKMM

SEQ ID NO: 75136 - protein, 334 aa, Oryza sativa
  misc_feature (228)..(228): Xaa can be any naturally occurring amino acid
  misc_feature (258)..(258): Xaa can be any naturally occurring amino acid
MMGGFLSRVLLLAFGYAYPAYECYKTVELNKPEIEQLIFWCQYWILVALMTVMERFGDFTISWLPFYSEAKLMFFIYLWYPKTKGTTYIYGTFFRPYISQHENEIDRNLLELRARATDVVVLYFQKAATVGQNTFFDVLKYVASQSPSQRSSQQPSQEPQQPKQQQAPVQQQPTQKQAPTVLRRSASIAARQAAMAQQSQDAKTVPSSPKIKRQASTKAAPVASTKLXGAAAPSTPKSDADAPKKNEAAPASLQVATXPATKADVPASEPSAPLPEAEEADKMAIDEADDAVEGTEEGDPVPGETVEERPMEETIRVTRAKLRRRTASEDPAGN

SEQ ID NO: 75137 - protein, 530 aa, Saccharomyces cerevisiae
MSATKSIVGEALEYVNIGLSHFLALPLAQRISLIIIIPFIYNIVWQLLYSLRKDRPPLVFYWIPWVGSAVVYGMKPYEFFEECQKKYGDIFSFVLLGRVMTVYLGPKGHEFVFNAKLADVSAEAAYAHLTTPVFGKGVIYDCPNSRLMEQKKFVKGALTKEAFKSYVPLIAEEVYKYFRDSKNFRLNERTTGTIDVMVTQPEMTIFTASRSLLGKEMRAKLDTDFAYLYSDLDKGFTPINFVFPNLPLEHYRKRDHAQKAISGTYMSLIKERRKNNDIQDRDLIDSLMKNSTYKDGVKMTDQEIANLLIDVLMGGQHTSAATSAWILLHLAERPDVQQELYEEQMRVLDGGKKELTYDLLQEMPLLNQTIKETLRMHHPLHSLFRKVMKDMHVPNTSYVIPAGYHVLVSPGYTHLRDEYFPNAHQFNIHRWNNDSASSYSVGEEVDYGFGAISKGVSSPYLPFGGGRHRCIGEHFAYCQLGVLMSIFIRTLKWHYPEGKTVPPPDFTSMVTLPTGPAKIIWEKRNPEQKI

SEQ ID NO: 75138 - protein, 474 aa, Zea mays
  misc_feature (35)..(35): Xaa can be any naturally occurring amino acid
  misc_feature (48)..(48): Xaa can be any naturally occurring amino acid
MNGGAAPPSAAAAATPPHRRLPDFLQSVNLKYVKXGYNLVSVLVLSAXVLVFGATVYVLTRPRPVYLVDFACYKPPAHLQVRFEEFMRHSKLCGFSDDALEFQRKILERSGLSEETYVPEAMHALPPQPTMANARAEAETVMFGALDSLFRSTGVKPKDVGVLVVNCSLFNPTPSLSAMIVNKYKLRGNVRSFNLGGMGCSAGVIAVDLARDMLQVHRATYAVVVSTENITQNWYFGNRKSMLIPNCLFRVGGAAVLLSNRGADRRRAKYVLRHVVRTHKGADDRAFGCVYQEQDGEGKTGVSLSKDLMAIAGGALKTNITTLGPLVLPVSEQLLFFATLVAKKLLSAKTKPYIPDFKLAFEHFCIHAGGRAVIDELEKNLQLSPAHVEASRMTLHRFGNTSSSSIWYELAYMEAKGRVRRGHRVWQIAFGSGFKCNSAVWHALRNVKPSPDSPWEDCIDRYPVELVDGFPTHQ

SEQ ID NO: 75139 - protein, 390 aa, Nostoc sp. PCC 7120
MQFAKRLEKIPPYLFAEINRKREALIAKGVDIINIGVGDPDKPTPAHILQAMREAIDDASNHNYPPYEGTQEFREAAVEWMERRFGVMDLNPNTEVVSSIGSKEAIHNTFLAFVEAGDYTLIPDPGYPVYRTSTIFAGGEAFSMPLKAENKFLPDLDLIPEEVARKAKMLWINYPNNPTGALATLEFFEELVALCQQYSILLCHDHAYSEMAYDGYKPPSVLQIPGAKDIAIEFHSLSKSYNMTGWRIGFAVGNAYAIKGLSQVKTNVDSGVFKAIQKAAIAAYATDEVELQAVMSVYQSRRDIIVKGLQSLGWPIEPPKATLYVWVPVPPGYTSTEFTTLLLDKCGIVVPPGVGYGASGEGYFRVALTISDERLHEAIQRMQDAGIRYA

SEQ ID NO: 75140 - protein, 479 aa, Glycine max
MMENGGKQTFEVSNDTLQRVGSKSFDDDGRLKRTGTIWTASAHIITAVIGSGVLSLAWAIAQLGWIAGPVVMILFSIVTYYTSTLLATCYRSGDQLSGKRNYTYTQAVRSYLGGFSVKFCGWVQYANLFGVAIGYTIAASISMMAIKRSNCYHSSGGKNPCKMNSNWYMISYGVSEIIFSQIPDFHELWWLSIVAAVMSFTYSFIGLGLGIGKVIGNGRIKGSLTGVTIGTVTESQKIWRTFQALGNIAFAYSYSMILIEIQDTIKSPPAESETMSKATLISVLVTTVFYMLCGCFGYASFGDASPGNLLTGFGFYNPFWLIDIANAGIVIHLVGAYQVYCQPLFSFVESNAAERFPNSDFMSREFEVPIPGCKPYKLNLFRLVWRTLFVILSTVIAMLLPFFNDIVGLIGAIGFWPLTVYLPVEMYITQTKIPKWGIKWIGLQMLSVACFVITILAAAGSIAGVIDDLKVYKPFVTSY

SEQ ID NO: 75141 - protein, 148 aa, Brassica napus
  misc_feature (17)..(17): Xaa can be any naturally occurring amino acid
CRLTSLAVTHTNWTCLXKHEWGDIFDIIKRTRLLRGEGESKLLMIGGLKSTFSLNPACSTILILRLCLESLEWEEAGRMPLEMYRGFQESSKFKVFGGGDRVYFSAKRMGKLAMWDCWEGWRWVDGVSGYGDGLCRGFVFEAKLTLMQ

SEQ ID NO: 75142 - protein, 276 aa, Treponema denticola ATCC 35405
MSQTCNHECEGCNLTCNERTAAPNSFIESPNKLSSIKKVIAIISGKGGVGKSLITSLSAVQSQKKGYQCAILDADITGPSIPKAFGISGTVVGNDSGIFPAKTKTGIDIMSVNLLLENETDPVIWRGPVIAGTVKQFWTDVIWKDIDFMFIDMPPGTGDVPLTVFQSIPVDGIIVATSPQELVSMIVAKAVNMAKKMNIPIIGLVENFSYFTCPDNGKDYHIFGESGIDEIALEYGIPVLAKLPIDPEIAKACDKGKIENIDAPWFNPIVECIAKL

SEQ ID NO: 75143 - protein, 435 aa, Debaryomyces hansenii CBS767
MASQIHFLDIKGKTLLSRDYKGDIPSNTIEKFPLLLLDLENDENNEESNYKPFVNYQGINYIYINHNNLYVCALTRKNDNVMAIIVFLSKLIEVLTEYFKVLEEESIRDNFVIIYELLDEMMDFGHPQTSDTQILKQYITQDYFKLIRKTSLRLVQPPNAVTNSVNWRSEGIVYKKNEAFLDVVESINMLINAQGQVLNSEILGEVKIKSHLSGMPDLRLGLNDKGIFNNESNNKNIDLEDIKFHQCVRLSKFENEKIITFIPPDGEFTLMSYRLSSNQFLVKPLILVNCKTKVHKHSRIEILCSVKAQIKKRSVANNVEIVIPLPDDADTPKFTPEYGTVKWIPEKACLIWKLKTFPGGKQFHMRAELGLPSVVDSETILSKKPIKVNFSIPYFTTSGIQVRYLRINEPKLQYQSYPWVRYITQAGEDYTVRLK

SEQ ID NO: 75144 - protein, 196 aa, Brassica napus
MGKAKKPQKFAVMKKTISHKALKHYKEEVLNPNKKDLTELPRNVPNVPSGMFFSHNTNMVPPYRVLVDTNFINFSIQNKIDIEQGMMFCLNAKCTPCITDCVMAELEKLGQKYRVALRIAKDPRFERLPCVHKGTYADDCLVDRVTQHKCFMVATCDRDLKRRIRKVPGVPIMYLAGRKYSVERLPEATLGRAPRY

SEQ ID NO: 75145 - protein, 169 aa, Thiomicrospira crunogena XCL-2
MSSKELQEGQDGLVEKLVSVRRVAKVVKGGRVFGFSALTVVGDGEGRVGYGSGKANEVPVAIKKAMEKARRNMKDVHLDGGTLQYPINFKQGAANIVMLPASDGTGIIAGGAMRAVLEAAGVKDVLAKCVGTTRPVNVVRSTVNALTGMSSPELIAAKRGKSVEEILGE

SEQ ID NO: 75146 - protein, 379 aa, Synechococcus sp. RS9916
MTSATPTVPAVLVLADGTVFEGLACGSRGSVVGEVVFNTGMTGYQEVLTDPSYSGQLVTFTYPELGNTGVNAEDQEADVPHARGLIARQLAPLPSNWRCSQTLPEWLDQHGVVGIHGIDTRALVRHLRDTGAMNGVISSDGRSPQVLLEELKSAPSMQGLNLADRVSTAEPYTWTSACAASFDQRLKPRPEHPYRVVAIDFGIKRAILDRLVGHGCEVTVLPASSSLETVLSHEPEGVFLSNGPGDPSAVTGGIALAKDLVEHKSLPLFGICLGHQILGLAMGGTTFKLDFGHRGLNHPCGTTGQVEITSQNHGFAIDAQTLPASVEVTHLNLNDRTVAAMAHREQPLFGVQYHPEASPGPHDADHHFGRFVALMAERR

SEQ ID NO: 75147 - protein, 339 aa, Arabidopsis thaliana
MSTTSLQTIGAIKSYHHQAQHLVKNYLLADPFIPYTSVLTGIFLCKVVYDLCHFISNSHSKTYIILTKIQRIEWNNRFLNRFVLFGSGISTVHAIFISAMSLYFVFWSDLFSDRWHNDLVVFRSSRLSSLGLGISIGYFLADLGMIFWKYPSLGGIEYIVHHSLSGVAVAYSLFSGEGQLYTYMVLISEITTPEINLRWYLDTAGMKKSLAYVVNGVFIFLAWLVARILLFIYMFYHVYLHYNQVMRMHIFGYVLQRDVNVEIGESSSHRFFTSSSPYFFVPLTYACLSSGFDSISATFRLTGVRYSTTKMMNNCLVFKFYGRENIWSPVYYFFVQYSQ

SEQ ID NO: 75148 - protein, 337 aa, Ajellomyces capsulatus
MVVKVGINGFGRIGRIVFRNAIEHGEVDVVAVNDPFIETHYAAYMLKYDSTHGQFKGTIEVNSNGLTVNGKAVTFYQERDPANIPWGKHGVEYVVESTGVFTTTEKASAHLKGGAKKVIISAPSADAPMFVMGVNEKTYDPSVNVLSNASCTTNCLAPLAKVINDNFGLTEGLMTTIHSYTATQKTVDGPSSKDWRGGRTAAQNIIPSSTGAAKAVGKVIPSLNGKLTGMSMRVPTANVSVVDLTCKTEKPVTYDQIKQTIKKASEGELKGILGYSEDALVSSDLNGDSRSSIFDASAGIALNDHFIKLISWYDNEWGYSRRVVDLIAYIAKVDAGK

SEQ ID NO: 75149 - protein, 576 aa, Schizosaccharomyces pombe 972h-
MSQKSQFAYRSSKSIGLVNASENYASPPKFEAISEPARNACYSPNGKLFAYATATQVVINDTESGAKLTQLPAANTYELGFSPLGKYLSTWERPGKEADGTPKQNMKVWNTETGQLVFSFVQRNQTGWNLQYTCDESLAARLVTNEVHFYETGNMSKGPIAKLRVEGISDFALSPGQNHAVAVFIPEKKGAPASVRTYSIPNFNSPLSQKTFFKADKVQFKWNALGTSLLVLTQTEVDKSNKNYYGETNLYLLGITGQFDCRVDLDREGPIHDVCWNADSKEFGIVYGYMPAKTAIFDNRANVVSIIPPAPRNTLIFSPNSRYILLAGFGNLQGSIDIFDAANNMKKITTVEAANCTYCEFSPDSQFLLTAVTSPRLRVDNSIKIWHITGAPMFYEEFNELYQAFWRPRPLNPTLLQNALTSASLPSPPTPHASASKLAAKPSVKPAGAYRPPGARGQNSTFSYRREEIDVMSSGSANKHVNSSRQRVVPGATPVIDGNKKNNKKTKPAVKQVAQPTAEVSDEKKIRSLCKKLRAIDDLKSRLNNNEKLEATQVKKIESEGKVLAELKALGWTPDA

SEQ ID NO: 75150 - protein, 278 aa, Shewanella sp. MR-4
MPPIDIEDTRENAMSIVIKTAEEIEKMRAAGKLAAQVLEMIAPYVKAGVSTNELNDICAKYTEEQGAISAPLNYHGFPKSICTSLNNVICHGIPSDRVLKDGDILNIDITVIKDGYHGDTSKMFLIGEVSPKDKRLCRIAQESLYLAIRKVRPGLKLGEIGNTIEKFIKASKTGLEKYSIVQDYCGHGIGAGFHEEPQVMHYRNGDNTILRPGMCFTIEPMINAGRHTTVLDRDDKWTVTTSDGKNSAQWEHTLLVTETGVEVLTLRDEEDFPRIINH

SEQ ID NO: 75151 - protein, 435 aa, Pyrococcus woesei
AKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 75152 - protein, 226 aa, Nitrosomonas europaea ATCC 19718
MYRIAPSILSANFARLGEEITQVLDSGADIIHFDVMDNHYVPNLTIGPLVCEAIRPLTQAMIDVHLMVEPVDRIIPDFAKAGANIISFHPEASRHIDRTIGLIKEQGCKAGLVFNPATPLSYLDHVLDKLDLILIMSVNPGFGGQTFIPEALNKLRLTRERITASSRDILLEIDGGVKVDNIAEIARAGADTFVAGSAIYGAGKESDPHRYDSIIAAMRAELAKVA

SEQ ID NO: 75153 - protein, 250 aa, Brassica oleracea
MVKIEVGSVGDSFSVASLKAYLSEFIATLIFVFAGVGSAIAFGKLTSDAALDPAGLVAIAVAHAFALFVGVSIAANISGGHLNPAVTLGLAVGGNITLITGFLYWIAQCLGSIVACLLLVYVTNGESVPTHGVGAGLGALEGIVMEIVVTFALVYTVYATAADPKKGSLGTIAPIAIGFIVGANILAAGPFSGGSMNPARSFGPSVVSGDLSQIWIYWVGPLVGGGLAGLIYGDVFIGSYQEVETCEIRV

SEQ ID NO: 75154 - protein, 177 aa, Candidatus Carsonella ruddii
MLNTKIKPFNTISYFNKKFFNINLNDLKNKWNIFFFFPYSFTFICPTELKDISNYTFKFKEKNCNIFAISTDSHYTQKKWVETELNFVNFPLISDFNKNISKNFNIYNKKDGNCERSTFILDRNLNIKYIEILDINIGRSINDIYQKLSMIQFTNKNINKLCPFSWIKDGKHIDLNL

SEQ ID NO: 75155 - protein, 388 aa, Arabidopsis thaliana
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVTALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNVCA

SEQ ID NO: 75156 - protein, 177 aa, Candidatus Carsonella ruddii
MLNTKIKPFNTISYFNKKFYNINLNDLKNKWNIFFFFPYSFTFICPTELKDISNYNLKFKEKNCNLFAISTDSHYTHKKWIESELTFINFPFISDFNKLISKNFNIYNKKDGNCERSTFILDKNLNIKYIEILDNNIGRSIHNIYQKLIMMQFTYKNINKLCPFSWNNDNKAIGINL

SEQ ID NO: 75157 - protein, 290 aa, Nostoc sp. PCC 7120
MTLSVAHLGPPGTYAEQATIFYVKWLTHNTGLEAVLHPYSSIAQSLQALAQGETQLAVVPVENSIEGSVTMTMDTMWQMDSLQIQSALVLPIAHALISCANSLAGIKTVYSHPQALAQCQGWLREFLPDVQLIPSNSTTEALEKLEQDLAVGAIASSRSAELYNLPILASRINDYPENCTRFWAISHAESGITHQLPLQKLTHTSIAFSVPANVPGALLKTLQVFAHLDINLSRIESRPTKRSLGEYLFFIDLEADVNTPQMKSALVELTTYTEVLKIFGSYSVISANNQ

SEQ ID NO: 75158 - protein, 537 aa, Aspergillus oryzae
MALFTFRLLPLVCTASIAIYVLSRFMHFETKSTGALTYSITFIIYLLYWLYIYPYHLSPLRHVPTVPGCPLWGHVFEIFNAEIGAVQQKWHKTHGPIVRYFYPFGKEILSVVDNSALKHILVEASYNYEKTASNRKFLSRLFGEGILTAGGKVHAQQRKALNPAFSISAIKALAPAFWDYSCSMSSYWEQDIKESSDDSVSLDISDWASRATLDIIVAVGFGAKIDTLHNSTAPLIEAFRTVFRFDAVAKLLAVLHILFPIVRYLPIKENREVDAAKRTLFEFASGLIQEKEANINSTGNNILSQLVRGDRKPQAAGEDIFSRVICDQIATFLGVGQDTSATWLSWTLHLLSKHQHMQVKLREEIRSHFPFLFRGATHEKIDFTEVDVDRLPYLNNVCRESLRFIPPIPFVSREAARDERLGEYFIPKGTVIHIPINTIHRMPEYWGPNSNAFDPDRWNCLPASYTNNAFLPFTQGPRGCIGRKFADTEVKTILCCLLSKFQFSPDPAVQDPEELKRYRIVQKSQYGIRLKVSKLDG

SEQ ID NO: 75159 - protein, 167 aa, Phaseolus vulgaris
FFFFTIGFLTLPLVAYPTRTHWRSLYKLLSLLPLAYSVLILPLVSESPRWLLIRGRTKEALQVLDRFARLNGKQKLPTNLTLTNPSGSSNVAPCTTSEGGERTPNNKENLWTTKWAAIRMVTVMLAGFGVGFVYYGVQLNVENLNFNLYVSVALNALMEIPAVVIGS

SEQ ID NO: 75160 - protein, 436 aa, Methylomicrobium sp. AMO1
MKIFDEIESEVQSYARSFPRIFNKAKGEFLYDEEGNEYIDFLAGAGTLNYGHNNPVFKEKLLDYIHSDGITHGLDLHTKAKGEFLETFNEKILKPRGLEYVMQFTGPTGTNAVEAALKLARNVTGRENVVSFTNGFHGVSLGSLAATGNSHHRGAAGVSLNGTSRMPYDGYLGDDIDTTAYLDKVLSDSSSGVDLPAAVIVETVQGEGGINAASFEWLKNLDQVCKKHGVLLIVDDIQAGCGRTGTYFSFEEVGIYPDIVTLSKSLGGYGLPFAVVLIRPELDQWKPGEHNGTFRGNNFAFVTAKAAIDHYWSDNRFADQIKQKGEYVSSRLNKIVDLYGEGNFTTRGRGMFQGINCVNGDLAGKITRRAFQLGLVIETSGADDHVVKFLCPLTIAEASLKKGIDIVEQAIKEVCAKESSIPQEKNYFEADYKLAS

SEQ ID NO: 75161 - protein, 130 aa, Picea sitchensis
MAGRMMGMLRGGMVARSASGSLRLRSGMGMPVGTTPPPDKPLHIQHELIWDDGSAYPEPALDRIAAPQIGKYEALAWLCGGLSFFGLVGLLAVWNDKASKIPYTPKEYPFDNLRVELGGDPNVKRTTASV

SEQ ID NO: 75162 - protein, 240 aa, Oryza sativa Indica Group
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASYNNFPTAAGLASSVAGLVCFVFTLGNLMNVKEDYGELSSIARQGSGSACRSIYGGFVKWCMGKNNDGSDSIAVQLADEAHWNDLVIIIAVVSSKQKETSSTSGMRDSVETSPLLQYRAQRK

SEQ ID NO: 75163 - protein, 240 aa, Thiomicrospira crunogena XCL-2
MSPLFERSLLVFEEQGIKQLQNSHVLVAGVGGVGGFVIEALARAGVGKMTIVDHDSVSPSNLNRQIIALESTLGQNKAEVMKQRIYDINPACEVVTIQSFLKPDDMNELLADDFNYVVDAIDSLNCKVALVATAYQRGLKVVSSMGAGRRIDPSKILIEDISKTHTCGLARNMRQRLKKQRIAKGVPVIFSTELPKAPGPMEEIEGARGRVVNGTASYMPGIFGLMLAGLVIQDLAKTDS

SEQ ID NO: 75164 - protein, 405 aa, Arabidopsis thaliana
MNSILSSVLPAPEDPVLSVIFACRDDPSPVKLNLSAGTYRTEEGKPLVLDVVRRAEQQLANDLSRDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 75165 - protein, 200 aa, Fulvimarina pelagi HTCC2506
MRASALDDAEKRRQANAKRETRHMPIYQLEDDKPDIAGDEPHFIAPGAHVIGRVRFGRNVGVWFNAVIRGDNEWMEIGDDTNIQDNCTLHSDMGFPLTIGKGCTIGHNAIVHGCTLGDNVLIGMGATILNGAKIGDNSIVGANALVTEGKSFPPNSLIVGSPAKAVRELDDTAAAKLKESAQHYVRNAQRFADSLTEILG

SEQ ID NO: 75166 - protein, 329 aa, Pichia pastoris
MADKGSVAAKSLTNSAPLSIFSYCAASILMTVTNKYAVSGVDFNFNFFLLAVQGIVCITLISSLKQLNVITFREFNKVEAKKWFPIAVLLVVMIYTSSKALQYLSIPIYTIFKNLTIILIAYGEVIWFGGRVTNLALGSFVLMVLSSAVASYGDSNVDTGKLNFNIGYFWMFTNCFSSAAFVLFMRKRIKLTNFKDFDTMYYNNLLSIPILLFASLTTEDWSAKNIAQNFPEDTKYAVIASMIISGMSAVGISYTSAWCVRVTSSTTYSMVGALNKLPIALSGLLFFKAPINFYSISSIFIGFAAGLVYAIAKQKQKKEDELQLPTDKS

SEQ ID NO: 75167 - protein, 395 aa, Flavobacteria bacterium BBFL7
MKNNLSDRINNLPVSATLAMAAKARELREQGKDIIGLSLGEPDFNTPDFVKDAAIQAINENYNSYTPVDGYVELKDAIILKFKRDNNLEYTRDQIVVSTGAKQSIANVAMVLLNEGDECILPAPYWVSYAAIVQLAEGVPVEVRAGVEQNFKITPDQLRAAITPRTKMILFSSPNNPSGSVYSKNELEELAAVLKDHPQIVVVSDEIYEHINYGDGHASMASVNGMYDRTVTINGVSKAFAMTGWRVGYIGAPAWIARACNKMQGQITSGTNCIAQRAVITALEAPVSEIQYMVDAFHKRRDLILELLSKIHGFITDIPEGAFYVFPDISSFFGKTIKGHKIENATDFSLLLLEEALVATVTGDAFGAPNCIRLSYAASEDQITEAIKRIDEVLS

SEQ ID NO: 75168 - protein, 212 aa, Zea mays
  misc_feature (185)..(185): Xaa can be any naturally occurring amino acid
FVLEVRNVIGDRGLEVVGDTCKKLRRLRIERGDDDPGLQEEQGGVSQLGLTAVAVGCRDLEYIAAYVSDITNGALESIGTFCKNLYDFRLVLLDRQKQVTDLPLDNGVRALLRSCTKLRRFALYLRPGGLSDTGLDYIGQYSGNIQYMLLGNVGESDHGLIRFAIGCTNLRKLELRSCCFSEQAXSLAVLHMPSLRYIWVQGYKASPAGLEL

SEQ ID NO: 75169 - protein, 600 aa, Nitrosomonas europaea ATCC 19718
MAISENKTMTQFIKVTLPDIGDFQEVPVVEILVSPGDEVEQETPLLVLETDKASMEVPAPQAGIVREIHVKAGDRISQGSLIVTLETRETDTQVASPTPPRDTMAVPDSQPTITSAAEATAGKVALASVADRGDIHAEVVVLGAGPGGYTAAFRAADLGKQVVLIERYPALGGVCLNVGCIPSKALLHAAKTLTEAKEASLYGIRFGQPEIDVGKLRSWKESVVGKLTKGLSMLARQRKVTVIHGTGKFVNPHLIEVETSDGIKTISFDHCVIAAGSSAARIPGLPADERIIDSTGALALAEIPERMLILGGGIIGLEMATVYHALGTRISIVERMAQLIPGADTDLIKPLYKKLKTECEAIYLNTSVSRVEADKEGLQVFFEGEQAPEPQRYDRVLVAVGRRPNGKLIDAGAAGINVDERGFIPVDKQMRTSVPHIFAIGDIAGDPMLAHKASHEGKIAAEVIAGHKVTFDARTIPSVAYTDPEVAWMGLTETEAEKQGIAYEKAVFPWAASGRAITMTRDEGMTKLLFDKVSKRILGAGMVGPHAGELIAETVLALEMGADMQDIGLTIHPHPTLSETILFAAELAEGTITDLYVPKK

SEQ ID NO: 75170 - protein, 321 aa, Fulvimarina pelagi HTCC2506
MAADGKETPGKVLVFGSLNIDLVCRVERIARPGETVLGPSYEQLFGGKGANQAVAAARSAASGISVRMIGAVGPDDFGTAIIANLEANGIDAGSILRTQEPTGAAFIAIDSGGENAITVASGANRVLGADALVGAQLSERTILLLQMESPLDETIAAARRAQEVGGRTILNLAPVPANLTAESLRKLTEAIEWLIVNELELDAAARALDLKAGSITDLASTVGQALDVNVIATLGANGVVTITKDGESFIEPAMSVAIEDTTGAGDTFCGVFAASLAAKLEIHLAVRRATTAASLACRRTGAQTAMPTFEEITAALNAPLP

SEQ ID NO: 75171 - protein, 243 aa, Flavobacteria bacterium BBFL7
MAQEVKPYNEEDSSKKEQVTKMFDTISGEYDGLNRMISLGLDQKWRANVVDMVAATNPDSIMDIATGTGDLVIQMAQKTSASRLIGLDISSGMLEVGKIKVKKEELDNRIEMVLGDSEDLPFEDNSIDAVTVSYGVRNFEDLEKGLSEIRRVLKPQGILVILETSVPTKFPFKQGYYVFSKLVVPTIGKLFSKDKIAYGYLQKSASTFPYGDRFNNILKKVGFNNVEHFLQFHGASTIYKAIK

SEQ ID NO: 75172 - protein, 356 aa, Arabidopsis thaliana
MIGAVNSVEAVITSIQGLSGSPEDLSALHDLLRGAQDSLRAEPGVNFSTLDQLDASKHSLGYLYFLEVLTCGPVSKEKAAYEIPIIARFINSCDAGQIRLASYKFVSLCKILKDHVIALGDPLRGVGPLLNAVQKLQVSSKRLTALHPDVLQLCLQAKSYKSGFSILSDDIVEIDQPRDFFLYSYYGGMICIGLKRFQKALELLYNVVTAPMHQVNAIALEAYKKYILVSLIHNGQFTNTLPKCASTAAQRSFKNYTGPYIELGNCYNDGKIGELEALVVARNAEFEEDKNLGLVKQAVSSLYKRNILRLTQKYLTLSLQDIANMVQLGNAKEAEMHVLQMVLCPTLDFWKLALLV

SEQ ID NO: 75173 - protein, 365 aa, Oryza sativa Japonica Group
MPLSYSAAAAAAPSPLAARSRGLLRRPPRSSPVVVRCKKIDQLRAVNGIPPYAPVSNRSLLSPVTLPIIRDANIKNDTRLRIFSGTANPSLSQEIASYLGLELGKINIKRFADGEIYVQLQESVRGCDVFLVQPTCPPANENLMELLIMIDACRRASAKNITAVIPYFGYARADRKSQGRESIAAKLVANMITPVILDYLASKTICSDDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEDKSFPQLTILSVANLLGETIWRVHDDCSVGHEPYSSLDID

SEQ ID NO: 75174 - protein, 502 aa, Cryptococcus neoformans var. neoformans JEC21
MSTLSYDDKMGYLPEQDIDTTIHAAPLAELETPKKRKWMQTLSVLIAGVALFSDGYNIQITGYTNTVMAKLYPTALNSTMKTRLSNSILIGDIFGMILFGLCADRLGRRWGIIGCTFFLVLGVTLATAAHGKSEVGMLWMIVIGRGVAGLGAGGEYAVCTTSAVEAADETHTLRKKRGLLVASSTNTAIIAGFVASAIVFLIVLAAYGGEPHVGVWRICFGIGIIMPLSIFLFRVRMADSTLYSKHSIKSPKFPYWLAFKRYWKPLLGCSLVWFLYDAVVYPFNLLAPTITAGFSSNQSLLASNGWGALVNAFALPGAFFGGFIIDRLGPRQTYAFGLVMVAIFGFVIGGAMEPLRNNGTGAFAAFVILFGLFQCFLSVGPGNCNFIVSSESFPTPVRGHALGLAAAIGKAGAAVGTQVFPLIEARFATTLKGQQAIFLIGSGICVVAAIVVMTIVPNRRAQLEDEDVEFRRYLEENGWDTSDMGSVGRIVSDEVVERGEKV

SEQ ID NO: 75175 - protein, 290 aa, Hordeum vulgare subsp. vulgare
MEGKEEDVRLGANRYSERQPIGTAAQGGGDDKDYKEPPPAPLFEPGELKSWSFYRAGIAEFIATFLFLYVTVLTVMGVSKAPSKCATVGVQGIAWSFGGMIFALVYCTAGISGGHINPAVTFGLFLARKLSLTRAIFYIIMQCLGAICGAGVVKGFQQGLYMGNGGGANVVASGYTKGDGLGAEIIGTFVLVYTVFSATDAKRNARDSHVPILAPLPIGFAVFLVHLATIPITGTGINPARSLGAAIIYNRDHAWNDHWIFWVGPFVGAALAAVYHQVIIRAIPFNKSRS

SEQ ID NO: 75176 - protein, 177 aa, Candidatus Carsonella ruddii
MLNTKINSFKSIAYFKKKFFEITDKELKNFWNVLFFFSFSYTYICPTELLELSKNINLFKNLKCNIYAISTDSHYTHKNWIENEINFINFPFISDFNHKTSKNYKILNKNDGNCYRSTFIIDPNLIIKSIEIIDISISRSIQEILNKIKMLIFTFKNKNKLCPYNWLKDNNSIDINL

SEQ ID NO: 75177 - protein, 182 aa, Glycine max
MASKIFYLLSLLLLAHLLQPHVFVKGDGSLIEKTCKNTKYYNLCFSSLKSNPSSANADPKGLAVIMVGIGMANATSTSLYLSSKMLGTANNNDSTFKRVLKECAEKYKYASDALQASAQDLVNEAYDYASMHIIAAYDYSNVCHNLFKLYSGLVYPSELAPREDGLKCLCDVALGIVENLNR

SEQ ID NO: 75178 - protein, 140 aa, Nostoc sp. PCC 7120
MAQTQETTTKTHTLPLPTTITSRGVAATELRPWGSFTVLEEGRGYKIKRIEVKPGHRLSLQMHHHRSEHWIVVSGTARVVCGEKEILLGNNQSTYVPQCTAHRLENPGVIPLVLIEVQNGEYLGEDDIIRYQDDYSRTSN

SEQ ID NO: 75179 - protein, 366 aa, Desulfotalea psychrophila LSv54
MSDPIFAKRLRACPLIGAGVICFFATIFCLAESNAAESIMKNREDLSITTLAGGCFWCLEADLEKLPGIVDVVSGYSGGDQKNPSYEEVSTGRTGHLEAVQIRFDPEVISYEEILQRFFRLHDPTDAGGSFVDRGRQYSSAIFYHDEVQKEIAERVRDELAPTFSRPIVTELISFRAFYPAEDYHQNYSLKSPQAYARYRSLSGRDSFIEAIWGSAGEMNYEKMSDDQLRKRLTALQYEVVREDGTEPPYDNAYWDNKRAGIYVDIVSGEPLFSSRDKYKSGTGWPSFIRPLVAENVVELKDNSFFLRRTELRSLHADSHLGHLFTDGPAPTGLRYCINSASLRFIPREVMQAEGYGEYLSSFLHN

SEQ ID NO: 75180 - protein, 421 aa, Mycobacterium leprae TN
MALVVQKYGGSSVADADRIRRVAERIVQTKKQGNDIVVVVSAMGDTTDDLLDLAQQVCPEPPARELDMLLTAGERISNALVAMAIESFGAQARSFTGSQAGVITTGTHGNAKIIDVTPTRLQFALDEGRIVLVAGFQGVSQDTRDITTLGRGGSDTTAIAMAAALGADVCEIYTDVDGIFSADPRVVHNARKLDTVTFEEMLEMAACGAKVLMLRCVEYARRHNIPVHVRSSYADKPGTVIVGSIKDVPMEDPILTGVAHDRSEAKVTIVGIPDIPGYAAKVFRAVADADVNIDMVLQNVSKVEDGKTDITFTCSRDSGPIAVAKLGSLRDEIGFTQLLYDDHIGKVSLIGAGMRSHPGVTATFCEALAAVGVNIELISTSEIRISVLCRDTELDKAVFALHEAFGLGGEDEVTVYAGTGR

SEQ ID NO: 75181 - protein, 539 aa, Arabidopsis thaliana
MTREKVMWEPELHKVFVDLCVEQKMLGFRLPGLNRIWESFVQNTGARFTRDQLKNHWDTMLRLWRAWCRLVECSEMKWDPQTKKFGASTEVWTNYFRVNPKAKQYRFRSSPPPFLKDLKMIFEGTDLGDEEGTSCGKRKRIPDADNDTGDEDNDTGDDDNYTGDDDITIPRYKAYWSSSSHEIFVDLLFTESLKENRPKPARRNGYYAKETWNMMVESFNQKTGLRYTRKQLKNHWNITRDAWRRWCQAVGSPLLKWDANTKTFGATSEDWENYSKENKRAEQFRLKHIPHADKLAIIFKGHVEPGKTALRPYRKRVNHHSEAPQHPAPSSALNINESVPGSEGGADDDHHIVMDHHFESPHDPASSSEIDLNEPVTGSEGGADDDHYIVLNHLVESPHDRAPSSELDINKPVAGIEGIADDNDNHEPTPHHWAFNGVGVEESQDVETVTPAPCERINIELVEKITSNALVKEYEYTIGECMKCLNAMEEVEKGSELYMLALDLFMNKECREMFLLLETSTLRMSWLLRRLSGGSTMAA

SEQ ID NO: 75182 - protein, 277 aa, Yersinia pseudotuberculosis IP 32953
MTMQPLIKLHDGRLMPQLGLGVWQASIQETELAVSKALEVGYRSIDTAAIYKNEEGVGKALKAAAVARDELFITTKLWNDDQHNPQQALETSLQKLQLDYIDLYLIHWPDPKQDHYVSAWRELVTLKEQGLIRSIGVCNFHIPHLQRLIDETGIAPTVNQIELHPLLQQRQLHAWNATHHIATESWSPLAQGGKGVFDQEIIRKLAQQYNKTPAQIVIRWHLDSGLIVIPKSVTPARIRENFEVFDFKLQKEELLAITKLDCGKRLGPDPEVFGSDR

SEQ ID NO: 75183 - protein, 145 aa, Oryza sativa Indica Group
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASYNNFPTAAGLASSVAGLVCFGKVYYF

SEQ ID NO: 75184 - protein, 151 aa, Triticum aestivum
  misc_feature (3)..(3): Xaa can be any naturally occurring amino acid
GIXQLLAAEQEAQQIVNAARAAKTARLRQAKEEAEREIAEYRAQMEADFQRKLTETSGDSGANVKRLEQEDKRKRFEQLKATREAKQSSSKRVVQKCFWRAPSTNWKEKGLIESSPGIMMGKLLPNPGQFLGGGYIGFLPTSLVPWVGLGK

SEQ ID NO: 75185 - protein, 561 aa, Saccharomyces cerevisiae
MAGNMSNLSFDGHGTPGGTGLFPNQNITKRRTRPAGINDSPSPVKPSFFPYEDTSNMDIDEVSQPDMDVSNSPKKLPPKFYERATSNKTQRVVSVCKMYFLEYYCDMFDYVISRRQRTKQVLEYLQQQSQLPNSDQIKLNEEWSSYLQREHQVLRKRRLKPKNRDFEMITQVGQGGYGQVYLARKKDTKEVCALKILNKKLLFKLNETKHVLTERDILTTTRSEWLVKLLYAFQELQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEINYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGLEHSDPFSTFY

SEQ ID NO: 75186 - protein, 471 aa, Treponema denticola ATCC 35405
MKKTKIVCTIGPASDSERVLAEMFKAGLNVCRLNFSHGSHEEHKVKIDRIKKIREELKMPIALLLDTKGPEIRLGLFEKPVEIVQGQEFIITTRDVIGTNQICSISYKNIAAEIKPKSRILINDGLLELQVIDILNDTDIECVAVNSGTLSSRKGVNIPGLRVNLPYMSEKDISDIEFGIENDVDFIAASFTQRADDIIQIRKLLEKHKSTIAVIAKIENQEGLDNIDEILAEADGIMVARGDMGVEIEPEKIPHLQKQLIKKANLAGKPVITATQMLESMTHNLRPTRAEVTDVANAILDGTSAVMLSGETAAGEYPVETVAMMTSIANSIEETLDYEKLFAENASLHETTITNAIARATCSTALALDANAIITASASGITPRALSKFKPRVPIIAITESPQVMRKMALDWDVYPVLADPIKSTDNMFDVCSQIAKDTGHVKKGDIAILTAGIPIGKAGSTNLLKVEIIE

SEQ ID NO: 75187 - protein, 201 aa, Thiomicrospira crunogena XCL-2
MARGVNKVILVGTLGRDPEIKYAANGNAIANLNVATSEQWNDKASGQKQEKTEWHRVVIFGKLAEIAGQYLTKGSQVYLEGKLQTRKWQDQNTGQDRYSTEVVIDFNGQMQMLGGGNRQGSDAPFDNNASGFGQQAPQAPQQNNMGMNNQPQQTQPGFGQTAPQQQAAPQQGFGGQPNNPAPAQQVPAYTANDFDDDDVPF

SEQ ID NO: 75188 - protein, 155 aa, Picea sitchensis
MASTTLSASVVPVALCGGAKAAGGLRQTAPSMVSLKAFNSNMGQSLFGVKASRARVTAMATFKVKLLTPEGEKLIECPDDVYVLDAAEEAGIDLPYSCRAGSCSSCAGKVLEGEVDQSDGSFLDDDQIGEGYVLTCVAYPTADVTIETHKEEALS

SEQ ID NO: 75189 - protein, 425 aa, Pseudomonas syringae pv. syringae B728a
MAFLALGINHKTASVDVRERVAFTPEQLVEALQQLCQLTQSREAAILSTCNRSELYIEHEHLGADSILAWLANYHHLSLEELRASAYVHEDDAAVRHMMRVASGLDSLVLGEPQILGQMKSAYAVAREAGTVGPLLGRLFQATFSAAKQVRTDTAIGENPVSVAFAAVSLAKQIFSDLQRSQALLIGAGETITLVARHLHDLGVKRIVVANRTLERASMLAAEFGAHAVLLSDIPAELVNSDIVISSTASQLPILGKGAVESALKLRKHKPIFMVDIAVPRDIEPEVGELDDVYLYSVDDLHEVVAENLKSRQGAALAAEQLVSVGAEDFMSRLRELAAVDVLRAYRQQSERLRDEELSKAQRMLANGSNAEDVLIQLARGLTNKLLHAPSVQLKKLSAEGRVDALAMAQELFALGEGSTDKPPQ

SEQ ID NO: 75190 - protein, 469 aa, Magnaporthe grisea 70-15
MVLRACFDVKRIAVIGAGPCGLAAAKYLVAQKAFSEIVVFEQAAEVGGVWNYSKTPSSTLHVPQTNPLCAPDPPVFPDKEGPAMFPSPMYDLLHTNIPRTIMGFKDLELSAGVAFPHRDEVQAYLVKYSQDVRHLIKFSTIVKDVRLRQGTEIDQWDVRTESSTGGNPQMQTFDAVVVASGHYSTTYMPRIPNIEDFHKTHPAVITHSKTYRSPSIYTGKKVIVVGNSASGVDIAAQIQRVAGKVFLSVREATASDSLAHIGAEETPPISEFLVKEKGVQFEDGRVEKDIDSVVFCTGYLFAFPFLESLATPLLTDGRRVHGLYKDFLHIKHPTLVFPGLPIKVIPFPFSESQAAIYARLWANALPLPSEKEMSDWEKSAEEQRGPAFHVYPKKGDVEYLREMHAWASKAESGKEPPLWTDEQVWQREIYAQAKLEFEKTGRTAKTLAELGFHYKAPSDVVEEAAQDVL

SEQ ID NO: 75191 - protein, 243 aa, Triticum aestivum
LLHRLFPNARYSLWIDGKLKLVKDPYQLLERFLWRKNVSFAISRHYRRFDVFEEAEANKAGGTHASASIDNQIEFYKREGLTHYSSAKLPITSDVPEGCVIIREHIPITNLFTCLWFNEVDRFTSRDQISFSTVRDKIRSRVNWTADMFLDCERRDFVVQAYHRELMEQRLAALRSQPPPPPPPPPPPPPVVRVQQPRKMLPDSAPKEPGRASKKPAGRRSRRSGSKRSHRTKASSVKEPIRL

SEQ ID NO: 75192 - protein, 225 aa, Frankia sp. EAN1pec
MAGLDRDGDVFVLSLGDGENRLNPAAVAAINARLDEVTAAAGPKALVTTAEGKFWSNGFDLAWMTANPGEIGPFIQSVRVLFARMVTLALPTVAAVGGHAFGAGAVLALTHDQQVMRVDRGYFCLPEVDVDIPFSIGITELIRARMPVRTAHEAMTTGRRYGGDDALAAGIIDGVADQEKVLATAIAMARPLTGKASRTLGTIKSRLYATAVAGLVSGEAVEVPV

SEQ ID NO: 75193 - protein, 329 aa, Neisseria meningitidis Z2491
MKITVIGAGSWGTALALHFSQHGNRVSLWTRNADQVRQMQEARENKRGLPGFSFPETLEVCADLADALKDSGLVLIVTSVAGLRSSAELLKQYGAGHLPVLAACKGFEQDTGLLTFQVLKEVLPDNKKIGVLSGPSFAQELAKQLPCAVVLASENQEWVEELVPQLNTSVMRLYGSTDVIGVAVGGAVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 75194 - protein, 398 aa, Clostridium perfringens ATCC 13124
MKIVVQKFGGTSVSTKERRTMVVEKVKGAINKGYLPVVVVSAMGRKGEPYATDTLLGLVSEEFKKENKLATDLLMGCGEIISTVVMSDELREAEIEAVPLTGGNAGILTDDNYSSADFIDINPKLILEVLKEGKVPVVAGFQGVDRNGFLTTLGRGGSDTTAAVLGVALKAEEIEIYTDVDGIMTADPRIVGDAELINKISYNEVFQLADQGAKVIHPRAVEIAMKGNVTLVIKNTMSTCIGTMIDSLGDVDNNKFITGITHQGNRIQVSIKSDDNKDNINYKTILESLANNKISLDLINIFPKEKVFTIDASVKELFEDIMRKNNLKYSLVEDLSTIAIVGSRMRGIPGVMAKIVGALDNENIEVLQTADSHMTIWCLVESKNVREAIKALHRVFMK

SEQ ID NO: 75195 - protein, 346 aa, Rhizobium leguminosarum bv. viciae
MRALQLIDDRKLEITDLPEPDAPAAGEVTLRVKAVALNHIDVWGWRGMAFAKRKMPLVIGAEASGVVEAIGPGVANVLPGQLVAIYGARTCGLCRPCREGRDNLCEHVSGVHGFHLDGFAQEKVNLPARLLVPAPPGVDAIGAALAPVTFGTVEHMLFDNAKLEPGETILVHAGGSGIGTAAIQLAKKIGCTVITTVGSDDKIEKAKALGADHVINYRTDRFEGVVRKLTKKKGVDVVFEHVGKDTWAGSMLCMKRGGRLVTCGSTSGVSTEMNLMMLFQQQLKLFGSFGCRMENMADAMQKMGPRARPSRHRYRGQAFSDIDRALEPDGIAPDLRQDHPEDGLTA

SEQ ID NO: 75196 - protein, 331 aa, Lactobacillus rhamnosus
MTIAVLGGAGYIGSHTVKQLLADGEDVIVLDNLITGHRKAVDPRARFYQGDIRDYHFLSQVFSQEKIDGIVHFAAFSIVPESMKDPLKYFDNNTGGMITLLEAMNQFGIKKIVFSSTAATYGEPKQVPIKETDPQVPTNPYGESKLAMEKIMHWADVAYGLKYVALRYFNVAGAMTDGSIGEDHHPETHLIPIILQVAAGSRTGLQIYGDDYPTKDGTNVRDYVHVVDLADAHVLAVKYLNAGNPSSAFNIGSAHGFSNMEILNAARKVTGQKIPATVGPRRPGDPSTLVASSEKARDILGWKPNYDDIDKIIETAWNWHENHPEGFGDRN

SEQ ID NO: 75197 - protein, 144 aa, Synechococcus sp. RS9916
MNPARCRILAVGKVRKSWVQEGIALYLKRLPGLTITELRDSTPEKEAEAIRQALRPDEVPVILMEQGKTIDSVTFASRLGGYGSQRLAFVIGGADGITAELKASAAWQLSLSPMTFPHELARLLLLEQLFRAQTIRAGSPYHRA

SEQ ID NO: 75198 - protein, 579 aa, Kluyveromyces lactis NRRL Y-1140
MGLCCSCLRGESSLEDSTGLPIAENEREAVTSLLEFLENKDQYDFYSGKPLRALTTLVYSDNLNLQRSAALAFAEITEKYVSPVSRDVLEPILMLLTNPDPQIRIASCAALGNLAVNNENKLLIVEMGGLEPLIEQMKSDNVEVQCNAVGCITNLATQDDNKIEIAQSGALVPLTKLARSSNIRVQRNATGALLNMTHSGENRKELVDAGAVPVLVSLLSSMDADVQYYCTTALSNIAVDESNRRYLSKHAPKLVTKLVSLMNSTSPRVKCQATLALRNLASDTNYQLEIVRAGGLPDLVQLIQSDSLPLVLASVACIRNISIHPLNEGLIVDAGFLPPLVKLLDYQESEEIQCHAVSTLRNLAASSEKNRAEFFQSGVIEKFKQLALTCPISVQSEISACFAILALSDNTKYDLLQQDVLKVLIPMTMSQDQEISGNSAAAVANLISRVSNLEKILEYWGQPNDGIKGFLIRFLSSDFPTYEHIALWTILQLFECHNETIYKLIKEDQKLVNGVKKIADENYAVAREYMQDGQDTNIDHNGNSNNIEGNGRSNKQSSEKEDASFELYNITQQIIQFLV

SEQ ID NO: 75199 - protein, 371 aa, Gluconobacter oxydans 621H
MDVTAAIAFEAGRPLEIDTVQLEGPRDGEVLVEIMATGLCHTDKYTLSGQDPEGLFPAILGHEGAGIVREVGAGVKHLKPGDHVIPLYTPECRECPSCLSRKTNLCTAIRSTQGKGLMPDGTSRFSYKGQPIHHYMGCSTFANFTVLPEIALAKIRPDAPFDKVCYIGCGVTTGIGAVLFTAKVEPGSTVAVFGLGGIGLNVIQGAKMVGANRIIGIDINPEREAIARKFGMTDFVNPKDLGPDGDLVGHLIEMTGGGLDYTFECVGNPTLMRQALESAHRGWGVSCVIGVAGAGQEISTRPFQLVTGRRWIGSAFGGARGRTDVPKIVDWYMEGRIDIDDLITHKLKLADINLGFDMMSRGESIRTVVEY

SEQ ID NO: 75200 - protein, 1106 aa, Coccidioides immitis RS
MKRRFTSRRSHPYRTHRVSRSPDRAATDNPPHADAANDYMAASRRSPSMRDQWRADGDYDREIHHHRPRARERHSRRQLSPPAPRRRDRDRERPSRGRGSGSTAHYHPCRRPIPRGEDRNPENTRTTPFKAAREENRDAKHSLKNQVRSRQREDSPPSPSNPSFPRRKRSRSPSPSRSHRRPHHKKGRHNDRGDHFGRGGRRPQRYSSPERFVPPRETGPGRKSHYSKAPTSDSLSISRCRRSRSPVPSDFGLRASLSPHSPSNRSCNSIDYPSRPPSRHSFASKVSRESSPSRAFRSMQDTLPIQSLEDESIGSASTFRPAANADIPSSNHSVDGDSHMRDAYPMHGMRPSETRGSRRQARPHVDTRQPYSSPQYIPGSDSRHPSPQSGSPYGSSRGSWVGQPQHPYPHGQQRQMHGYSPPYRQPSYSSQGGSQGQYYQGQPPQYPPSPNAGQQGYSGQPPYRGTSSSYRGNPYSQPPPPDRRFSGANSQNYGSPPQPQRSRSGHFTSLQWTASAGRGRGSQTGPGQPSPTIPSLQPPHHALDDPLSPDMDDNDNPFRPSKDLQVEDEEAVKKNENNDVKKMPPPRQGSGSSQPKETGKFSFAFKSKAPATPVPKPVSGLAQKMREPPRPLEPPKKELLSAQTRLKHEIRPDRRDDRRDRDGRRGDRRFDRRDDRRRDRREDRRPDVKHDRRKDRERERDREHSPPTQEKPKKKMLTRMKPRPTLSEEFSKSDSVYYRKPGNESVVGAGTYGKVFKAVHVFTKNKVALKRIRMEGEKDGFPITAVREIRLLQHLRHENVVSLQEVMVERNECFMVFEYLSHDMTGLINHPSFTLSAAHKKHLAKQMFEGLNYLHHRGVLHRDIKAANILISNKGQLKFADFGLARFFSKSRQLDYTNRVITIWYRPPELLLGETRYGPAVDVWSAACVYMEMFTKKAIFPGDGSEINQLDKLYNSLGTPTRTDWPAIIDMPWFELMRPRERKKRAFENMYKDYLSPAALDLVSKIFQYDPVKRPSTEEVLAHPYFTEEEPAPQQAIELADVEGDWHEFESKAHRKEKDKEARRAEQREREKRRISNHTGESVDRERKRTKVDDDTSAPVSQGPEN

SEQ ID NO: 75201 - protein, 93 aa, Pinus pinaster
ESLASSASSAMTAWGLTLLAMGLACKEIHVGGRNSKLITLESFLIILSGTQLFYILVIHGGYFGGNYGSYQDTYVATTTAEPREGSTPAGSSV

SEQ ID NO: 75202 - protein, 156 aa, Triticum aestivum
HYRTSLYKKAGWYRSGIPGISSTHASATISAAAATTVVARAAIARPQALGLPQLRTRSERVRCSYSKDAKEATPAATVRGASASLLAAAGAVTASAGPALALVDERMSTEGTGLSLGLSNNLLGWILLGVFGLIWSLYTVYTSGLDEDEESGGLSL

SEQ ID NO: 75203 - protein, 221 aa, Flavobacteria bacterium BBFL7
MSKLIAPSVLAADFANLQRDVEMINRSEADWFHIDIMDGVFVPNISFGMPVLRDIAKHATKTIDCHLMIVDPDRYVKTFADLGCDILTVHYEACTHLHRTLQLIKSHGMKAGVALNPHTSVHLLSDVIQDIDMVCLMSVNPGFGGQSFIENTYDKITQLKKIIDFKGCDTLIEIDGGVTDKNAKQLVDAGADVLVAGSYVFKSSDQVATIAGLKSMVNPAI

SEQ ID NO: 75204 - protein, 430 aa, Desulfotalea psychrophila LSv54
MLREERGMEDYLVTGIFFFMGLLATAVVSSVIFKRLSFPYTIGLVVVGGLLGFLAFRWQPLALLQNIDLSPGVILYLILPTLIFDAAINIDTHLLRRDFFIIFLLAVIGLLASAAMIGYSLAYFTPLSLGAALLFGALISATDPVAVMALFREVGAPPRLATLMDGESLLNDATAIVLFVIILGTMGFDIGPDFNMANHPLFSFVFVLAGGVLVGLVVGWIGVLLVLLDRSNFISELTISFVVAYISFLVADHLFDVSGVMSTLTAGITLKALGGKHLDVANLKMIKRFWNYFAFIANSMIFLLLGLTEEHVFYNMIHLHQHMFYLLFAIPAVLVARAIVVWSIVGIYNRFVAKENTVPGAYQAVLIWGGLRGAIPVALVLTIPAEMPFRPLLIDLTLGFVLFTLLVQGTTVKKMMKALGVTVREEVEEE

SEQ ID NO: 75205 - protein, 327 aa, Flavobacteria bacterium BBFL7
MDSKIIYDVIIIGAGPIGLACGLEAQKAGLRYLIIEKGALVNSLYHYPVNMNFFSTSEKLEIDEVPFISKESKPSKQESLEYYRRIATSKKLEIRLYEKVMAVTKDVEFKIKTSKDEYLSKHIIIATGFYDIPVKLNIPGEDLDKLNHYYHDPHAYAFLETVVIGASNSAVDAALEIYRKGGKVTMIVRGDQIGDRVKYWVRPDIINRIEEGSIKAHFNAALTRIDETTVTFTKDGETHTIANDQVLALTGYQPNFEFLKSMGIQLSGPHKIPVYDSHTMETNVKGIYLAGVICGGLETHKWFIENSRVHAPQIISSIVQRDKKTSV

SEQ ID NO: 75206 - protein, 775 aa, Schizosaccharomyces pombe 972h-
MNEKKKDSLSVLDSNEFFGETTMVSPSIDVSSSPRPNVERFSPCSTKKDLLEGNNIMTRIPEELSRVSLQFDSKGSQQSMIFTNNRCLSDKENLENLQNLLYLHCDLNRPHLSCELPSEHREKCLKRRNSSLSSNLHANKRFLFNSQSDGNKKNETFPSTNYSNVFYPNNCDSKEVASETTFSLDAPNNSVNYSYFSPNLLGNDSKTRQSFPPHSSSSSHNSLHEPVIYDFSSENPSIHPSNHLSSQKNAVLKLAQLISSFEKLPESVRQYLLFHLLSRCGKHAVQNIHKILLPIFQKNFLTGFPAEITNLVLTHLDAPSLCAVSQVSHHWYKLVSSNEELWKSLFLKDGFFWDSIDSKIRTMCLEQSLSACAIMKRVYFRHFNLRERWLHAPEKIKRCSFPIHGVRLITKLQFDDDKIIVSTCSPRINIYDTKTGVLIRSLEEHEGDVWTFEYVGDTLVTGSTDRTVRVWDLRTGECKQVFYGHTSTIRCIKIVQGNQSTTDTDDVEKENRPASNDANSMPPYIISSSRDCTIRLWSLPCLDDPPFVNVNENPDQNNDFTSATTNPFYIRTLRGHTDSVREVACLGDLIVSASYDGTLRVWKASTGVCLHVLRGHVGRVYSVTINPSRQQCISAGTDAKIRIWNLESGELLQTLHGHSNLVSQVTFNQNILVSASAPPDTSLRVWDLNTGSCRDILKCPLGHIFFQHDESKVVSGSHSTLQLWDIRSGKLVRDLLTDLDIIWQVAYNENVCVAAVLRNNRFWIEVLEFGSTKSS

SEQ ID NO: 75207 - protein, 403 aa, Brassica oleracea
MNCLFLLKSKKPEPRNQQKDRRKAQNSAPGQRNKSETPSFNLHRPRSLPSGRSIRNLDREREQSLRVFTYEELSEATCGFSRRLKIGHGGFGNVYKGKIPTTRDSDPPLVVAIKKLNPQGLQGHKQWLAEVEFLGVVNHQNVVKLLGYCSEDGENGMERLLVYEYMSNRSLEEHLFTRGARTLPWKQRLEIMLGAAEGLAYLHEVKVIYRDFKSSNVLLDDEFCPKLSDFGLAREGPQGDNTHVTTAKVGTEGYAAPEYVQTGHLRLKSDVYSFGVVLYEIISGRRTIERNKPPAERRLLEWVKEYPPDSRRFSMIVDPRLRNNYPSAGTRSLAKLADLCLKKNDKERPTMEIVVERLKKIIEECDSGDSYIAASKESSQVRCNSRAAGPVEGSLRGGVSVRE

SEQ ID NO: 75208 - protein, 522 aa, marine gamma proteobacterium HTCC2143
MPADMPTSAPRKPTVLVILDGWGYREDPRDNAIANANTPTWDKLWATAPRTLISSSGRNVGLPEGQMGNSEVGHMSLGAGRIVYQNISKIDKAIEEGEFTANPAYINAIDQAIANDRAIHLLGLLSPGGVHSHEKHIYAMVDMAAKRGAKKVYVHAFLDGRDTPPRSAKNSLQTLSEQFSSLGCGRIASLVGRFYAMDRDNRWDRVQSAYRLLTEERADYHYNTAVDGLEAAYLRDENDEFVSTTIIKKEGESSAAIEDGDSVIFMNFRADRAREISRAFVDKDFSGFKRDKTPELASFVMTTEYASDIAAACAFPAEKIHNSFGELIEKAGKKQLRIAETEKYAHVTFFFSGGREQPFEGEERELIPSPDVITYDLKPEMSAPEVTDKLVAAIKGGQYDTIICNYANGDMVGHTGIYEAAVKAAEAIDESLRRVTNAILDAGGDCLITADHGNCEQMQDYQSGQAHTQHTTELVPLIYVGDKAVTVKESGGKLADVAPTLLALMGIPQPAQMTGQPLLNLD

SEQ ID NO: 75209 - protein, 575 aa, Xylella fastidiosa Temecula1
MNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGELLLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMVSCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGTLKTSVTTLLRARDRKSIEEWMAAHANTTPT

SEQ ID NO: 75210 - protein, 597 aa, Cyclamen persicum
EGDALHSLRTNLADPNNVLLSWDPTLVNPCTWFHVTCNNENSVIRVDLGNAALSGQLLAQLGLLKNLQYLELYSNNISGPIPSDLGNLTNLVSLDLYLNSFTGAIPDTLGKLSKLRFLRLNNNSLTGAIPMSLTNITSLQVLDLSNNRLSGAVPDNGSFSLFTPISFANNLALCGPVTGRPCPGSPPFSPPPPLVPPPPISSPDGNSVTGAIAGGVAAGAALIFAAPAIAFAWWRRRKPQEYFYDVPAEEDPEVHLGQLKRFSLRELQVATDGFSNKNILGRGGFGKVYKGRLADGSLVAVKRLKEERTPGGELQFQTEVEMISMAVHRNLLRLRGFCMTPTERLLVYPYMANGSVASCLRERPPSAPPLDWPTRKRIALGSARGLSYLHDHCDPKIIHRDVKAANILLDGEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLEKNYVEPEVEQLIQVALLCTQGSPVDRPKMSEVVRMLEGDGLAEKWDEWQKVEVLHEEVELAPHPNSDWIVDSTENLHALELSGPR

SEQ ID NO: 75211 - protein, 278 aa, Aspergillus oryzae
MADLIESAKRAAGQAAVKNHYPKDAKYVGIGSGSTIVYVVEAIKESGVDTSQTKYVPTGYLSKQLIVSNGLTAVDFDSLPEGTVLDIAFDGADEVDDDLNLIKGGGACLFQEKIVALQAKEFVCVADSRKLQSRLLSNWKYIPIEVAPIAASRVLGELRELGSISPALRLNTTAPEGAPKPTPLKTDQAFNIIDAPFKSLLTKADIAAGQDGTGKDGVWEVEALSRAIKQIPGVLDVGIFSGETGPQAQARGGTGGQKPIAAYFGMPDGSVSVRKASA

SEQ ID NO: 75212 - protein, 486 aa, Oryza sativa Japonica Group
MSSSSSSGWSSKKVCVVGAGMAGLAAARELRREGLDVTVLEQSAGVGGQWLYDAATDGGDPLGMAGVHSSIYSSLRLNSPREVCGFSDFPFRPTNGGGGDARRYPVHGELLRYIREFCDVFGLMDAVRLDTTVVRVAMAPPRRDGSLRWTVRSKHNGDAETEEVFDAVVVATGHYSQPRLPSIDGMDKWRRRQLHSHSYRVPDSFAGEVVVIVGCNLSGKEVALELLRVAKEVHLSSKSTKEAMTPSMSKMLARYDNLHLQPLVEHLCEDGRVVFDDGSFVVADAVIYCTGYNYSFPFLETEGKVTVDDNRVGPLYEHVFPLALAPSLSFVGIPVKVILPRFAEVQARWVAQVLSGRRTLPSPGEMLRAVEEYNRAKEAAGLPKRQTHDLFLDLEYCDEYGERHCGFPRTEQWKKELIWSSISDMCDDIENFRDDYHDSDIVRDGRRLHGWASSPPLAPRPQEKDDDHDKEEDKHLGFGPSKFSLR

SEQ ID NO: 75213 - protein, 830 aa, Gibberella zeae PH-1
MISGRGGAGTRGRIRPPRRIVRATESGEGSDFEVCWKMLREALDDIHRKNCSKLSFEELYRAAYKIVLKKKGELLYEKVKGFEEQWFNDHVIPEIKELFSKSLLDSGSRSIHEKRQTGERFLKGLRDKWEDHNMSMNMTADILMYLDRGYTQLEAQRIPIFATTIALFREHILRSSLNTNHKVIDVLISVILEQINMEREGDIIDRNLIRSCTRMLSSLYETEDEKDSDKLYSTVFEPRFLENSKAYYAAECEKLLRESDAGAWLRHTQTRLNEEIDRCGTTIELETLPKVTSTIDQELIIKHLGEFLALEGSGLKWMIDNDKVEELSILYRLVSRVDSTKTSLREILQRRVVELGLDIEKVLKNTDFSTGQGDGEEGEGDKAKTLNPAAQQTAAAIKWVDDVLRLKDKFDNLWTRCFQDDLIIQSALTKSFSDFINMFNRSSEYVSLFIDDNLKRGIKGKTEAEVDVVLEKAIVLIRYLQDRDLFQTYYQRHLARRLLHGKSESHDVEKQIISRMKQELGQQFTSKFEGMFRDLVTSTELTTGYRDHIRSVGDGTKTIDLNINVLTTNYWPPEVMGRTAQIGDGSRVTCTYPPELDRLQTSFEQFYLTNRNGRKLTWIGTTGSSDIKCTFPAIAGKSGPLSRERRYEINVPTFAMVVMLLFNDLEDDQSLTFEEIQAKTNISNQDLMRTLTAIAVAPKSRVLLKDPANKSVKPGDKFTFNASFQSKTIRIKAPIINAVSKVEDTTERKTTEEKNNQTRAHIVDAAIVRIMKSRKELSHSQLTSEVLSQLSGRFKPEVSLIKKRIEDLIAREYLERPDEDGAPSLYRYVA

SEQ ID NO: 75214 - protein, 511 aa, Pisum sativum
MDNPSTNESSNISSIHLESASNRKPTPLIKMIAVASIAAGIQFGWALQLSLLTPYIQLLGVPHKWAANIWLCGPISGMIIQPIVGYYSDRNRSRFGRRRPFIFFGAIAVAVAVFLIGFAADIGHSFGDDLKKKTRPKAVVIFVFGFWILDVANNMLQGPCRAFIGDLAADDHRRMRTGNALFSFFMAVGNVLGYAAGSYRKLFMMLPFTKTEACNEFCANLKTCFFIAIFLLVLLSTFALLYVEDIPLPSIESQSQTQTQTQSEPEQQVSCFGEILGAFNGLQKPMWMLMLVTAINWIAWFPFFLFDTDWMGHEVYGGNPGBDAYNRGVRAGAMGLMINAVVLALMSLAVEPLGRFVGGAKRLWGIVNIILAVGLAMTIVITKAAQHERHVSNGNTPSAGISAASFAFFALLGIPLAINFSVPFALASIYSSASGAGQGLSLGVLNIAIVVPQMIVSALSGPWDSLFGGGNLPAFVVGIGAAVISGVLAIIILPTPKATDVAKVPIAGGFH

SEQ ID NO: 75215 - protein, 68 aa, Phaseolus vulgaris
MTTSRRFADRKVEKFEKNITKRGFVPDTTSKKGKDYPVGPLLLGFFVFVVIGSSLFQIIRTATSGGMA

SEQ ID NO: 75216 - protein, 503 aa, Phaseolus vulgaris
MEPSSSSLQVETGERQQPSPLRKMFAVSSIGAGIQFGWALQLSLLTPYVQTLGVPHAWSSFIWLCGPISGLLVQPIVGYSSDRCTSRFGRRRPFILSGAVAVAISVFLIGYAADIGHATGDDITKKTRPRAVAIFVVGFWILDVANNMLQGPCRAFLGDLAAGDQKKTRTANAFYSFFMAIGNVLGYAAGSYDKLHHLFRFTETEACGVFCANLKSCFFFSIVLLLVLCAIVLTCVDDPQFTPDCVNANNPQTGSWYSCFGELGIAFKGLQKPMLMLMLVTAINWVAWFPYVLYDTDWMGREVYGGEVGSNAYDNGVHAGSLGLMLNSVVLAVMSLVVEPLGRVVGGVKWLWAAVNVILAVCMAMTVVITKAARHERNHDGVLVGHPSFGVKAGAMSFFSILGIPLAITYSVPFALASIYSSTSGAGQGLSLGLLNVAIVVPQMIVSAISGPWGSWFGGGNLPAFVLGAVAAAVSAVLAVVMLPSPKPADVSKASSVTVGNFH

SEQ ID NO: 75217 - protein, 232 aa, Oryza sativa Japonica Group
MAAAASTLASLSATAAAAAGKRLLLSSPSRSLSLSLASRGRIAVMPHLRAGILSAAPRRAVSASAPAAATIAVGDKLPDATLSYFDSPDGKLKTVTVRDLTAGKKVVLFAVPGAFTPTCTQKHVPGFVAKAGELRAKGVDAVACVSVNDAFVMRAWKESLGVGDEVLLLSDGNGELARAMGVELDLSDKPAGLGVRSRRYALLAEDGVVKVLNLEEGGAFTTSSAEEMLKAL

SEQ ID NO: 75218 - protein, 476 aa, Streptomyces coelicolor A3(2)
MRRSKIVCTLGPAVDSHEQLVTLIEAGMNVARFNFSHGTHAEHQGRYDRVRAAAKETGRAIGVLADLQGPKIRLETFAEGPVELVRGDEFTITAEDVPGDRTICGTTYKGLPGDVTKGDQVLINDGNVELKVTEVEGPRVKTIVIEGGVISDHKGINLPGAAVNVPALSEKDVEDLRFALRMGCDLVALSFVRDAKDVADVHRVMDEEGRRVPVIAKVEKPQAVDNMEDVVMAFDGVMVARGDLAVEYPLEKVPMVQKRLIELCRRNAKPVIVATQMMESMITNSRPTRAEASDVANAILDGADAVMLSAESSVGAYPIETVKTMSKIVTAAEQELLSKGLQPLVPGKKPRTQGGSVARAAAEIADFLGGKGLVAFTQSGDTARRLSRYRAAQPILAFTTDESTRNQLALSWGVEPHVVPFVNTTDEMVDLVDQETARLGRFSDGDTVVITAGSPPGVSGTTNMVRVLHLGETRRG

SEQ ID NO: 75219 - protein, 132 aa, Oryza sativa Japonica Group
MAEKEEGKVAAEGGAEAEADEEVEVKFRLFDGSDIGPLRCNAVATTVAALKDRVVADWPKDKTIVPKTANDVKLISGGKILENDKNIAQCRAPFGDLPSTAITMHVVVQPSSAKSKPGELYYFIESMLDCLT

SEQ ID NO: 75220 - protein, 147 aa, Stevia rebaudiana
MIHTMSLVHDDLPCVDNDDFRRGKPTSHKVYGEEMAVLTGDALLSLSFEHIATATKGVSKDRIVRVIGELARSVGSEGLVAGQVVDILSEGADVGLDHLEYIHIHKTAMLLESSVVIGAIMGGGSDQQIEKLRKFARSIGLLFQVVD

SEQ ID NO: 75221 - protein, 655 aa, Zea mays
GAADAGGQDAGGQGPCPHFSCGDLGNISKPFRRPGDPEECGVKAYELVCSNGKATIRINTGTYFVTSINYTNRSFWVVDANLDMHSSCPLPRWDQFPYTSEGLFWRSGKHTHIDLPTDDASLWACFVNCSRAVRITNNLGYKPVTCLSGSSSFVYIYVQYGACTVGSLEPFCGYLAEISFGTNPKGTNASYADIIQVVKKGFSVGFPKDEYDYSYHNTSWIFKTCLNNFTRYFHEQLSSGGIVGITRAFFWSDVFLLKCAESYNATTVILDFDVISVVTGVKITTLLVLFRFVFTALAVQMFLAHKYWKTTIAIDAVEKFLHMQQMLGPTRFAYTDITAITGHFRDKLGQGGYGSVYKGALLSGNMHVAVKMLGNSNCNGDEFISEVSTIGRIHHINVVRLVGFCAEEMRRALVYEYMPNGSLDKYIFSAERSFSWDMLNEIALGIARGINYLHLGCDMQILHFDIKPHNILLDSNFVPKVSDFGLAKLYPRDKSFVPASAMRGTIGYIAPEMISRSFGAISSKSDVYSFGMLLLEMAGGRRNADQNAANSSRAYYPAWVYDRLAEQDAGEISVAADMHELERKLCIVGLRCIQMKPQDRPTMSEVIEMLECGTHGLGLQMPSRPFFCDDDDPNMPAADSYHFSSELTAISEEDG

SEQ ID NO: 75222 - protein, 1174 aa, Cochliobolus heterostrophus
MANVEETVANVQRKIDREKALINAANAMRQSTNNPAVLSRLDGQIKDGRRNIDYFESKLRDLDLQRTTSGVDNMSLQPGRSPTNPLTPPPKDNWDGYAQQDQGGYGGPQSQYSQLSGGEALQPPRAPFAAPPPATANKRPNYSKLDLIKYDTPHLGPRIQLMLTQLEFKLSVEKQYKDGIEKMVRLYQMEGDRKSKQDAEAKRIESNQKIQLLKHSLKRYEDLHVDIDGDGDDNDSLDIPSQRKPLSGQLSLRIHAVADVDHAATGRFSRGPETFVNIKVEDTIKGRTKPTRNDRWTDEVHDFSIDKANEIEITVYDKTGDHLLPIGMLWVRISDIAEEMRRKKLETELANSGWVAADKMGGHTGIQPDMQFQPPPGQSPAGGPGGGPTPAGVRPPGAPQPQTGPIMIDDWFSLEPVGRIHLTMSFIKNTGNKQPFDLGLGRKGAVRQRKEDVVEQYGHKFVQQQFYNVMRCALCAEFLKYAAGMQCSDCNYTCHKKCYPKVVTKCITQSNAETDPDEAKLNHRIPHRFENFSNMGANWCCHCGYVLPLGRKQTKKCNECGLTCHAHCVHFVPDFCGMSMEVANQILMEIKRTRRGQSSSGPGMSQRTLRPQSAAKPLPPTQPQSPGQPGQESPTQSDRYSYGKEQMSPPPGPPRQPSYPSSATSVDAARASYSTTGTASTGAPTSPTSGSRPPSGPRTQSSVAAAAAAMNKATQPGYGRSNTDYSPQSGRSSGSGYPTEQRMSQQQAPQPAAYDPSVYANIPSYPPSHQQPAPVPSYPTKSSYPLPQPPPPQSPPQHPQQPTPSQQKMPEQQALTQQPPSAVGEVPGKKVTPAANTQGTGKRIGLDHFNFLAVLGKGNFGKVMLAETKTTKQLYAIKVLKKEFIIENDEVESTRSEKRVFLIANKERHPFLLNLHACFQTETRVYFVMEYISGGDLMLHIQRGQFGTKRAQFYAAEVCLALKYFHENGVIYRDLKLDNIMLTLDGHIKVADYGLCKEEMWYGSTTSTFCGTPEFMAPEILLDKKYGRAVDWWAFGVLIYQMLLQQSPFRGEDEDEIYDAILADEPLYPIHMPRDSVSILQKLLTREPEMRLGSGPTDAQEIMSHAFFRNINWDDIYHKRVQPPFIPQITSPTDTSNFDTEFTSVTPVLTPVQSVLSQAMQEEFRGFSYSADFA

SEQ ID NO: 75223 - protein, 469 aa, Bacillus halodurans C-125
MVVGDFAKEVDTLVIGSGPGGYVAAIRAAQLGQSVTIVEKGTLGGVCLNVGCIPSKALISAGHRYHNALHSDDLGIKAENVTLDFSKVQEWKASVVNKLTGGVEGLLKGNKVEIIKGEAYFASEDSVRIMDEKNATTYKFKNCIIATGSRPIELPNFKYSKRIINSTGALALEEVPKKLVVIGGGYIGIELTGAYSNLGSDVVVLEGGKQILPGFEKQMAKLVERKLKKNGVSFHTEAMAKGVEETEDGVKVTAEIKGKEEVFEADYVLVTVGRKPNTDELGLEQIGVELTERGLIKVDKQCRTNLSNIYAIGDVIEGPALAHKASYEGKIAAEAIAGEKSEIDYLAIPAVVFSDPELATVGYTETEAKEAGYDVTAAKFPFAANGRALSLNDADGFMKLITRKEDGLVIGAQIAGPNASDMIAELGLAIETGMTAEDIALTIHAHPSLGEITMEAAEVALGTPIHIVK

SEQ ID NO: 75224 - protein, 426 aa, Bacillus halodurans C-125
MAYEFKLPDIGEGIHEGEIVKWFVKPGDEVKEDDILLEVQNDKAVVEIPSPVDGKILEVKVEEGTVAIVGDVLVTIDAGEGVGAEETEEAPAPEEKAEEAAPAEPAPAKETAPEEDGDEDKRVIAMPSVRKYAREKGVNIKKVKGTGKNGRILREDIDAFLSGDTQAEASEEKAETAAPAAASNVEPTEIPVGEREERVPLKGIRKAIAKAMVNSKHTAPHVTHMDEVDVTALVAHRKQYKEIAAEQGTKLTYLPYVVKALTSALKKYPVLNASIDDVNEEIVYKHYFNIGIAADTEQGLVVPVIKDTDRKSIFELADNINELAIKARDGKLSAAEMKGGSCTISNLGSARGQWFTPIINHPEVAILGIGRIEEKPVVKDGEIVAAPVLALSISYDHRLIDGVTAQNALNHVKRLLNDPQLMLMEG

SEQ ID NO: 75225 - protein, 306 aa, Desulfotalea psychrophila LSv54
MTTTIGQSIGNTPLLKLGRLDRDCAATILVKQESRNPAGSVKCRVAVSMIETGLREGKISKGTTIVEPTSGNTGIGLAFVCAAKGLRLILTMPESMSIERRKLLAHLGAEIVLTPAAEGMTGAITKAEELLTGLADGFMPDQFNNPANPEIHRQTTGKEILRDTDGRVDIFVAGVGTGGTLTGVGSVLKAKNPRVQVIAVEPATSAVISGEAPGPHGIQGIGAGFIPGNLDISLIDETIKVNDEDALVAAQELATQEGILCGISSGAAFWASLEVAKRPENIGKTIVTILPDTGERYLSTNLFSTS

SEQ ID NO: 75226 - protein, 325 aa, Desulfotalea psychrophila LSv54
MEKTIPTIPELCDHVKITENSKHNQLPDIVKKMLSGWSTKECFDHISPVCIPSQEKIIDIALQARRIIFPGYFTTTKLHASNIEYYIGKETMDLYELVCEQITMAIRHDCRRNRRLCTNCEQESAKLALQFMEKLPEITATLAQDIRATLAGDPATKSPDEVIFCYPGLLATLVYRLAHELFLLEVPFVPRIMTEYAHSQTGIDIHPGAQIAPGFFIDHGTGIVIGETTIIGENVRIYQGVTLGALSLPRDAGEKLRSTKRHPTIENDVIIYANTTILGGTTTIGEGSVIGGNSWIIESVEQGSKVFLKKPELIVHHANGQKTHL

SEQ ID NO: 75227 - protein, 288 aa, Zea mays
MAKDIEASGPEAGEFSAKDYTDPPPAPLIDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 75228 - protein, 635 aa, Magnaporthe grisea 70-15
MKAEELETIAPALSGDFRSIEGHLTNLDKHLTLRTYLNGTQLGDIDSKIWTSLATNRAAIAFIRRGVLANLTRWFIFVEQNHPEIQGEVKKAAAAQKAKVAAASRAGGNFNLALQDADKGVVTRFLPEPSGYLHIGHAKAALLSDYFAHQAYNGTLRLRLDDTNPSKEKEEYQDAIIEDLALMGIKADKFSYTSDYFQYLYEMCIRLIKEGNAYADDTDQETMKKERWDGIASKHRDMSIEETLRVFEEMKKGSDEGKRYCIRAKLSVDNPNKALRDPVIYRCNDEPHHRTGTTWKMYPMYDFACPVVDSYEGVTHALRSTEYTDRNPQYQWFLDTLKLRQVHMWDFARMNFIRTFLSKRKLAKLVDTGRVWGWDDPRMPTIRGVRRRGMTVPALRDFIIKQGPSRNVTSMDWTVFWAANKKEIDPVAARHTALSQKSPVKVKITGKDAPASPHSVEKPKHPKNKDVGVKQVAFSDEILLEQEDVALMKPGEEITLMAWGNAIVKDISTGTPIPTMTVELNLAGDVKTTEKKVTWLSNQGQKLIPAELWDFDYLITKDKLEEDDDLEKFLTPVTEFMEPAWCGADAETLKKDDVVQLERRGYYRVDKGLGDWKDGEEGEKGKRIVFFNIPTGKTK

SEQ ID NO: 75229 - protein, 258 aa, Eriobotrya japonica
LFATDFFEIKAVKEIEPALKKQLIISTVLMTIGIAIVSWIALPSSFTIFNFGVQKVVKNWQLFLCVAVGLWAGLIIGFVTEYFTSNAYSPVQDVADSCRTGAATNVIFGLALGYKSVIIPIFAIAVSIYVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSA

SEQ ID NO: 75230 - protein, 556 aa, Cryptococcus neoformans var. neoformans JEC21
MSYRPSQQQQPGPSNFQQQQQHMLNPQNMAGPGRTSPMPTVPQVSQPNIGQPGSMRPGEGPTPAVAQANAGGQIQGNGAEGLGSLASDKGPDYVYFERKPGQFSEAVQGKAMGAKMKLELFYKEAVEGVVGRKERRTALEKQLAADALTPDSLKARQLINLGRRESNYLRLRRTRIGLDDFRTVKVIGKGAFGEVRLVQKADTGKIYAMKTLRKNEMFKKDQLAHVRAERDVLAESNSPWVVQLYYSFQDTQYLYLVMEFLPGGDLMTMLIKYDTFSEDVTKFYMAECILAIEAVHNLGFIHRDIKPDNILIDSLGHIKLSDFGLSTGFHKQHDSAYYQRLLGGGDVSGSNRHSQTAAGARNSVMVNAINLTMTSKQDIATWKANRRKLAYSTVGTPDYISPEIFLQQGYGKECDWWSLGAIMFECLVGYPPFCSENAHDVYKKIIDWRNYLFFPDDVHLSREAEDLIRRMLCEADRRYTVEQLKAHPFFYGVDWATIREIDAPFVPHLRSITDTSYFPTDELDQVPDIPVGAETGSDAKKDLAFLGYTFRRYEML

SEQ ID NO: 75231 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFFVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYNSRVVDLIVHMSKA

SEQ ID NO: 75232 - protein, 476 aa, Phaseolus vulgaris
GGSGVQFGWALQLSLLTPYVQTLGVPHAWASFIWLCGPISGLLVQPIVGYSSDRCQSAFGRRRPFILAGALAVAIAIILIGYAADIGQLAGDDITQKTRPRAVAIFVVGFWILDVANNMLQGPCRAFLGDLAAGDQKKTRTANSFFSFFMAVGNVLGYAAGSYDGLHKIFPFTETEACNVFCANLKSCFFFSIVLLLALCIIVLTCVNDPQYIPSNPEKEAEEEGKTQVSCFLGECCVAFKGLQRPMWMLMLVTAINWIACFPYVLFDTDWMGREVYGGDVGQKAYDAGVHAGSLGLMLNSVVLAVMSLAVEPLGRLVGGVKWLWAIVNVILAACMALTVLITKVAEQQRALNPALIGNPSMEVKGGAMAFFSVLGIPLAITYSVPFALASIYSSTSGAGQGLSLGLLNVAIVIPQMIVSAISGPWDDWFGGGNLPAFVLGAGAAAISAILAVILLPSPKKEDEAKISSLSMGSFH

SEQ ID NO: 75233 - protein, 560 aa, Oryza sativa Japonica Group
MVLYADPPPPIKPPEIKIKELANKSTYESSMMEQKTRLHAIERHRSCEVSQAILSEVENRHQHQTLEPIKSPISGCSPSVESTTDTNTVHRHTVADAAWEALKKSIVHFRGQPIGTVAAIDKSQGALNYDQVFMRDFVPSALAFLMKGEPTIVKNFLLETARLQLREKMVDLFKLGQGVMPASFKVHHCNSKHKTESLLADFGETAIGRVAPVDSGLWWIILLHAYTIWTRDNSLAESPECQRAMRLILKLCLSEGFDTSPALLCADGCSMIDRRMGIYGYPIDIQALFFMALRCAVTLLKEDHNDDFVYQISRRIKALSYHLHSYYWLDFQRLNEIYRYKTEEYSETALNKFNVIPESIPDWIFDFMPSRGGYFIGNVSPARMDFRWFCLGNFIAILSSLTTGEQAEAILDLVEERWEELIGEMPMKVCYPAMENQEWQIVTGCDPKNTRWSYHNGGSWPVLLWLLVAVSVKLGRPHIARRAVEVMEKRLVKDEFPEYYDGKAGRYVGKQARKFQTWSVAGYLVAKMLLDDPSNLRAVSLADDCHIRSAPVLKRSNSFP

SEQ ID NO: 75234 - protein, 265 aa, Staphylococcus aureus subsp. aureus MW2
MTDKTLQQIDKLICSWLKQIDNVIPQLIMEMTTETKRHRFDLVTNVDKQIQQQFQQFLATYFPEHQLLAEEKSNAMITNEINHLWIMDPIDGTANLVKQQEDYCIILAYFYEGKPMLSYVYDYPHKKLYKAIRGEGAFCNGIKMEEPPSLKLEDAIISFNAQVMNLDTVQDLFDASFSYRLVGACGLDSMRVAKGQFGAHINTNPKPWDIAAQFLFAELLNLKMTTLDGKAIDHLKGAPFIISNKACHETVLKILNANGGYQKYR

SEQ ID NO: 75235 - protein, 669 aa, Desulfotalea psychrophila LSv54
MWRSLDVLSVNRLDIRYGEKHLFKNVSVQVNRGNRIALVGVNGAGKTTLLKIMAGVSATDDGVVTCSKQFTVGYLPQESEPSTSAISLYEEAKKAFAPIIALQEEVDVLHQTISCCDAQDPTLEKLLQRQGELQHRLDGSAIYSMRAKIEKVLDGLGFTSEDMEKELHSFSGGWQMRLRLAKMLLEAPSVLLLDEPTNHLDLETLRWLEQFLISYDGAMVVISHDRSFLDKATTMTWEVSLGNVNIFKGNYSYYVKEKQERLAVERGAYENQQAKIRQTMLFVDRFRSKATKAKQVQSRVKQLEKMEMVELSAEDQQIHFSFPPAPPSGRDMLSVKGLSKSYRGKTVFKDAEFELQRGDKVAVVGVNGAGKSTLLKILAGEIEADAGQKKFGSGVVKTYFGQHQAQELSPQLSALDTMALSGEALSITRQRSLLGAFLFRGDEVDKKVAVLSGGEKSRLALAKMIAIPANCMLLDEPTNHLDMNSQDILQEAMGQYDGTIIVVSHNRYFLDTFVNKVFEVKDGKINVYGGNVTEYLQKVEAIAEEGKRQEQDATRQESVQEPGEGSGQNRKERKKQEAQRRQERSKLLGSWLKVAEESEKQVENIEEEKEALEVTMADPALYSDEDAWSAVSADYEACKTRLERAYASWEEAQGKIEEGEAKLALKYGE

SEQ ID NO: 75236 - protein, 338 aa, Buchnera aphidicola str. Sg (Schizaphis graminum)
MNCLYQRDCLRLLDFTTAELKHIITLSEKLKKTKQNRQEIKLLKQKNIALIFEKESTRTRCSFEVAAFDQGANVTYLGPGSTHLGTKESIEDTARVLSRLYDGIQYRGHNHKTIEILAQYSTVPVWNGLTEKFHPTQLIADLLTIKEIFPNRNFSDIKCAYVGDSRNNIGNSLLEAASIVGLNLYLVSPKQYWPEKNLFIECKKIIKKNQGNIICTENISEGVKNADFIYTDVWVSMGEHHKIWKERIELLKNYQVNDSMIKMTNNSKVKILHCLPALHDQKTSIGKSILKKYGLKDGMEITDNIFQKHQKTIFEQAENRLHTIKALLVSSLIKEMNF

SEQ ID NO: 75237 - protein, 419 aa, Arabidopsis thaliana
MATEKWVFMVTAQTPTNIAVIKYWGKRHEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 75238 - protein, 311 aa, Glycine max
  misc_feature (53)..(53): Xaa can be any naturally occurring amino acid
  misc_feature (77)..(77): Xaa can be any naturally occurring amino acid
MAEIQPPEGQINGAVGTLILHSSEPSIGSKRQRRPSVRLGDIGGDQPYDPHAXATRSRGNSPSTVTTTTTTTTAARXKDPGKPSKTRPLTNLSEFNETLEPCNDREPGNIDTVAIGSWKVKESKKRGSVATKRVRSNWVLRIDDGGGDNGGDEGEGEKYNNGEEDGDDDDGYREFEVENSESPLKDQSPIHSMENLGVDGHRRVFKGREREQHHDGVELSAPSDTDVRDWKCGDRNNENGGGRVRGVEDGVRVWLNGLGLGRYAPVFEVHEVDDEVLPMLTLEDLKDMGISAVGSRRKMYTAIQKLGKGFS

SEQ ID NO: 75239 - protein, 299 aa, Yarrowia lipolytica CLIB122
MISINDRKFLTEALKVSKRLDGRSMEEQRPMEVTFGSQFGHVELTMGKTKVVVRISAEITKPNERRPFEGIFVVHTDIGSMASPIFENNHQSEQEIMISQVVEKAVRRSGALDLESLCIVAGKKCWEIRADVHYLDFDGGLVDATCAAVMAGLYHFKKPDVDVDGGAVTVCDMEERHPVALSVLHLPVSVTYGLFELKNDETNEVEKVECVLDCTAIERQVQNAEITITINKNRDICQISKPSGVSIEGYRIVELCEKAFQEALKVTEMIDKALKEDEEMRNKGNWKALLSAENDRYEK

SEQ ID NO: 75240 - protein, 336 aa, Oryza sativa Indica Group
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASYNNFPTAAGLASSAAGLACFVFTLGKLMNVKEDHGELSSIARQGSGSACRSIYGGFVKWCMGKNNDGSDSIAVQLADEAHWNDLVIIIAVVSSKQKETSSTSGMRDSVETSPLLQYRAQTVVPERVLKMEEAIKSRNFESFARIISLVEKWNQSEGTPRVAYTFDAGPNAVLIAPNRKNATILLQKLLYYFPPQDNDLSRCVNIVMSMTYQSIQESI

SEQ ID NO: 75241 - protein, 459 aa, Staphylococcus aureus subsp. aureus MW2
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVIAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 75242 - protein, 681 aa, Saccharomyces cerevisiae YJM789
MSRSNKPLTQEANSSAHIDRAHQLAQDFNSKQDDTALTSLPHKNPDIFRFENNIMAHSSRRGSLYRDSDATVVLPLSEHTPRLSMDDPYRQLLQQAEISQLRSKKKRHSSRVLRTSFISFVVLVSSLSGLDQGLISGNVMTLSFQKYFHYPLTSPLGNIVSIVNLGAFMASLFVYSGILEPCSRKKMLQISTMIYSLGAIVQVLALNQWCLLLGRFLLGVGMGFAFSMVIIYQFEFPLPCIRKRTLISIQCVSSVIAYSFGIWINCAFRYLGFAWRYPLSTHVALGIILNLMSFYLILESPSWLLKQKNDVEALVLISNVFDDGNFEENQTQLKFRVLKRDILLKSHLQKNSYPYAYILKDFSSIIKLLIGFQLLTRTNGVDAFLYYSPLILQQMGRGERKSIYLTGLNALIYSIVILAYVPLVLRKRKEKTNVLLGSIVMCVLLFTISFTDWFPKSTTRYISILFAVFLFTHFISWDSIGWVMTIELLPHLSQAPVILLVSNFYWIFKWFVSLITPILIDRLSWKFYLIPSLSSFIYIIFVLRIFPIETRDKGLDSDDDSTGNGSGNHDDVFDDTGSEFSSSPSFSAYQINTLGSSIKQNNQAYSSIQNEQILPKNGNLSNQTHGSAQNVYFITSDSGPSRTGEFFSFHNRTDPNISDNIAANKPSSGGGQNSPGDMAVA

SEQ ID NO: 75243 - protein, 380 aa, Ustilago maydis 521
MTGRQAATALLRNAASPALRRCASSSAATATRAPPHLLTLADLSPAQIASVLESAIEFKRAFRASSLALPETSRKQLAAGESPIVQSLKNKSIAIMFSKRSTRTRVASETSVASLGGTGLFLAPSDIQLGVNESLYDTAKVVSSMVDGIMARVGGHDEVELLSKHSTVPVINALSARYHPTQILADLQTMLEIYAPASSPTDLACLAGLKVAWVGDSNNILNDMLVAYPRLGINLSVATPKGPAYQRDELVWGTMQDGLGALSKSGSSPVSLGQVTWSNDPAEAVKDADIIVTDTWISMGDEAQKEQRLRDFAGFQVTEQMAKQGGAKPDWKFMHCLPRKGDEVDDQVFYSDRSVVFPEAENRKWTIMSLFDRMFGRWEL

SEQ ID NO: 75244 - protein, 97 aa, Triticum aestivum
  misc_feature (47)..(47): Xaa can be any naturally occurring amino acid
MEGEKLSSAATFVEGGVYACDHTCSICLKAFCDSDSSTVATSVLQMXTGCKHDLHLQCILEWCQRSSQCPMCWQAINTKDPMSALEKMDMRPQPALA

SEQ ID NO: 75245 - protein, 273 aa, Pseudomonas aeruginosa PAO1
MKTLTLIDGQEVAAIGQGTWHIGEQPGERKREVAALREGIELGMTLIDTAEMYAEGGAEDVVGAAIAGRREEVFLVSKVYPHNASREGLPAACERSLRRLGCETIDLYLLHWQGRYPLEETIEAFERLRDQGKILRWGVSNFDLGDMYELDGSACAANQVMYNLEERGIEYDLLPWCQERGMPVMAYCPVGQGGRLLRHPALGEIAARHDASSAQVALAWLLEQGVIAIPKAVTSAHIRLNAAAADLELSADDLRALDQAFPPPTRKRNLAIV

SEQ ID NO: 75246 - protein, 472 aa, Escherichia coli K12
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAVVFDRHPEIGGLLTFGIPAFKLEKEVMTRRREIFTGMGIEFKLNTEVGRDVQLDDLLSDYDAVFLGVGTYQSMRGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEGSDNAFQTSNPKIFAGGDIVRGSDLVVTAIAEGRKAADGIMNWLEV

SEQ ID NO: 75247 - protein, 388 aa, Mycobacterium sp. MCS
MRALCWNGVNKLSVETVDDPEILNPHDVILKVTLTTTCGSDLHFIDGYLPGMREGDIFGHEFMGEIVETGREVRDVKVGDRVVVPSFIGCDRCWYCEHDLYSCCDTTNPNAELQQPLLGYPSGGIYGYTHPFGGYAGSHAQFVRVPFGDTNCFPIPGDITDEQALFLSDAVPTGFMGADFCDVNGGDTVAVWGAGGVGLMAAKSALLLGAERAIVIDRIPERLSLAGEFGLETIDYGAADSVQESLREMTGGRGPDACIDAVGMEGHSTGLQQVYDRAKQLLRLETDRASALRQAILACRKGGVVSVLGVYGLTDKFPMGVVTNKGLTLRSAQQHGQRYMARLFDYVEQGDLDPAKLITHDLPLEQGVRAYDMFKNKQDNCIRVALRP

SEQ ID NO: 75248 - protein, 556 aa, Streptomyces avermitilis MA-4680
METTLRGVGVSHGVAIGEVRHMGTAVLEPPAKQIPAEDAEREQGRAHKAVDAVAADLIARGNLAGGEAQAVLEAQALMAQDPELMADVERRIAVGSTAERAVYDAFASYRALLAGAGEYLAGRVADLDDVRNRIVARLLGVPMPGVPDSDEPYVLIARDLAPADTALLDPTLVLGFVTEEGGPTSHSAILARALGVPAVVALPGAGEIGEGIVIAVDGSTGEIFVNPSPEKKEQLEAAAAERKAALSASTGPGATSDGHKVPLLANVGGPADVPAAVEAGAEGVGLFRTEFLFLDDSKNAPSEEKQVEAYRQVLEAFPEGRVVVRVLDAGADKPLEFLTPADEPNPALGVRGLRILLEHPDVLRTQLTALAKAAEGLPVYLEVMAPMVADRTDAKAFADACREAGLQAKFGAMVEIPSAALRARSILQEVEFLSLGTNDLAQYTFAADRQVGAVSRLQDPWQPALLDLVALSAEAAKAEGKSCGVCGEAASDPLLACVLTGLGVTSLSMGAASIPYVRATLAKYTLAQCERAAAAARAADTAEEARNAAQAVLSGE

SEQ ID NO: 75249 - protein, 204 aa, Zea mays
  misc_feature (59)..(59): Xaa can be any naturally occurring amino acid
MKFNIANPSTGCQKKLEIDDDQKLRAFYDRRISQEVSGDALGEEFKGYVFKIMGGCEPXDLSVINLVIVKKGENDLPGLTDTEKPRMRGPKRASKIRKLFNLAKDDDVRKYVNTYRRTFTTKNGKKVSKAPKIQRLVTPLTLQRKRARIADKKKRIAKKKSEAAEYQKLLAQRLKEQRDRRSESLAKRRSKLSAAAKASAATSA

SEQ ID NO: 75250 - protein, 239 aa, Vibrio parahaemolyticus RIMD 2210633
MNKTLLAFSLSLLTLSAAQASEWGYGNDKHGPEHWGEIAKDCATTKNQSPINIENPADAKLEALNPSYTGQVIGLTNNGHTLQAQVNGRNSFTIDGETFELQQFHFHTPSENQIKGRQYPLEAHFVHANEDGELAVISVMFDAGDQNAALSKLINAIPQENQTTFFKDTFEINDLLPKTANYYRFNGSLTTPPCSEGVRWFVLKDTQTLSKDQAAKLMEVMGQNNRPLQPLNARVVLSN

SEQ ID NO: 75251 - protein, 285 aa, Mesembryanthemum crystallinum
MEGKEEDVKVGASKYPEKMPLGMARQTKDYKEPPPAPLFEPDELKSWSFYRAGLAEFIATFFFLYVSVLTVMGVSRNPNKCATVGIQGIAWAFGGMIFALVYCTAGISGGHINPAVTFGLLLARKLSLTRAVFYMIMQCLGAICGAGVVKGFESGAYESMGGGANVVASAYTKGDGLGAEIIGTFVLVYTVFSATDAKRSARDSHVPLLAPLPIGFAVFLVHLATIPITGTGINPARSLGAAIIYNKAHAWDDHWIFWVGPFIGAALAAVYHQIVIRAIRFHSKA

SEQ ID NO: 75252 - protein, 438 aa, Pseudomonas aeruginosa PAO1
MSAKDTPAPQAAEPGRAQPVEVPGGGHWWRRLLAFAGPGYLVAVGYMDPGNWATDVAGGAQLGYLLLSVILLSSLMAMLLQALSARLGIASGLDLAQACRERYSPSTCRLLWLACETAIIACDLAEVIGTAIALKLLFGLPLAWGALLCVGDALLVLVLIGRGQRPLEAFVVALLTLIFACFAVQLLLSRPELGEVLQGFLPSPRVLSDPAALYLAIGIVGATVMPHNLYLHSSLVQSRAYPRSLAGKRKALRWAVADSSLALTLALLVNAAILIVAASVFHRNGHTEVVDIEQAHALLSPLLGLELASLLFAVALLASGLNSTVTTTLAGQIVMEGFLRLRLAPWARRLLTRGVAVLPVLLVTLLYGEDGTARLLIFSQVILSMQLPLAVIPLLQFVSDRRLMGPLAIGAGTRWLAWAVALAIVGLNLQLLADFAFG

SEQ ID NO: 75253 - protein, 831 aa, Streptomyces avermitilis MA-4680
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDTFLVISGDALTDFDLTELINFHKEKGALVTVCLTRVPNPLEFGITIVDEEGKVERFLEKPTWGQVFSDTVNTGIYVMEPEVFNYVEADVSVDWSGDVFPQLMKDGKPVYGYVAEGYWEDVGTHESYVKAQADVLEGKVDVEIDGFEISPGVWVAEGAEVHPDAVLRGPLYIGDYAKVEADVEIREHTVVGSNVVVKSGAFLHRAVVHDNVYIGQHSNLRGCVIGKNTDIMRAARIEDGAVIGDECLVGEESIIQGNVRVYPFKTIEAGAFVNTSVIWESRGQAHLFGARGVTGILNVEITPELVVRLAGAYATTLKKGSTVTTARDHSRGARALKRAVISALQTSAIDVRDLENVPLPVARQQTARGSAGGIMIRTTPGVPDSVDIMFFDGQGADLSQGSQRKLDRVFARQEYRRAFPGEIGDLHFPASVFDSYTGSLLRNVDTTGISESGLKVVVDASNGSAGLVLPSLLGKLGVDALTINPGLDESRPTETADARRSGLVRLGEIVASARAAFGVRFDPVGERLSLVDEKGRIVEDDRALLVMLDLVAAERRSGRVALPVTTTRIAEQVAAYHGTQVEWTTTSPDDLTRVGGDESTIFGGDGRGGFIIPEFSSVFDGTAAFVRLIGLVARTQLTLSQIDARIPRAHVLKRDLATPWAVKGLVMRRVVEAAGDRFVDTTDGVRVVESDGRWVMVLPDPAEAVTHLWAEGPDDASAEALLDEWAAVVDSAGR

SEQ ID NO: 75254 - protein, 79 aa, Gluconobacter oxydans 621H
MSDIADKVKKIVVEHLGVDESKVTPDASFIDDLGADSLDTVELVMAFEEAFSVEIPEDAAEKIATVKDAIDYIEKQKAA

SEQ ID NO: 75255 - protein, 252 aa, Mesembryanthemum crystallinum
ELKLWSFYRALIAEFIATLLFLYVTIATVVGNNKADTGVCGGVGLLGIAWSFGGMIFILVYCTAGISGGHINPAVTFGLFLARKVSLIRAVSYMIAQCLGAICGVGLVKAFMKGYYNSVGGGANSVAHGYSKGTALGAEIIGTFVVVYTVFSATDPKRSARDSHVPVLAPLPIGFAVFMVHLATIPITGTGINPARSFGAAVIFNSKKNWDDHWIFWVGPMVGALAAAAYHQYILRAAAIKALGSFRSNPTN

SEQ ID NO: 75256 - protein, 80 aa, Arabidopsis thaliana
  misc_feature (60)..(60): Xaa can be any naturally occurring amino acid
MASSMLSSATMVASPAQAIMVTPFTGIKSTAAFPSTGNAKKYTTSHQKRTVSRVHCKHVXPPIVKKKFETLSYRPDLTDS

SEQ ID NO: 75257 - protein, 183 aa, Bacillus halodurans C-125
MTDKRMVAKQAPRFEMDAVMPNKEFGKVSLEENMKNDKWTVLFFYPMDFTFVCPTEITSLSDRYDEFEDLDAEVIGVSTDTIHTHKAWINTSRDDNGLGDLKYPLAADTNHEVSREYGVLIEEEGIALRGLFIISPEGELMYSVVNHNNIGRDVDETLRVLQALQTGGLCPANWKPGQETLSV

SEQ ID NO: 75258 - protein, 2201 aa, Mycobacterium leprae TN
MTASTPDRRAIITEALHKIDDLTARLEIAEKSSTEPIAVIGMGCRFPGGVNNPEQFWDLLCDGRSGIVRVPSDRWDADAYYTDDHTVPGTICSTEGGFLTGWQPDEFDAEFFSISPREASAMDPQQRLLIEVAWEALEDAGVAPHTIRGTQTSVFVGVTAYDYMLTLAGRLRPEDLDAYIPTGNSANFAAGRLAYILGVRGPAVVIDTACSSSLVAVHLACQSLRHRESDAALVGGTNLLLSPGPSIACSRWGMLSPAGQCKAFDVSADGYVRGEGAGVVVLKRLDDAVRDGNRILAIVRGSAVNQDGASSGVTVPNGPAQQELLRTALASSKLTAADIDYIEAHGTGTPLGDPIELDSLSKVFSDRQSRRGSVPLVIGSVKTNLGHLEAAAGIAGFIKAVLAVQRGFIPRHLNFHQLTTHASEAASRLNIASEGLEWPTVGRPRRAGVSSFGVSGTNAHVVLEQAPDPVAVPAPGPALRLVPAVSTLVVSGKTVQRVAATASVLADWMEGPGAAVPLTDVAHTLNHHRARHTKFGTVAAVDRGQAVAGLRALAAGQSTSGVVAPRDSVVGPGTVFVYSGRGSQWAGMGRQLMADEPAFAEAIAKLEHEFVVQAGFSLHEVIANGKELVGIEQIQLGLMGMQLALTELWRSYGVEPDAVIGHSMGEVAAAVVAGALTPTQGLRVTATRSRLMAPLSGQGTMALLELDAVATEALIADYPQVSLGIYASPRQTVIAGPTAMIDALIDKVRQQDGFATRVNIEVAPHNPAMDALQPQMRSELADLTPQQPTIPIISTTYEDFGSTPVFDVEHWATNMRNPVRFQQAITHASSGVGGDYHTFIEISAHPLLTHSISDILCSIAGTAEENAVGAGYLSIGTLQRDAHDTLEFHTNLNATHTSRPPRTPHPPEPHPVLPITPWQHTRHWISAMSAAYHRADTHPLLGVGVTDPTSGTRVWESQLGPDLLWLGDHVIDDLCVLPGAAYAEVALAAATDTFPNERVEGDQPWMIYELDLHQVLHVTEGTVLVTTLTGDQQRCRIEMRTRNGFSGWTTHATATVGPAESVQPSDREERTATPVDVVDELGPEDLYQRLCSAGQQHGPAFQGIVGLAVEESGAARAEVRLPSSARMGFRDFLLHPVMMDIALQTLGATRMATDLAGGPTARKTLVLPVRFAGVHVYGDVTRGVCAVGLLTATEGLDRLVGEVVLTDLDGQPLLVIDEVQMTVLGAGSDATELTDRLFTLEWEPTPLYKEVSRSSAQGGLLLIGDVAAGDPLLLALQSSLRARLSENGPPPVDCVSFSDEVKLQAAITRTDISWDGIVVVCPPRASDESLPDDAQLELAQTRTLQIAGVVQAVTQMGARKSPRLWIVTRGAQQLNAGESVTLAQTELRGIVRVLTFEHSELKATLLDIEADGTDSLDDLTEELLAGSNHDEVAYRDGQRYVNRLVPAPITPKGELAGETRRKVVELGGLGAVQLQIDQPGRLDALTVHQVKRGEPEGDQVEVRVVAAGLNFSDVLKAMGVYPGLDGGAPAIGGECVGYVTAIGDDVDSVEVGQRVIAFGPGTFGTYVGTIADLVVPIPDTLSDHEAATFGVAYLTAWHCLCEVGRLSPGERVLIHSATGGVGMAAVSIAKMLGARIYTTAGSDAKRQMLSELGVEYVGDSRSVDFADEILELTHGYGVDIILNSLADKAIQRGVQILAPGGRFIEIGKKDVYDDANLGLAALAKSASFSVVDLDLNLKLHPARYRQLLQHILAHVADGRLPVLPVTEFSLHNAADAFRLMASGKHTGKIVISIPYEGNIEAIASPPPVPLVSQDGGYLVVGGMGGLGFVFARWLAEQGAGLIVLNGRSSPSDDVTAAIADLTAAGHRIEVVTGDISEPGTADRLVHAVQSAGFRLAGVLHSAMVLADEIMLNMTDSAARRVFVPKVTGSWRLHQATAAFEVDWWLTFSSASSLLGTPGQGAYAAANAWVDGLVAYRRSLGLPAVGINWGPWAEVGRAQFFAGLGVSLLTAEQGLAAMQTVLAADRAQTGVFSLDARQWFQSFPAVAGSSLFANLRDTATLKSGERRGVGKIRAQLDVLDAAERPGHLASAIADEIRAVLRSSDPIDHDRPLEALGLDSLMGLELRNRLEASLGITLPVALVWAYPTTADLAAALCERMDYALPAEVQEATDTNAELSKAEMDLLSDLVEASELEAATRGES

SEQ ID NO: 75259 - protein, 374 aa, Solanum tuberosum
MRPLQPPPPAANSTSSAAASSMPPPSSAGQRSRPRRRTDLTLPLPQRDVALAVPLPLPPTSAPSSSSSSSSSPLPTPLHFSELERVNRIGSGTGGTVYKVLHRPTGRLYALKVIYGNHEDSVRLQMCREIEILRDVDNPNVVRCHDMFDHNGEIQVLLEFMDKGSLEGIHIPLEQPLSDLTRQVLSGLYYLHRRKIVHRDIKPSNLLINSRREVKIADFGVSRVLAQTMDPCNSSVGTIAYMSPERINTDLNHGQYDGYAGDIWSLGVSILEFYLGRFPFSVGRQGDWASLMCAICMSQPPEAPPTASREFREFIACCLQRDPARRWTAAQLLRHPFITQNSPGTHTGPATTSLSNQAHQLLPPPPHFSSSSSS

SEQ ID NO: 75260 - protein, 487 aa, Escherichia coli
MITEFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALA

SEQ ID NO: 75261 - protein, 520 aa, Oryza sativa Japonica Group
MGACFSSHTATAAADGGSGKRQQRKGDHKGKLPDGGGGEKEKEAARVEFGYERDFEGRYQVGRLLGHGQFGYTFAATDRASGDRVAVKRIDKAKMVRPVAVEDVKREVKILKELKGHENIVHFYNAFEDDSYVYIVMELCEGGELLDRILAKKNSRYSEKDAAVVVRQMLKVAAECHLHGLVHRDMKPENFLFKSTKEDSPLKATDFGLSDFIKPGKKFHDIVGSAYYVAPEVLKRRSGPESDVWSIGVITYILLCGRRPFWNKTEDGIFREVLRNKPDFRKKPWPGISSGAKDFVKKLLVKNPRARLTAAQALSHPWVREGGEASEIPVDISVLSNMRQFVKYSRFKQFALRALASTLKEEELADLKDQFDAIDVDKSGSISIEEMRHALAKDLPWRLKGPRVLEIIQAIDSNTDGLVDFEEFVAATLHIHQMAELDSERWGLRCQAAFSKFDLDGDGYITPDELRMHTGLKGSIEPLLEEADIDKDGRISLSEFRKLLRTASMSNLPSPRGPPNPQPL

SEQ ID NO: 75262 - protein, 94 aa, Glycine max
MDTQKSQPEKQSSSTATAPSVTSCRKKKNEEAAFLDDLKDHIDEFINASMDEHKTCFKKTIQKMFGMSKAVAEGQSNASKEVESSLPLQTTVQD

SEQ ID NO: 75263 - protein, 182 aa, Rhodobacter sphaeroides 2.4.1
MLPGSKLPSVTFRTRVRDDSLGGPNPFRWQDMTTEDYFAGKRCVLFALPGAFTPTCSTYQLPGFEKGFADFQAHGIDAIYCLSVNDSFVMNQWAKAQGLENVQVIPDGSGEFTRRVGMLVRKDNLGFGLRSWRYAAIVKDGRVEAWFEEPGLCDNHGEDPYGVSSPDTVLEWLAADAQGAAA

SEQ ID NO: 75264 - protein, 305 aa, Staphylococcus aureus subsp. aureus MW2
MFQKLSIFATKSFLVWMLVAAVIGFISPQHVATLGKWVPYLLGIVMLGMGLTITPNDFKMVFKAPRAVIIGVCLQFSIMPTLAFIIAKSFHLPPDIAVGVILVGCCPGGTSSNVMSYLAKANVALSVSITTVSTLLAPFVTPALIYLFANEWLEVSFLSMLWSVVQVVLIPIALGIVLQIINRKIAEKASTALPIISVVAISLILAIVVGGSKHQILTTGLLIFLVVILHNVLGYTIGYWLARLLKLDRQDQKAVSIEVGMQNSGLAVSLAALHFNPIAAVPGAVFSFIHNITGPILAKYWSKKL

SEQ ID NO: 75265 - protein, 396 aa, Mesorhizobium loti
MLAHRTNLFGTSGTAAARAAAKAAADAGKEIIDLTAGEIWSELAPTIRDGAIDAINKGVNRYTDSVGMVELREALARKISLDTGQIWKAEEVAVTSGAKQALFNAAMVLLNPGDEVIIPAPYWTTFPAQVLIAGGTPVFVDTKSNGYVPRPEHIKEAVTERTRAIVVNTPSNPAGAVYDVETLMAIAELAVSRNLWIIFDECYGDFVHGGHTHHPIVSVAPEIRARALIVNSFSKSLALTGWRIGYLAGPKGVINAVKALQSHTTSNPNVIAQHAVLAHLQRGGSDYEGKLRSRLTSARRVGLDVLSSLTRVPVARAQGGFYFYLDLSHLLRPGAEDGASTTADDIVTGLLAEAGVAAVSGTAFGDPAGLRLSYGIPPEKLATGLARLVEFLNAWK

SEQ ID NO: 75266 - protein, 195 aa, Mycobacterium marinum
MSLLTIGQQFPAYSLTALIGGDLSKVDAKQPGDYFKTVTSDDHAGKWRVVFFWPKDFTFVCPTEIAAFGKLNDEFEDRDAQVLGVSIDSEFVHFQWRAQHDDLKNLPFPMLADIKRDVVAATGVLNADGVADRVTFIVDPNNEIQFVSATAGSVGRNVDEVLRVLDALQSDELCACNWRKGDPTLDAGELLKASA

SEQ ID NO: 75267 - protein, 183 aa, Zea mays
MSSPSKRREMDLMKLMMSDYKVEMVNDGMQEFFVEFRGPNESIYQGGVWKVRVELPDAYPYKSPSIGFINKIYHPNVDEMSGSVCLDVINQTWSPMFDLVNVFEVFLPQLLLYPNPSDPLNGDAAALMMRDRPAYEQKVKEYCEKYAKPGDAGVTPEEQSSDEELSEDEDDSGDEEIMGKPDP

SEQ ID NO: 75268 - protein, 278 aa, Zea mays
MVSSSRAVVVVVGLLVAASSLAVAASDGGGPTYGYTAGSPDGPENWGKLSPAYKLCGQGKQQSPIDIVTKQAVPNANLDTLNRTYAATAATLINDGHDITMTFEGKVGTVMVNGKAYSFEKMHWHSPSDHTINGQRFPLELHLVHRSADGALAVIGILYQLGAPDSFYYQLKRQLGEMAKDRCSFGEEESHEGVALIHLRSLQKRTGSYFRYTGSLTVPPCTENVVWSVLGKVRQISKEQLQLLKAPLPGNDARPTQPLNGRTVQFYNPPNSTVSFHM

SEQ ID NO: 75269 - protein, 309 aa, Anabaena variabilis ATCC 29413
MWEYTEKVLELFYNPKNQGAIADSNEAGVAVVFGEVGSIACGDALRLHLKIEVDTDKILDARFQTFGCTSAIASSSALTELVKGLTLDAALKVTNKEIAEYLGGLPEAKMHCSVMGQEALEAAIFKYRGIPVAAHDDDEGALVCRCFGISESKVRRVIRENNLTTAEQVTSYIKAGGGCGSCLADIDDLISAVIKESAPVGTSYKLSTQIAATTQKQSPRQLTTVQKIALIQKVLDEEVRPLLIADGGDIELYDVQGDNVQVVLQGACGSCPSSTATLKVAVEAKLQERVSQSLRVEAVDPLFSVSRAR

SEQ ID NO: 75270 - protein, 472 aa, Synechococcus sp. RS9916
MGKTAQDVLNTIKNEGIELIDLKFTDLHGKWQHLTVCTDLLDEDAFTDGLAFDGSSIRGWKAINASDMAMVPDPKSAWIDPFYRHKTLSMICSIMDPRTGEPYERCPRALAQKALNYLSSTGLADTAFFGPEPEFFLFDDVRYESSNGSSSYSVDSIEAPWNTNRVEEGGNLANKIQLKEGYFPVSPNDTSQDIRSEMLLTMGSLGVPIEKQHHEVATAQHELGMKFAELIQAADNVMTYKYVVRNVAKKYGKTATFMPKPIFADNGSGMHVHQSLWKAGAPLFFGEGTYANLSQTARWYIGGILKHAPSFLAFTNPTTNSYKRLVPGFEAPVNLVYSEGNRSAAVRIPLTGPSPKAKRLEFRSGDALANPYLAFSAMMMAGIDGIKNQIDPGDGVDVDLFELPADELAKIATVPASLNGALEALREDHHYLLEGGVFTKDFIDNWIEIKYEEVQQLRQRPHPHEFTMYYDA

SEQ ID NO: 75271 - protein, 230 aa, Mycobacterium sp. MCS
MSRATLDKNPHEVASMFDAVARRYDLTNTVLSLGQDRFWRRETCAALGIGPGDRVLDLAAGTAVSTVELAASGAWCVAADFSVGMLSAGRQRDVPKVAGDATRLPFADESFDAVTISFGLRNVVDHVAGLEEMARVTRPGGRLVVCEFSTPTNRAFATLYKEYLMKALPRMARAVASNPDAYVYLAESIRAWPDQAGLARRIEAAGWSQVRWRNLTGGIVALHAAVKPPR

SEQ ID NO: 75272 - protein, 262 aa, Gluconobacter oxydans 621H
MTFDPIAVRLEAARSVVRDAARLALSLRPAPGGPTGTLKGRQDYLTETDGAVEAFVSRRIQELFPEDGFQGEENGATRQGGFRWVVDPIDGTSNYARGRDRWCVSLGLLDGDKPVAGVIDAPALGEVFTAQKGKGAFLNGKPIKASPITNTQEAMIEMGWSARVTTETFNEKIAAIMALGAMPRSGGSGALALADVACGRSDGYLEIVIQLWDVAAALVILSEAGAAVSPFLQTGGLTGGATILAAAPGIAKALSAAVDVEI

SEQ ID NO: 75273 - protein, 377 aa, Synechococcus sp. RS9916
MAPIATPDRLLLGPGPSNAHPTVLQSLSRTPIGHLDPLYVELMAEVQELLRYAWQTDNRLTLPMSGTGSAAMEATLANTVEPGDRVLVAVKGYFGNRLVDMAGRYRADVRVVEKPWGEAFSLDELEAALIEHKPAILAMVHAETSTGICQPMDGVGDLCRKHNCLLLLDTVTSLGGVPLFLDAWKVDLAYSCSQKGLSCPPGLGPFTMGPRAEEKLAARKDKVPNWYLDVSLLNQYWGSNRVYHHTAPVNMNFGMREALRLLAEEGLEQSWSRHRSNAEALWSGLEGLGLVMHAPVELRLPTLTTVRIPEGVDGKAFTQHLLDNHGIEVGGGLGTLAGKIWRIGLMGYNSTPENVNRLLNLFETELPKFRQPAVAAA

SEQ ID NO: 75274 - protein, 431 aa, Bacillus thuringiensis
MSKFNKFDKCNHIPFPCAFPPLQEGPTGPTGSTGPVGPTGPTGTGEGITGPPGPTGDPGPAGPQGVPGIQGEQGDPGPTGPQGVPGIQGEQGDPGPTGPQGVPGIQGEQGDPGPDGPQGVPGIQGEQGDPGPTGPVGPTGAGVTGPTGLPGPTGPGAGATGPTGPAGPTGPGGGATGPTGPTGPGGGATGPTGATGLQGPPGPAGPTGPQGNQGIQGEPGPEGPTGPQGNQGIQGPAGARGPTGPQGPQGIQGPAGARGPTGPQGNQGIQGPTGPQGPQGPQGPQGPVGPTLTANNIYVANPSTNINVVGSPGRNAPIPMTTTVTRNGTILTLASPGISVSTTGTYYIIAKGTIESPVNARAAIALALNGILIPQTSSLANLPFGSTPISGTQVMTFAIVNISASQVITVVNNDVENSVFGNVSIGVFRIG

SEQ ID NO: 75275 - protein, 290 aa, Streptococcus pyogenes M1 GAS
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLAFPFKAAALITEQAMTVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 75276 - protein, 459 aa, Vibrio parahaemolyticus RIMD 2210633
MTQNIKPTHFRSEGDVNTTPARQAWNASMDDERTQVLLKRDSEVFLHQAMSTPCLDTLDAAEGIYIQDATGKKYMDFHGNNVHQLGYGHPHVIKRVQEQIAKLPFSPRRFTNETAIECAEKLTQICGGELNRVLFAPGGTSAVGMALKLARHITGNYKVVSLWDSFHGASLDAISVGGEACFRQGMGPLMAGVERIPPAVSYRGAFPVADGSDVHYADYLEYVIEKEGGVGAFIAEAVRNTDVQVPSKAYWKRIREICDKHNVMLIIDDIPNGMGRSGEWFTYQAYDIEPDMLCIGKGLGGGLVPIAAMVTKDKYNTAEQISMGHYTHEKSPIGCAAALATMEAIEQDGLLDKVKADSQFMREKLLEMKAKYPVIGDVRGIGMLWGIELVTDHESKARAYDEAEAVLYQCLNNGVSFKVSQGNVIQLSPPLIITREQLTEALAIFEEAIAKVCKDFNYF

SEQ ID NO: 75277 - protein, 411 aa, Xylella fastidiosa Temecula1
MSAVSESVLSLSRYYLPVYRPCQVVLVRGQGSRVWDEQGRDYLDLAAGIAVCCLGHCDPDLVAALVEQAGRLWHTSNVFYSEPSLRLAQELVDVSRFAERVFLCSSGTEANEAAIKLVRKWAAAQGRLPEHRTIVTFRGSFHGRTLGAVTATAQPKYQEGYEPLPGGFRYVDFNHIEALEAAMVGGDVAAVMLEPIQGEGGVMPIAPGYLAQVRALCDRYGALLVLDEIQCGMGRTGTLFAYWQEEVVPDIVTLAKGLGGGFPIGAMLAGPKVAEVMQFGAHGTTFGGNPMAAAVARVALRKLASVEIAANVQRQSVALRAGLEEISEAFGGVFTQVRGRGLMLGAVLAPLYAGQASAILEVAAEHGVLLLQAGPDVLRFVPALNVSDEELADGLVRLRAALGDYVSRCRG

SEQ ID NO: 75278 - protein, 307 aa, Arabidopsis thaliana
MEGRLNNMWRLTVNESKFVESALQSELRVDGRGLYDYRKLTIKFGKEYGSSQVQLGQTHVMAFVTAQLVQPYKDRPSEGSFSIFTEFSPMADPSFEPGHPGESAVELGRIIDRALRESRAVDTESLCVLAGKLVWSVRIDLHILDNGGNLVDAANVAALAALMTFRRPDCTVGGDNSQDVIIHPPEEREPLPLIIHHLPIAFTFGFFNKGSILVMDPTYVEEAVMCGRMTVTVNANGDICAIQKPGEEGVNQSVILHCLRLASSRASATTKIIRDAVEAYNRERSSQKVERHHTLAKSEVLGPIVVV

SEQ ID NO: 75279 - protein, 203 aa, Xylella fastidiosa Temecula1
MSSPLECAKYLLSAHTPHQLPSDDGSEVAFAGRSNAGKSSVLNTLTRQNALARVSKTPGRTQQLVYFTVTPQRYLVDLPGYGYAKVPKELQIHWQAFIDTYFHHRQSLRGLVVVMDIRHPLKEYDLQMLAYARQRGLPAQALLTKADKLGRGQQAQTLQKVRNELTKHFADHINIQTFSSKSRQGVEQLHTVIETWLGLARSG

SEQ ID NO: 75280 - protein, 168 aa, marine gamma proteobacterium HTCC2143
MPFTGPDVILDNPTFIHESALLFGKITIGPESTVWPYVVMRAEILEIRIGRRTNIQDFVMIHIGNNSPTIIGDNCSITHHCTIHGARIGDNCLIGINATIMDGVKIGKNCIIAGHTIVKENTVIPDNSIVAGSPGKVIRTMDNSEANKMNADFYYQNGINYSQQIYRM

SEQ ID NO: 75281 - protein, 445 aa, Zea mays
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAASGRSVQKNRRKKPACTLSTVLSARSKAACPVTEKPKEPIEDIDKFDGDNQLALVDYVEDIYTFYRPPMHESRPIDYMGQTSPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTGPQRAADTGRAKTLVGSHAASASPDARLKAVYQKYATEQFGRVALHPPAPAALPDLV

SEQ ID NO: 75282 - protein, 467 aa, Mycobacterium leprae TN
MTHYDVVVLGAGPGGYVAAIRAAQLGLSTAVVEPKYWGGICLNVGCIPSKVLLHNAELAHIFTKEAKTFGISGDASFDYGIAYDRSRKVSEGRVAGVHFLMKKNKITEIHGYGRFTDANTLSVELSEGVPETPLKVTFNNVIIATGSKTRLVPGTLLSTNVITYEEQILTRELPDSIVIVGAGAIGIEFGYVLKNYGVDVTIVEFLPRAMPNEDAEVSKEIEKQFKKMGIKILTGTKVESISDNGSHVLVAVSKDGQFQELKADKVLQAIGFAPNVDGYGLDKVGVALTADKAVDIDDYMQTNVSHIYAIGDVTGKLQLAHVAEAQGVVAAEAIAGAETLALSDYRMMPRATFCQPNVASFGLTEQQARDGGYDVVVAKFPFTANAKAHGMGDPSGFVKLVADAKYGELLGGHMIGHNVSELLPELTLAQKWDLTATELVRNVHTHPTLSEALQECFHGLIGHMINF

SEQ ID NO: 75283 - protein, 153 aa, Vitis vinifera
MDAASSSSANDMMVMDYGDEPHVLAVDDNLIDRKLIEKLLKNFSCRVTTAENGLRALEYLGLGDNQQTSHKASVSKVNLIITDYCMPGMTGYELLKRVKQSSILKEVPVVIMSSENIPTRINKCLEEGAQMFMLKPLKQSDVKKLRCYLKHRS

SEQ ID NO: 75284 - protein, 530 aa, Crocosphaera watsonii WH 8501
MQFNLNAYPYASQRRVILAKNCAVATSQPLATLAGIEMFQSGGNAVDAAIATAITLTVVEPTSNGIGGDAFALVWDGKLQGINGSGKSPKNLPLSAYSSLEKMPDIGWLTVTVPGAVSVWYEVWQRWGKLPFEQLFAPAIRYARNGFPVSPVTAEIWRRKEVVYLTKKRPEYQYFQQVFFPKKRAPKAGEIWGSVLHAQTLEEIANTGGESFYKGKIAEKINNFAADTGGYITSDDLAIHTPLWVDPIATKYKELEVWEMPPNSQGIAALMALNIVEGLNIEQYKRDSVDSFHYQIEAMKLAFADAYAYVSDPDFMKVTNSNLLEKNYAKQRQELINNQAIPLANHGIPQGGTVYLCTADAELMVSFIQSNYDTFGSGILVPETGISLHNRGSAFTLEKGHSNQIAANKRPFHTIIPGFLTKDNQPIGPFGVMGAPMQPQGHLQMVVNLTDYQMNPQTALDAPRWRFLEGNSVLLEMGASPEIIAGLRERGHDVKLAPETMFGKGQMILKNNGVLIAGSEPRADGLALGY

SEQ ID NO: 75285 - protein, 452 aa, Vitis vinifera
MVASRLQPPFLNPLFSSNYYSSHPLPSPSRPTFLALSANPQETSEPAKDRQKVVRIAWEKLVRWSRSWRSKAKTDVLERTNKVVVLGGGSFGTAMAAHIAARKAQLEVNMLVRNSQVCQSINENHCNCKYFPEHKLPENVIATTDARAALLGADYCLHAVPVQFSSSFLEGIADSVDPTLPFISLSKGLELNTFRMMSQIIPQALGNPRQPFIALSGPSFALELMNKLPTAMVVASKDKKLANATQQLLASSHLRISTSSDVTGVEIAGALKNVLAIAAGIVEGMNLGNNSMAALVAQGCSEIRWLATKMGAKSTTIMGLSGTGDIMLTCFVNLSRNKTVGIRLGSGEKLDDILGSMNQVAEGVSTAGAVIALAQKYNVKMPVLTAVARIIDNELTPKKAVLELMNLPQVQSYKKYTYKSPFFHFSLETLWWSAMYHHPLCIFAINIFIFCF

SEQ ID NO: 75286 - protein, 405 aa, Nakaseomyces delphensis
MSEMHRLLTFPERPISESYLEGLGSFLNAGVPATYTLEQVAAYERSERGDDLPEEGEDASNTTPLHILARSLPKDLSKEEKAVVLKMMDMLFEYGAGWNFIDYDNKTIGDLILQNNGGDRECPLYQRVVEAGVCAELLLRKLNGGEVEFIDTAELQNQVEDQVEQKRLNTQEPAVNEVNDDATAADPETYLKTKLKYTDDALITEHNKDGVMMDWETNIMKLAADTLTSSQPAGECVVLNIGFGMGIIDTFLNEKKPKKHYICEAHPDVLAKMKEDGWYEKEGVVVLEGKWQDTLNKLLDDGTVFFDGIYYDTFSEHYEDMLDLYDLIVGLIKPEGIFSFFNGLGADRQLCYDVYKKIVEVDVATYGMKCEYDIVSLVGQLPDWNDVKRSYFNCDYYYHPKIFFA

SEQ ID NO: 75287 - protein, 236 aa, Rhodobacter sphaeroides 2.4.1
MSFDRRIKIAPSILSADFANFGAECRAIEAQGCDWVHVDVMDGHFVPNLTFGPAMCAAIRPHIKGVMDVHLMIAPVDPYIEAFAAAGADVITAHLEAGPHIHRTLQAIRGTGRKAGLALNPGTGLDAVGHLLDLLDLVCIMTVNPGFGGQKFIASQVDKVRDLRAMIGDRPIHIEIDGGVTPETAPLVAAAGADVLVAGSAVFKGGSVDNPEPYGANIRAIRAAAEASLGRAFAAK

SEQ ID NO: 75288 - protein, 280 aa, Polaromonas sp. JS666
MRIAAANLIACLGPVGTYSEDAAILYFGSSSKRLLLPSLDAIFEACESGLASHSVVAVENSTEGAVPRTLDLLYKTELQICGELSLLLRHDLLTQSGQLHGVTRVRAHAQALAQCHGWLSTNAPHLIREAVSSNAEGARLAAQDPTSAAIGGLRSAEEYGLLAAFHAVQDDPNNRTRFFVLSRKDNASEALGVGCKTSIIVSVPNEVGALFRVVEPFARHGVSMSRFESRPVKSGAWDYNFYIDIVGSRLEEKVANALAELQQQGAKVKLLGSYFDTDQH

SEQ ID NO: 75289 - protein, 302 aa, Pediococcus pentosaceus ATCC 25745
MNTVTIIGSINLDRTIRVKQMPKPGETMHTKEIFSAGGGKGANQAVAAKRSEAKTNFIGAVGNDDAGRAMLELLEHENIDMSGIETLDNQSTGQAYIVVDDAGENQIMIHAGANTAFTPEYVQSKADLIKNSDFIIAQFESSLDSVTEAFKIAREAGVKTILNPAPAVEKVPSDLLAVTDMIIPNETETEILTGIEVTDEASMKKASKALHDEGIEAVLITIGSKGTFYDVNGKSGIIPAFKVKAVDTTSAGDTFIGAMSTVLNKDFSNLEDAILYGNKASSLTVQRFGAQPSIPYKKELEK

SEQ ID NO: 75290 - protein, 559 aa, Arabidopsis thaliana
MKKKQQKQEFVAETSEMNNNNECSGQDQQKRYVWPWVGLVANVPTEVEPSGRRVGKSGSTLRDEFTLKGFNPTRVKPIWNTKGHTGFALVEFAKDFKGFESAMQFEKSFDLDRHGKRDWKKGHRLRDDKLYGWLAREDDYNRSDTVGKNVKKKRDLKSISQIVEEDQRKLYHLFENMCQTIEKNKQRKQQLEQKVDETLESLEFHNLMLNNSYQEEIQKMEKNMQEFYQQVLGGHEKSFAELEAKREKLDERARLIEQRAIKNEEEMEKTRLEREMIQKAMCEQNEANEEAMKLAEKHQASTSLKEKEKLHKRIMEMEAKLNETQELELEIEKLKGTTNVMKHMVGCDGDKDIVEKIAKTQIELDARETALHEKMMTLARKERATNDEYQDARKEMIKVWKANEELMKQEKIRVKIMGELNPAPFLPAVMNKHKAMMLCSVWAAEIGDVQWTPFRVDESDGTPKQKLHISQHSKCEMQRVVDENDEKLRMLKNQYGEEVYSEVVRAKLEMEEHNASGSYETEELWNYEENRKATIEEITDVMLKIRSKLAAMKNKRKRP

SEQ ID NO: 75291 - protein, 182 aa, Mesorhizobium loti
MTVKKKVPFVTFRTRVRDESIEGPNPYRWEDKTSDDYFSGKRIILFSLPGAFTPTCSTLQLPDFEMLYDEFEKEGIDAIYCVSVNDAFVMNAWGKALGLKKVQLIPDGSGEFTRKMGMLVAKDNLGFGMRSWRYAAVINNGVVEQCFEENGFCDNSEADPYGVSSPQNVLETLRAAKAVTAA

SEQ ID NO: 75292 - protein, 447 aa, Pediococcus pentosaceus ATCC 25745
MSEKLDEVDSKSLDEINGSIKVPKNAGFWKTLMAYSGPGFLIAVGYMDPGNWITSIAGGAQFRYTLLSVILLSSLIAMLLQAMSARLGIVTGKDLAQLTRERTSKRVGFLLWIVAELAIMATDIAEIIGSGIALELLFHIPLIIGILITAADVLILLLLMKLGFRKIEAIVATLVAVILIVFAYEVLLSDPSISGIIKGYVPSVEILGNNSMLYLSLGIVGATVMPHDLYLGSSISQTREVDRKDRENVAQAIRFSTIDSNMQLFLAFIVNSLLLILGAALFYGTDSSLGRFVDLFNALSNNQIVGAIASPVLSMLFAVALLASGQSSTITGTLSGQIIMEGFIRLRVPLWVQRLVTRVLSVAPVLIFAIYYHGDEAKIENLLTFSQVFLSVALPFAVIPLVIYTSSKKLMGEFANRAWVKWCAWTATIVLILLNIYLILQTLGLIK

SEQ ID NO: 75293 - protein, 464 aa, Mycobacterium leprae TN
MRIAQHISDLIGGTPLVRLNSVVPAGTGVVAAKVEYFNSGGSSKDRIAAKMIDAAEASGQLKPGGTIVEPTSGNTGVGLALVAQHRGYKCVFVCPDKVSEDKRNVLLAYGAEVVVCPTAVPPDDPDSYYSVSDRLVAKIDGAWKPDQYANPAGPASHYETTGPEIWADTDGRVTHFVAGIGTGGTITGVGRYLKEVSGGLVRIIGADPEGSVYSGGTGRPYLVEGVGEDFWPAAYDPMVPDQIIAVSDSDSFNMTRRLAREEAMLVGGSCGMAVVAALQVAEEAGPAALVVVLLPDGGRGYMSKIFNDAWMSSYGFLRSRLDGSTEQPIVGDVLRRKSGALPDLVHTHPSETVRDAIGILREYAVSQIPVVGAEPPVMAGEVVGSVSERELLSAVFEGRASLADAVSEHMGPPLRLIGDGELVSVAGEALRDSDALMVVEKGKLVGVITRYDLLGFLSEGAPLR

SEQ ID NO: 75294 - protein, 446 aa, Ustilago maydis 521
MPPSMESSTSSGSSEPVTPPLNRNATWAASRSAAADASETTPQKGPSAPTDSSSPLSLRKRFASFTRSAGKNVSGSLSAGATSPSVTPLQDSSQRIERLDLQKGAVGANTGDPPTLSNHASSAPISRRGSFTETGERDVFSAPPKDDILDDSPLQCILRSPNARALPGHPGNLTPTQTQALHELTQALKSDGALHDPESEPPSYQETQLLRFLRARSFNVQAARAMYLKAEAWKKEIDLDRLVREFSFDERDAVAAHGWCMYFHKTDKLGRPIFIQDLGSMNCTEVFRKTTPERVIQKFAVTLELAVRHRYEPCTIASGRWVDDNMMVINLAGLGLSTFWSMKGQLQQLLSILDNNFPELSGRVQIINAPYMFSTIWSWVKGWLPTATVEKIDIAGAEYKEAVFEYVRKEDWPKDLGGECECRDEQGCRKSDPGPWDKRLVRTADL

SEQ ID NO: 75295 - protein, 443 aa, Aspergillus oryzae
MARGRSSSNLGADIPGDTSAPAMSTMNEVSPIETEAPKWNKSSEKSLKSQPKRRKSRSLLRRFKDKCLKHTWLLPLLMVVVLLALYAVNPNPSNPLHSAIFLSYPQGPKTPGGPVMYGKGPKDVAFVSFYTIVLSFTREFIMQRIIRPWAIYCGIRGKGKTARFMEQVYTAIYFGIFGPFGLYVMYRSDIWYFNTTAMYEGFPHREHEALFKAYYLLQASYWAQQAIVLLLQLEKPRKDFKELVGHHIITLALIALSYRFHFTYMGLAVYITHDVSDFFLATSKTLNYLDSFITAPYFGMFVGIWIYCRHYLNLKILWAVLTEFRTVGPFELNWDTQQYKCWISQYITFALLASLQAVNLFWLFLILRILKNYLFNSIRKDERSDDEDTEEEEEVEQGQSGRATLATGAEVSTVTARNVGKENQAPQVLVNGEPLNEKSSSRR

SEQ ID NO: 75296 - protein, 241 aa, Nostoc sp. PCC 7120
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNSDVPIQYGGSVKPNNIDEIMAQPEIDGVLVGGASLEAASFARIVNYL

SEQ ID NO: 75297 - protein, 385 aa, Buchnera aphidicola str. Sg (Schizaphis graminum)
MPSKNDLLSFRSEINNIDKNIVQLLAKRKKLVLNIAESKIKNNQPIRDIEREKILLEKLTNLGKKNNLNTNYITRLFQLIIEESVLTQKKLLNKFCNDNNLDLASFSFLGPKGSYSHIAASQYAEQNFKTCIENACLSFNEVIQSVENNQTDYAVLPIENSCSGFINEIFDILKKTNLFIIGEINISINHCLLAIKKIELNKIKAVYSHPQPFQQCSYFIKKFPNWKIQYTNSTADAMKKIVKYNITTNAALGSELGSKIYGLKVLYKNLANKKKNITRFILLSRKPVSISSKIPTKTTLIFNTGQESGALAEVLLILKKNKLIMKKLTSQNIYKNPWEEMFYIDVQANLSSSLMQETLEKIGKITKFIKILGCYPSENITPIIP

SEQ ID NO: 75298 - protein, 525 aa, Treponema denticola ATCC 35405
MEWKNLDKCTSFTQLQKAHKEQAENLKLADIFDTENSVKRVKNYSVKMGGNLKYNYAAKPVNDEILKALQSLADEQKLIEKYELLLNGDFINTGENRMVLHQLTRGQLKNDVVYKGVNMRSFYLNELKKIKEFSEAVHSGKIKTSQGKVFTDVVQIGIGGSDLGPRAMYIALKNRAKKKMRAHFISNVDPDDAAEVLNSINLASTLFILVSKSGTTQETLANERFVKSVLEKNGLDCKKQMLAVTSETSPLANNPDYLTSFYMDDFIGGRYSSTSVCGAAVLALAFGMETVEAFLKGAAEGDKLSLNKNIKENASLLDALLGVYERNILGCSATAILPYSQALSRFPAHLQQLDMESNGKTVNRFGEKVSYKTGPVIFGEPGTNGQHSFYQLLHQGSDIIPLQFIGFKKSQIGLDIESEGSTNMQKLNANLAAQIMAFAAGKTDENKNKDFAGNRPASLIYGEELNPENLGALLAHYENKVMFQGFIWNLNSFDQEGVQLGKTLAKKVLSNDMPPALKAFSEFLL

SEQ ID NO: 75299 - protein, 212 aa, Treponema denticola ATCC 35405
MKIINAEFIKGAVKAEQFPEIGVSEFAFFGRSNAGKSSLINMLVNRKNLVKTGSRPGMTREVNFFLVNRPASLNFNPKTKKFSGPAPKDMFVLTDLPGYGYAKLSGGMTLQIDKMLYEYCTNRPLLKIIFFLMDMRREPTETEKESIGFFHGLNIEVVIVGTKADKIGKNDQIKAKNDWADFFNFDEELIIISSAAKKTGRDNILSLIAKRI

SEQ ID NO: 75300 - protein, 418 aa, Mesorhizobium loti
MRPVYLDNNATTRVDPEVVQAVLPFFTDQFGNPSSSHDFGASAGAAVRKARLRVQTLIGAEFEDEITFTSGGTESDNAAILSALEVMPERTEIVTSAVEHSAVLTLCAHLEKTRGIKVHRIPVDRHGRLDLDTYKAALTPRVAIVSIMSANNETGTIFPVVELAELAKEVGALFHTDAVQAVGKLAIDLKSTAIDMLSLSGHKLHGPKGVGALYVKRGVRFCPLIKGGGQEGNRRAGTENTPGIVGLGVAADLALKFMDDANTRVKALRDRLEKELLQRIPHAFVAGDLLKRLPNTANIAFGDIEGEGILHFLNREGIACSSGSACACGSLEPSHVLVAMNIPNSAAHGAIRFSFSRNNGEEDVDRVLEVMPGIVKKLRELSPSASQARGLQSAPGLGDKANPTTVSGPGECNAQLFR

SEQ ID NO: 75301 - protein, 259 aa, Vibrio campbellii AND4
MTDTSVQSNTALDNDTTHFGFTTVAKDEKVTKVAEVFHSVAAKYDIMNDLMSGGVHRLWKRFTIDCSGARPGQRVLDLGGGTGDLTAKFSRIVGEQGHVILADINNSMLNVGRDKLRDNGIVGNVHYVQANAEELPFPDNYFDIITISFCLRNVTDKDKALRSMFRVLKPGGRLLVLEFSKPVLEPLSKVYDAYSFHLLPKMGELVANDADSYRYLAESIRMHPDQKTLEGMMQDAGFENTKYFNLTGGIVALHRGYKF

SEQ ID NO: 75302 - protein, 714 aa, Yarrowia lipolytica CLIB122
MHSHRSSKKSQKPFKSKHASKGSIKALNKGKIEKASAGNKAVKTMGKWDRRNQKDQIRAAKMVELATDRKLFDGKSGAPKIVTVVGMSEDVDVNGLVCKMMGLESLQSKISTHEVERFKQKFTVITPSLDNFLEVLDAARIADFVILAFSPVAAFNDSEYILKCVAEQGVSNVISVVTETGMLTDKKRVERIDEIKTFSDYFFPQDKIFDIENATDCANLVRNIAQKFPKGVNWRDQRAFVLADNVQEVDGQVCVSGVVRGKGFNLLRTVHLPGYGDFKIAKAEVLKHGQAELVIPGEDVLAKNDGDDEDMDMEEDDVMEEEEEIQDQQLGVKVDGHHYFPDTAREAMQEKYAKRRVPKGTSEQQAKWLIDETLINSDDEFEDEQMEEDEVDMDAEDGAHVEFDMDEETRQLEEYKSLREELDFPDEVELKPGESAKERFAKYRGMKSLRNWDASQDDYPEEYKNCVTFNYNAMKNRVLKDSTDLQPGQYVKLYIEAPVSIVSEAQEHADSPFVVYGLHKYESDQAVCHVTMNPCFDQEETAPIKSKDELILQLGPRRLVVNPLYGTESTIAKFDRFLTRPCMATYIGPATFGNVPALWFRKSENGAMELVGTGSFDSTDPRKMLIKRAVLTGHPFKIHKKLVTIRYMFFNPEDINWFKAVPLFTKMGRSGFIKMSLGTHGYMKATFDQHLNGMDTVAMALYKRVWPKVARELE

SEQ ID NO: 75303 - protein, 333 aa, Silicibacter pomeroyi DSS-3
MTIKVGINGFGRIGRCTLSHIAASGRDDIEVIKVNATGPLETAAHLIKYDSVHGRFPGEVSLGEGTMNLGRGDMQMFSTYDLNELDWSGCDVVLECTGKFNDGAKAKVHLERGAKKVLLSAPGKNVDKTIVFGVNDDQLTAADTMISNGSCTTNCLAPLAKVLDEAFGIEHGIMTTIHAYTGDQPTLDRRHKDLYRARAAAMSMIPTSTGAAKALGEVLPNLKGRLDGSAIRVPTPNVSAVDLTFRAGRDVTTAEVNAAVEAAAKGPMKGVLGYEPAPLVSTDFNHTPESSIFAPDQTRVVENRMVRVLAWYDNEWGFSVRMADVAVAMGRLG

SEQ ID NO: 75304 - protein, 533 aa, Oryza sativa Indica Group
MDSSTVGAPGSSLHGVTGREPAFAFSTEVGGDDAAAASKFDLPVDSEHKAKTIRLLSFANPHMRTFHLSWISFFSCFVSTFAAAPLVPIIRDNLNLTKADIGNAGVASVSGSIFSRLAMGAVCDMLGPRYGCAFLIMLAAPTVFCMSLIDSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGASLKFAENSRSERGRRNVINAAAAAATPPNNSPEHA

SEQ ID NO: 75305 - protein, 415 aa, Panax notoginseng
MGSLGAILKHPDDFYPLLKLKFAARHAEKQIPPEPHWAFCYSMLHKVSRSFGLVIQQLGPQLRDAVCIFYLVLRALDTVEDDTSIPTEVKVPILMAFHRHIYDKDWHFSCGTKEYKVLMDEFHHVSNAFLELGNGYQEAIEDITMRMGAGMAKFICKEVETIDDYDEYCHYVAGLVGLGLSKLFHASGAEDLATDSLSNSMGLFLQKTNIIRDYLEDINEIPKSRMFWPRQIWSKYVDKLEDLKYEENSAKAVRCLNDMVTNALVHAEDCLKYMSDLRDPAIFRFCAIPQIMAIGTLALCFNNTQVFRGVVKMRRGLTAKVIDRTKTMSDVYGAFFDFSCLLKSKVDNNDPNATKTLSRLEAIQKTCKESGTLSKRKSYIIESESGHNSALIAIIFIILAILYAYLSSNLLPNKQ

SEQ ID NO: 75306 - protein, 144 aa, Silicibacter pomeroyi DSS-3
MLVQAILKSKASDGVVTVSAAATVAQAAAILAEKRIGTVVVSDDGETAQGILSERDIVRELAASGSGCLSEPVSTYMTKDLITCGRDAKVQDVLSQMTEGRFRHMPVIEEGKLVGLVTLGDVVKAQLAELAMEKDALEGMIMGH

SEQ ID NO: 75307 - protein, 263 aa, Staphylococcus xylosus
MFTDLEGKVVVITGGSSGIGKAMVEQFGKEKAKVVINYLSESSLDDVAESIKLIEDAGGQAIKVHADVSKEEDVNNLIKAAVDTFGTLDILINNAGFEKPIPTHEMPLEEWQKVIDINLTGAFIGSKAAVNQFLKEDKKGIILNTSSVHDRIPWPNYVNYAASKGGLKLMMETMSMEYAQHGIRINNISPGAIVTEHTREKFSDPETRAETLEMIPAKEIGEADQVANVARFLCSDLADYIHGTTIYVDGGMTNYPAFMGGKG

SEQ ID NO: 75308 - protein, 209 aa, Panax notoginseng
AHLKGGAKKVVISAPSKDAPMFVVGVNEKEYKPELNIVSNASCTTNCLAPLAKVINDRFGIVEGLMTTVHSITATQKTVDGPSSKDWRGGRAASFNIIPSSTGAAKAVGKVLPALNGKLTGMAFRVPTVDVSVVDLTVRLEKKASYDQIKAAIKEESEGKLKGILGYTEEDVVSTDFIGDSRSSIFDAKAGIALNENFVKLVAWYDNEW

SEQ ID NO: 75309 - protein, 140 aa, Triticum aestivum
MEHKETGCQSREGPILCVNNCGFFGSAATMNMCSKCHKEMAMKQEQAKLAASSFDSIVNGGDAAKEHLAAGNTAVAVAHVEAKTLITAQPADIAGPSEAAMENPKGPSRCSTCRKRVGLTGFNCRCGNLYCATHRYSDKI

SEQ ID NO: 75310 - protein, 141 aa, Bordetella pertussis Tohama I
MSIERTLSIIKPDAVAKNVVGQIVARFEQAGLKVIAARMQQLSRTDAERFYAVHKERPFFKDLVDFMVSGPVFVQVLEGESAIQKNRDLMGATDPKKAAPGTIRADFADSIDANAVHGSDAPETAAVEVAFFFPEINIHSR

SEQ ID NO: 75311 - protein, 499 aa, Silicibacter pomeroyi DSS-3
MQELTHYINGEHVKGTSGRFADVFNPATGDVQAKCPLASTEEMARAVEIAAAAQPAWAAVNPQRRARVMMKFVDLLNRDMDKLAEALSREHGKTLPDAAGDVQRGLEVVEYCIGAPHLLKGEFTDSAGPGIDMYSMRQPLGVTAGITPFNFPAMIPMWMFAPAIACGNAFILKPSERDPSVPLMLAELMEEAGLPKGILQVVNGDKEAVDAILYNPVIQSVGFVGSTPIAEYIYGTGCAQGKRVQCFGGAKNHMIIMPDADMDQAADALVGAGYGAAGERCMAISVAVPVGDDTADRLIEKLVPRIEKLKVGPYTAGKDVDYGPVVTAAAKENILRLVNSGVEQGAKLVVDGRDFSLQGYEDGFFVGPHLFDHVTPDMDIYKKEIFGPVLSTVRAKTYEEALGLAMDHEYGNGTAIFTRDGDAARDFANRINIGMVGVNVPIPVPLAYHTFGGWKKSAFGDLNQHGPDAFKFYTRTKTVTARWPSGIKEGGEFSIPVME

SEQ ID NO: 75312 - protein, 99 aa, Anabaena variabilis ATCC 29413
MTTYQVRLINKKRAIDITIPVDENTTILDAAEQQDIELPFSCQSGSCSSCVAKVVEGEVDQSEQVFLDEEQMAKGFIVLCVSYPRSDCTIRTHQEPYLV

SEQ ID NO: 75313 - protein, 272 aa, Streptomyces avermitilis MA-4680
MRIRIVDAFTDRPFAGNPAGVLLLDAFPDDAWLQDVAREVNHAETAFAHRLPRGEGGEADWALRWFTPATEVAMCGHATLATAHVLHTSGTHEGPVRFATRSGVLIATPREDGSITLDFPTAPLTPVEIPEGVAEALGAEPLTACDTGPNVGDLLIELADEKTVRGLAPDLRALARYSERGIIATARAEDPAQGHDFVSRCFFPNVGIDEDPVTGSAHTALAPFWSQRLGRPDLTGLQASPRSGHVRTELRDDRTLLTGRAVTVIDGELLTP

SEQ ID NO: 75314 - protein, 341 aa, Mycobacterium sp. MCS
MAHAQRQPKVVVLGGGSWGTTVASICSRRAPTIQWVRSEDTAKDINANHRNSRYLGEDVVLSESLRATTDFAEAASSADVVVMGVPSHGFRGVLEKLAAELRPWVPVVSLVKGLEQGTNMRMSEIVDEVLPGHPAGILAGPNIAREVADGYAAAAVLAMPDQHLAAQLAELFRTKRFRTYTTDDVVGVEMAGALKNVYAIAVGMGYSLGIGENTRAMVIARAVREMSKLGEAMGGHRDTFAGLAGMGDLIVTCTSQRSRNRHVGEQLGSGKPIDEIIASMNQVAEGVKASKVIMEFADEYGLNMPIAREVDSVINHGSTVEQAYRGLVAEKPGHEVYGSGF

SEQ ID NO: 75315 - protein, 522 aa, Schizosaccharomyces pombe 972h-
MRIWFKKVPDGITSSVILSEDHLVDDLKDAIARKFPIRISQYYDAPELSIRVVAPPNASSELQSRELSPNESILFVMETYYPHGQDFNDALLVASPDTSVALRYRSSQLSSSTFESTPPVFSEYPPNIIPTPANETVPRIKQPSIALDSLESPVSAPSRHQSTYSYKGGPLNYNLRNASRTRSHQTLPSSNVNKTGVLLLPRSSRQQTLASRPSLPDLTSADKSQPSDEAESITRKNSIGMSTRSDESTAEKLAKAEVATPTNSRSISHSSLYTKQSGTAGVLPAVNADIDAANRMNPDISSQFPIADNKDPLNADTQAHLGFPSNQIDGIVGTSPVNVLTSPGIGAKAPFASLLEGVIPPINVLIVEDNIINQKILETFMKKRNISSEVAKDGLEALEKWKKKSFHLILMDIQLPTMSGIEVTQEIRRLERLNAIGVGAPKLTQPIPEKDQLNENKFQSPVIIVALTASSLMADRNEALAAGCNDFLTKPVSLVWLEKKITEWGCMQALIDWNGWCRFRGR

SEQ ID NO: 75316 - protein, 581 aa, Kluyveromyces lactis NRRL Y-1140
MTHFSKNMDTKQQDLSSLSEVGQSFAKEETWSVEKQLKPLAEEKDYADMNDVEKAIYNTKDSKLNKDLSIRHLLTLAVGGAIGTGLFVNSGDSLSTGGPASLVIAWTIISTCLFTIVNSLGELSATFPVVGGFNVYVTRFVEPSFGFAVNFNYLAQWAILLPLELCAASITIRYWNKSINPDAWVSIFYVAIAFANMLDVKSFGETEFVLSMVKILAIIGFTILGIVLICGGGPSGGFIGGKYWNDPGAFVGDTPAQRFKGLSAVFITAAFSYSGLELVGVSAAESRNPRVTLPKAAKRTFWLITMSYLVILTLIGCLVPSNDPLLLNGTSSVDAAASPLVIAIQNGGIKGLPSLMNAIILIALLSVANSAVYACSRCIISMAEIGNLPRSLAHVDKKGRPLYAIAITLLVGLLSFIAASNKRDEVFTWLSALSGLSTLFCWFAINLAHLRFRHAMKHQNRSLEELPYVSMTGEWGSWYGCIVIGLVLIASFWTSLFPAGGNGADATSFFESYLSLPIFIACYLGHKIWKRNLRLYIKLSEVDVDSGRTDTDAATLKQEKEAEAELMKTKPFYIRLWNFWC

SEQ ID NO: 75317 - protein, 473 aa, Moorella thermoacetica
MAKEYDVVILGGGTGGYVAAIRASQLGLKTAVVEKGKLGGTCLHAGCIPSKALLRSAEVYAQTKNSEAFGVIVGDVRLDFAKVQARKATIVDQLHKGVQHLMKKGKIDVYAGIGRLLGPSIFSPLPGTVSVEMNDGSENEMLVPKFVVIATGSRPRTLPGLEPDGEFVMTSDEALQMEVLPSSILIVGGGVIGMEWASMLNDFGVEVTVLEYADRILPTEDEDVSKEMEKLLLRRGVNIVTGARVLAETLEKGNGVTIQAEHQGERKTFAADKMLVSIGRQANIEGIGLENTEIVVENGYIQTNEFGQTKESHIYAIGDVIGGLQLAHVAAHEGIVAIEHLAGRNPAPIDYSMVPRCIYTRPEAAAVGLTEQEAKAKGYDVKIGKFLFKAIGKALVFGEAEGFVKLIADRNTDDLLGVHMVGPHVTDLISEAGLARVLDAAPWEVAHAIHPHPTLSEAMAEAALAVDGKAIHF

SEQ ID NO: 75318 - protein, 140 aa, Agrobacterium tumefaciens str. C58
MAIERTFSMIKPDATKRNLTGAITKVFEDNGLRIVASKRVWMSKREAEGFYAVHKERPFFGELVEGMTSGPTIVQVLEGENAILKNREIMGATNPAQAAEGTIRKSFALSIGENSVHGSDAPETAAQEIAYWFAETEIVG

SEQ ID NO: 75319 - protein, 532 aa, Magnaporthe grisea 70-15
MEKLKVAVIGTGPTGLSMLKVLRDDGFRVTAFERRSRVAGLWSYSDNTTYTTALSTTEANISKYPCGFADFPIHDKYPPYMKAAHFQEFMEDYAKHFDLLKDIVFDTTVRRVARNEADTKWLVQVEKQGGAVEELEFDKVALCHGYQTLAKMPTYPGQDKFEGVLIHGQAFRNGEAFKDKTVIVAGASASSGDVIPSLIPHARKVYLSHRSGGLPIRRWVKGKPVDLNITWRRRQVGFFLQRYLPTLHKFLSDVGLSLVARLTNGPLDPAWRLQPYPSLTLKLTGIWESVMDGLRAGTVTSLHGIKRFTGPRSVEMDDGTVLDDVDAVICCTGYQADWGIAPFVQTSMPSEYGYAGTPLYRLYMNLFPPEYADSCALLCYSAFGKSNGFTFADLSAQAISNVWRGVEPLPSKAAMDKHIDAHQAWVASRWKQDPSIDTSCVKTWEFQGWLHRAAGTGMENIGWGWKGWKFWWKDPEMYRLMNHGVETAHAFRYFETGKRKAWSGAREAIIEVNKRASIFPLKKEALEDAKKR

SEQ ID NO: 75320 - protein, 223 aa, Streptococcus pyogenes M1 GAS
MDLLTNKKKIFETIRLSTEAANRTNDSVSVIAVTKYVDSTIAGQLIEAGIEHIAENRVDKFLEKYDALKYMPVKWHLIGTLQRRKVKEVINYVDYFHALDSVRLALEINKRADHPVKCFLQVNISKEESKHGFNISEIDEAIGEIGKMEKIQLVGLMTMAPANASKESIITIFRQANQLRKNLQLKKRKNMPFTELSMGMSNDYPIAIQEGSTFIRIGRAFFH

SEQ ID NO: 75321 - protein, 174 aa, Zea mays
LKDSTISQISGGWRHTMALTSEGKLYGWGWNKFGQVGVGRQGDHSSPGQVSFPEDQKISQVACGWRHTLALSEKKNVFSWGRGTSGQLGNGEIVDRWNTPVLSNALTSNGPACRKLESSTAAPFAAKVWVSPSERYAIVPDENVRKAGGGTARGNGADANVPENDVKRMRVQSS

SEQ ID NO: 75322 - protein, 379 aa, Oryza sativa Japonica Group
MALRGGHAAAAAGVSSGSEDDDEEAGFSRSYFLAKEKEPSSGKKRARAAGKLSDLNLVDEQVLRASLAEIPPKHEREVEALTRSYKEQYRNWLFELRCGFGLLMYGFGSKKMLLEDFASTTLSDFTVIVVNGYLPSINLKQVIVTVAEIFWEQTKLKRKRQTATRSQLQPFASQSIDDIISFLNDQTSDNGDDNVCLLIHNIDGPALRDAESQQYLAQVSCCPQVHVVASVDHVNAPLLWDKKLVHTQFKWSWYHVPTFAPYKVEGVFYPLILASGGHAQTMKTALVVLQSLTPNAQSVFRVLAEYQLAHEKEEGMHFSSLYTKCRERFLVSSQVTLNSHLTEFKDHDLVKIRKHSDGQDCLHIPLVSDALEKLLQELT

SEQ ID NO: 75323 - protein, 195 aa, Agrobacterium tumefaciens str. C58
MASRAYNIPNLLTYARILAVPVIVLCFFIEGKLESSDFARWTALWLFIVASLTDFLDGYLARIWNQTSNIGRMLDPIADKLLVASVLLLMAADGTIAGWSLWAAITILCREILVSGLREYLAALKVSVPVTQIAKWKTTIQMVAIAFLLAGPAGDKVLPYTTEMGITLLWLAAALTMYTGYDYFKAGLKHIVDEE

SEQ ID NO: 75324 - protein, 533 aa, Nakaseomyces delphensis
MSTENTSLVVELLEYVKLGLGYFMELPLAQRISILAALPFVYTVTWQLLYSLRKDRPPLVFYWIPWVGSAVPYGTRPYEFFEECHQKYGDIFSFMMLGRIMTVYLGPKGHEFVFNAKLADVSAEAAYTHLTTPVFGKGVIYDCTNQRLMEQKKFVKGALTKEAFVRYVPLIADEIYKYFRNSKNFLINEKNSGVIDVMVTQPEMTIFTASRSLLGKEMREKLDTDFAYLFGDLDKGFTPINFIFPNLPLEHYRKRDNAQKVISGTYMSLIKERRANNDIKDRDLIDELMKNSTYKDGTKMTDQEIANLLIGVLMGGQHTSAATSAWCLLHLAERPDVQEELYEEQMRVLNNDTKELTYDDLQNMPLLNQMIKETLRLHHPLHSLFRKVMRDVPIPNTSYVVPKDYHVLVSPGYTHLQEEFFPKPNEFNIHRWDGDSASSTAVGGDEVDYGFGAISKGVTSPYLPFGGGRHRCIGELFAYCQLGVLMSIFIRTMKWRYPNEGDTVPKSDFTSMVTLPTAPAKIYWEKRHPEQKY

SEQ ID NO: 75325 - protein, 2145 aa, Saccharomyces cerevisiae YJM789
MPVLKSDNFDPLEEAYEGGTIQNYNDEHHLHKSWANVIPDKRGLYDPDYEHDACGVGFVANKHGGQSHKIVTDARYLLVNMTHRGAVSSDGNGDGAGILLGIPHEFMKREFKLDLDLDIPEMGKYAVGNVFFKKNEKNNKKNLIKCQKIFEDLAASFNLSVLGWRNVPVDSTILGDVALSREPTILQPLLVPLYDEKQPEFNETKFRTQLYLLRKEASLQIGLENWFYVCSLNNTTIVYKGQLTPAQVYNYYPDLTNAHFKSHMALVHSRFSTNTFPSWDRAQPLRWLAHNGEINTLRGNKNWMRSREGVMNSATFKDELDKLYPIIEEGGSDSAALDNVLELLTINGTLSLPEAVMMMVPEAYHKDMDSDLKAWYDWAACLMEPWDGPALLTFTDGRYCGAILDRNGLRPCRYYITSDDRVICASEVGVIPIENSLVVQKGKLKPGDLFLVDTQLGEMVDTKKLKSQISKRQDFKSWLSKVIKLDDLLSKTANLVPKEFISQDSLSLKVQSDPRLLANGYTFEQVTFLLTPMALTGKEALGSMGNDAPLACLNENPVLLYDYFRQLFAQVTNPPIDPIREANVMSLECYVGPQGNLLEMHSSQCDRLLLKSPILHWNEFQALKNIEAAYPSWSVAEIDITFDKSEGLLGYTDTIDKITKLASEAIDDGKKILIITDRRMGANRVSISSLIAISCIHHHLIRNKQRSQVALILETGEAREIHHFCVLLGYGCDGVYPYLAMETLVRMNREGLLRNVNNDNDTLEEGQILENYKHAIDAGILKVMSKMGISTLASYKGAQIFEALGLDNSIVDLCFTGTSSRIRGVTFEYLAQDAFSLHERGYPSRQTISKSVNLPESGEYHFRDGGYKHVNEPTAIASLQDTVRNKNDVSWQLYVKKEMEAIRDCTLRGLLELDFENSVSIPLEQVEPWTEIARRFASGAMSYGSISMEAHSTLAIAMNRLGAKSNCGEGGEDAERSAVQENGDTMRSAIKQVASARFGVTSYYLSDADEIQIKIAQGAKPGEGGELPAHKVSKDIAKTRHSTPNVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAVLLGAESFTLATVPLIAMGCVMLRRCHLNSCAVGIATQDPYLRSKFKGQPEHVINFFYYLIQDLRQIMAKLGFRTIDEMVGHSEKLKKRDDVNAKAINIDLSPILTPAHVIRPGVPTKFTKKQDHKLHTRLDNKLIDEAEVTLDRGLPVNIDASIINTDRALGSTLSYRVSKKFGEDGLPKDTVVVNIEGSAGQSFGAFLASGITFILNGDANDYVGKGLSGGIIVIKPPKDSKFKSDENVIVGNTCFYGATSGTAFISGSAGERFGVRNSGATIVVERIKGNNAFEYMTGGRAIVLSQMESLNAFSGATGGIAYCLTSDYDDFVGKINKDTVELESLCDPVEIAFVKNLIQEHWNYTQSDLAARILGNFNHYLKDFVKVIPTDYKKVLLKEKAEAAKAKAKATSEYLKKFRSNQEVDDEVNTLLIANQKAKEQEKKKSITISNKATLKEPKVVDLEDAVPDSKQLEKNSERIEKTRGFMIHKRRHETHRDPRTRVNDWKEFTNPITKKDAKYQTARCMDCGTPFCLSDTGCPLSNIIPKFNELLFKNQWKLALDKLLETNNFPEFTGRVCPAPCEGACTLGIIEDPVGIKSVERIIIDNAFKEGWIKPCPPSTRTGFTVGVIGSGPAGLACADMLNRAGHTVTVYERSDRCGGLLMYGIPNMKLDKAIVQRRIDLLSAEGIDFVTNTEIGKTISMDELKNKHNAVVYAIGSTIPRDLPIKGRELKNIDFAMQLLESNTKALLNKDLEIIREKIQGKKVIVVGGGDTGNDCLGTSVRHGAASVLNFELLPEPPVERAKDNPWPQWPRVMRVDYGHAEVKEHYDRDPREYCILSKEFIGNDEGEVTAIRTVRVEWKKSQSGVWQMVEIPNSEEIFEADIILLSMGFVGPELINGNDNEVKKTRRGTIATLDDSSYSIDGGKTFACGDCRRGQSLIVWAIQEGRKCAASVDKFLMDGTTYLPSNGGIVQRGYKLLKELASQV

SEQ ID NO: 75326 - protein, 229 aa, Pediococcus pentosaceus ATCC 25745
MAKLVLIRHGQSQWNLSNQFTGWVDVDLSDEGVKQAQNAGKLIKEAGIEFDQAYTSVLTRAIKTLHYALEGSDQLWIPETKTWRLNERHYGALQGQNKAEAAEKWGDDQVHTWRRSYDVLPPLLDADDEGSAANDRRYANLDPRIIPGGENLKVTLERVIPFWEDEIAPKLIDGKNVIIAAHGNSLRALSKYIENISDEDIINLEMATGEPVVYDFNEKLEVQSKTKLN

SEQ ID NO: 75327 - protein, 191 aa, Picea sitchensis
MALDEQTNKLFRIRRTVLQMLNDRDYLVGDFEINTTKEQFLDKFGEDPKKEDLVINKAKRNSPSEQIFVFFPEEAKVGVKSIKTYVERMKSEGVFRAILVVQQALTPFARQSVQEFSGKFHLEVFQEAELLVNIKEHVLVPEQQILTPEEKKTLLERYTLKETQVCFSLVLTGLLILRCLGIFEYRMTVST

SEQ ID NO: 75328 - protein, 396 aa, Brassica oleracea
MNCLFMFKSKKPKSRRDLKKENKDKRGRELLQKSAPDLSTTRKNQTSSTSLSLPTPRSLPSPTSIRELYTERQQNRNLRVFSYKELSEATCGFDRKFQIGEGGFGNVYKATINNPTGGDSYSVPHTVAVKRLKKQSQQGHKQWLAEVQLLGVVNHPNVVKLLGYCSEDTERLLVYELMSNLSLEDHLFTRRTPTLPWKQRLEIMLGAAQGLAYLHEIQVIYRDFKSSNVLLDDDFNPKLSDFGLAREGPEGDNTHVTTVRVGTDGYAAPEYVETGHLRKHSDVYSFGVVLYEIITGRRTIERMKPSAEKILLDWVKLYPVNSKSFRVIVDSKLQSKYPVALVSRVAKLADLCLKKNDTERPTMAFVVESLSKIIEESNTGDMRSSIRESTRGVMRA

SEQ ID NO: 75329 - protein, 389 aa, Rhodococcus sp. RHA1
MSLLSRRRADAKVDPADVRTALARVEDPELHLPLEEAGMLGEVEVDRSGVARVTVRLTTPSCPLKETLTTDVTAAVRAIAGVSGVEVAFAAMGEGERMRLAARLRGSVPLGAHSFGPGSATQVYAVASGKGGVGKSTITANLAVALVQQGKRVGILDADVWGYSIPHLFGVRRAPVALKGLMLPVEAFGVALMSVGFFVRDDEPVVWRGPMLHKAIEQFLDDVYWGELDVLLIDLPPGTGDVTLSLLEFVPDAALIVVTTPQPAAQTVAQRVGRMALDSRTPVAGVVENMSAMICSSCCESTPLFGAGGGQRLAEAIAAPLLGQVPLDIELREAGDAGVPALIAAPRAASATQIRQIAASLPILRRSLVGRSLPLTVRPHHAHGMSVDD

SEQ ID NO: 75330 - protein, 386 aa, Saccharomyces cerevisiae YJM789
MSASTVGKPIKCIAAVAYDAKKPLSVEEITVDAPKAHEVRIKIEYTAVCHTDAYTLSGSDPEGLFPCVLGHEGAGIVESVGDDVITVKPGDHVIALYTAECGKCKFCTSGKTNLCGAVRATQGKGVMPDGTTRFHNAKGEDIYHFMGCSTFSEYTVVADVSVVAIDPKAPLDAACLLGCGVTTGFGAALKTANVQKGDTVAVFGCGTVGLSVIQGAKLRGASKIIAIDINNKKKQYCSQFGATDFVNPKEDLAKDQTIVEKLIEMTDGGLDFTFDCTGNTKIMRDALEACHKGWGQSIIIGVAAAGEEISTRPFQLVTGRVWKGSAFGGIKGRSEMGGLIKDYQKGALKVEEFITHRRPFKEINQAFEDLHNGDCLRTVLKSDEIK

SEQ ID NO: 75331 - protein, 443 aa, Oryza sativa Indica Group
MDRAGLMEQLVSTCTAGWHPDLCRSIGKSGIFESDDSLEQGYFAQWGEDGVVDIKYEMGNLILLIANRCLLGKQFGESKLEQVSTLLHELFDNGFHLISLFFPYLPTPQHRRRDKARAMLGEMIHEAVRSRRNSGVAEDDVLQKFLDSKYINGRCMTENEIAGLLICMMFAAQHTSSSTSTWTGACLLSHGHRSYLAAAIQEQKRIIQQHGDRINWGILLQMTTLTHCIKEALRLHPPANLLIRHASKSFSVQTRQGHRYQIPKGHTLATCTTVGNRLPYIYKDPNVYDPSRFGPGREEDKVGGKFSYTPFSAGRHVCLGEDFAYMQIKVIWSHLLRNFDLELISPFPEEEWEKFIPGPKGKVMAEVETAGGRDGVNGGLAGDRRSRGGAPGWRQGRCWRREHPGSDGAEAKVRGMVMVAQGSEDGGSVAFGVDSRPQAMKHE

SEQ ID NO: 75332 - protein, 612 aa, Treponema denticola ATCC 35405
MEYQVTATRRRPQRFEDLLGQEFVAATLQKSIEAGKIAHAYLFSGPRGCGKTSSARILAKVLNCAEGPRPTPCGHCTSCEEITAGSCLDVIEIDGASNTSVNDVRQIKDEILFPPNSNRYKIYIIDEVHMLSTSAFNALLKTIEEPPPYVVFIFATTEIHKVPATIKSRCQQFNFKLVSIEILKQALADAAAELGISADDEALYWIAREATGSVRDAYTLFDQVAAFSDGHITFEKIHEKLGLTGVDSINKLVSACVAKNGQEALSILDGILQGGISVEQVVSDCADYFRSLLLVKHGITKEALIGQRADRFPQDILQGWEAVQIERALSIMLQLFKDLRFSIDQRYELELAVSRLSWLGDYVSPADLKTAFDAAKSLISSRRTDVETGRPLPHREESRPKESPRPFDNAGSLTEQFKAVLRRDNKLDVFTEKKNEEKQPVSNNVPSDNVSFEKKDEAQETVLQTVRSVENAFNNVEELKEPLIEALLEKSGILSSAVGQSKDWILKEDSLTLFARSSFDYTLIQKQKDTVIDSISEITGKKIKLILKEYIPPQPENKVEETVKEPEKIRTITDVFMGKIVECKNLISESEEGEENEVQNVQNPAAIQEQNS

SEQ ID NO: 75333 - protein, 239 aa, Picea sitchensis
MAMSSLSFKFVGHSIVDVHTIKPRSICFNHLHSRIRCSDGSNDNVSIQVKTSPVERFKSIACGLCAVWAVTATYPTFAATSTPRLPPLSNDPNRCERAFVGNTIGQANGVYDKPIDLRSCDFTNEKTNLRGKSLAAALMSDAKFDGADMSEVIMSKAYAVGASFKGVDFSNAVIDRVNFGKANMQDAVFRNTVLSGSTFVDANLEGAKFEDTIIGYIDLQKLCTNQTLSDEGRDILGCR

SEQ ID NO: 75334 - protein, 223 aa, Vibrio campbellii AND4
MELTVSVKIHYQNTHFITSAPDIRHLPEDEGVEIAFAGRSNAGKSSALNRLTNQKSLAKTSKTPGRTQLINLFKVQEGCHIVDLPGYGFAQVPIEMKNKWQKSLGEYLQKRECLKGLVVLMDIRHPMKDLDQQMIFWAIDSRIPVQVLLTKADKLKSGARKQTLLKVRKQAETFGGDVSVDVFSSLKGLGVDQLRAKLDIWFAPALAHLIEASEQETQQSGDE

SEQ ID NO: 75335 - protein, 578 aa, Helicobacter pylori 26695
MQVLALKYRPKHFSELVGQESVAKTLSLALDNQRLANAYLFSGLRGSGKTSSSRIFARALMCEEGPKAVPCDTCIQCQSALNNHHIDIIEMDGASNRGIDDVRNLIEQTRYKPSFGRYKIFIIDEVHMFTTEAFNALLKTLEEPPSHVKFLLATTDALKLPATILSRTQHFRFKKIPENSVISHLKTILEKEQVSYETSALEKLAHSGQGSLRDTITLLEQAINYCDNAITESKVAEMLGAIDRSVLEDFFQSLINQDEARLKERYAILENYETESVLEEMMLFLKAKLLSPDFYSILLIERFFKIIMSSLSLLKEGANASFVLLLLKMKFKEALKFKALDDAILELEQTPFNQNPSISYNAPKQESKNIEKREKIEQIERIEGTEKREKLEKKENAETPQTPMLSAKDRIFHNLFKQVQTLVYERNYELGAVFEKNIRFIDFDSQTKTLTWESLATDKDKELLRERFKIVKSIVDGVFGKGESIKIALKNHSENKSTLEVVKELKFPYSKPKPTTETTAETKEKETKEKEIQENDTKEIQEVQPKQAPTALQEFMANHSELIEEIKSEFEIKSVELL

SEQ ID NO: 75336 - protein, 468 aa, Treponema denticola ATCC 35405
MDLSYKQKSAWENLTKAELSELGKLSDSYLDFLDNGKTERECTVEIIKQAKKHGFKSLEEVVKSGSAKKGTKVYLNNKEKSVVLMVLGDDITQGMNIIGAHIDSPRLDLKQMPLFEESNMAFLKTHYYGGVKKYQWTTIPLAIHGVIFTKEGKKVDICIGEDEKDPVLFINDLLIHLSKKQLQETMSEGITGEQLNILVGNQKPSSKEKKDDKKEESKNPVKDNILKILNEKYGIIEEDFRVAELEVVPAGKARNVGFDSSLIAGHGHDDRVCAYTSLKAILEVESPKRTAVALFADKEEIGSVGNTGMQALYFENMVAEIAALNKNYRDIDVRRAFANSYMLSADVSAGFDPAFPSVFEKMNSAYIGNGICINKYTGSGGKGGSNDANAEFLQRIRKIFDDNKVVWQTAELGKIDAGGGGTIAYIIAKYGAEVVDCGVPVLSMHAPFEILSKADLYMAYKAYRAFYK

SEQ ID NO: 75337 - protein, 357 aa, Solanum tuberosum
MALQIAKRLLRCRADSVASSVRFFDRTFTSESNSNLIRATLFPGDGIGPEIAESVRQIFKVAEVPIEWEEHYVGTEVDPRTNSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEIKYEEVVIDNCCMMLVKNPALFDVLVMPNLYGDIISDLCAGLIGGLGLTPSCNIGEGGIALAEAVHGSAPDIAGKNLANPTALLLSSVSMLRHLELHDKADRIQDAILKTIAGGKVPNWRPWRHCYNN

SEQ ID NO: 75338 - protein, 604 aa, Mycobacterium sp. MCS
MDATPFGHYRLQKLIGRGGMGEVYQAYDTHTDRVVALKVLPPHLAQDATFQRRFRREAQAAAGVQDPHVVPIHSYGEIDGRLYLDMRLIEGRNLGTILEGADKPLLPSFAVKVVEQVATALDAAHAAGLIHRDVKPSNILITDRDFVYLIDFGLARSAGEPGMTTAGSTLGTLAYMAPERFNGGRIDPRSDIYALTCVLYECLTGVRPYPADSLEEQIAGHIVRPVPKPSDTDPRLAAFDEVIERGMAKKPERRYQSAAEMAAAARRALTSPVRWSSRSGRHSARSARIPMRRRLTRRAAAVTGVVLVVVAVSGAVTWQWSGWPERTRAPRQVVVAEDTPTPAPTPGAVPSIAATVPADVRESGRLVIGVNVPYAPNEFRDAYGDIVGFDVDLMKAVARTLGLVPEFRETAFESVIPSVQSGAFTLGMSSITDTLEREKAVDFVTYLEAGTLWAQRAGSEVVDPSNACGLRVGVAYSVIQETDELPAKSEACVAAGREPIRKVVFTEQDDVTAALLAGEVDAMSADSPVTGFAIKTSGGALEPAGEVFDSAPYGWPVAKGSALAESLRQALEHVMATGEYRTIATMWGVEKGMIAAPVVNGAVR

SEQ ID NO: 75339 - protein, 446 aa, Bordetella pertussis Tohama I
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQHRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMSKGSGFFQHGHTYLGHATACAASLAVQEVIRRDGLLARVRQQGDGLRQRLMQALGAHPHVGDIRGRGLFLGVELVRDRATKATFDPELALHARVKREAMARGLMVYPMGGTIDGRHGDHVLVAPPFIIADDELDQLVERLAGAIDAAIAQTRA

SEQ ID NO: 75340 - protein, 704 aa, Pseudomonas aeruginosa PAO1
MHTFFIAPTGFGVGLTSISLGLLRALERAGLKVGFFKPIAQLHPGDLGPERSSELVARTHGLDTPKPLPLAQVERMLGDGQLDELLEEIISLYQRAAADKDVVIVEGMVPTRHASYAARVNFHLAKSLDAEVILVSAPENETLTELTDRIEIQAQLFGGPRDPKVLGVILNKVRGEADAANAEDGVADFARRLTEHSPLLRDDFRLIGCIPWQDELNAARTRDIADLLSARVINAGDYEQRRVQKIVLCARAVPNTVQLLKPGVLVVTPGDRDDIILAASLAAMNGVPLAGLLLCSDFPPDPRIMELCRGALQGGLPVLSVATGSYDTATNLNRMNKEIPVDDRERAERVTEFVAGHIDFEWLKQRCGTPRELRLSPPAFRYQVVQRAQKAGKRIVLPEGSEPRTVQAAAICQARGIARCVLLAKPEEVQAVAQAQGIVLPEGLEIIDPDLVRQRYVEPMVELRKGKGLNAPMAEQQLEDSVVLATMMLALDEVDGLVSGAIHTTASTIRPALQLIKTAPGYNLVSSVFFMLLPDQVLVYGDCAVNPDPSASDLAEIAVQSAASAQAFGIPARVAMISYSTGDSGSGVDVDKVREATRLAREQRPDLLIDGPLQYDAAAIASVGRQKAPNSPVAGQATVFIFPDLNTGNTTYKAVQRSADCVSVGPMLQGLRKPVNDLSRGALVEDIVYTIALTAIQADAQAPA

SEQ ID NO: 75341 - protein, 318 aa, Gluconobacter oxydans 621H
MSTVASIIVSIAEEMRTASERGTVANYIPPLARVDLNRFGMAVVGMDGETHTVGDAEVPFSVQSVSKVFSLSMALNAMGDELWGRVRQEPSGSAFNSIVQLENEHGIPRNPFINAGAIVIADILVSRYGRENAQTRLLEFLRPLVSDPSSIDIDTDVARQERETGFRNMALANYMRTFGNIRNVVEDTLDFYFHQCALTMSCHQLAQVGTCLMTGGRNPLTGERIMSERNAQTILALMMMCGHYDGSGAFAIRVGLPGKSGVGGGILAIAPGVASIAVWSPGLNAQGNSLLGTRALERLVQHTGWSVFRANPWVANPT

SEQ ID NO: 75342 - protein, 561 aa, Zea mays
MDKERKQGFFAALKEEVVRGLSPSRSRGKSPAPPRSASPARMLIPRRRKAPAAPPPPPPEKVLEQYLGEQLVARSGSLRPGGEALAPLIEGPDAERLAAGDPDAEDSGRREGFGHWVRGHLTRTPSMASSAAGGGGGPGGSSGSFRRSDLRLLLGVMGAPLAPIPSKTAEPLPLLSIKGTPIESSSAQYILHQYTAASGGYKLLQSVRNAYAMGKVRMVASEFETATRVVKNRGPSGRGAAAVEQGGFVLWQMAPDMWYVELAVGGSKVHAGSNGRLVWRHTPWLGAHAAKGPVRPLRRVLQVPAVLPTPRLIPSPPTRANHLTISSSFLSVWHWHWHWQLAMQGLDPLTTAGLFAEARCVGEKKVNGEDCFILKLSADPQTLKLRSEGPAEIIRHVLFGYFSQRTGLMVQMEDSHLTRIQPHAGGDAVYWETTISSSVEDYRAVEGVVVAHAGRSAVTLFRFGEAAVGLGHTKTRMEEAWSIEEVAFDVPGLSVDCFIPPADVGSGSVGEACELPSQPHGERARTGAAVHPSRVAAVERAGTAAGAGGRGEKKVMWRVQV

SEQ ID NO: 75343 - protein, 451 aa, Gluconobacter oxydans 621H
MGLNTPLMSDAPSPHTPSPEMRPSLPDAFSSIRVPGADASWFRRFLAFVGPGFMVSVGYMDPGNWATDLQGGSRYGYTLLCVIMLSNLMAILLQALSARLGIATGRDLAQACRDHFSPAVNIVLWLACELAIIACDLAEVIGTAVALQLLFGLPLLGGALLSILDALIVLLLMNRGFRYLEAFVIALLGIIALCFGIQLIAAAPPVHSILAGLLPDPKIVTTPGMLYVAIGIIGATVMPHNLYLHSSIVQTRAYERTPAGRRDAIRWTTWDSTIALTLALFINAAILIVAAAAFHTSDHQDVAEIQDAYRLLSPILGLGMASTLFALALLAAGTNSTITGTLAGQIIMEGFLHLRIPHWARRLLTRGLAIVPVAIVTLIYGNRGVGDLLMASQVILSLQLPFAVIPLVMFVSDRRKMGEFVISTPVRILSWGVAGLILLLNFKLLYDTLAG

SEQ ID NO: 75344 - protein, 811 aa, Flavobacteria bacterium BBFL7
MESYMIYMPLLMAALGLLYMFTKKSWVLKQDAGDGKMKEISDHIYEGALAFLKAEYKLLAIFVVVVSILLFIVSLVVPTTHWMIVIAFICGAVFSAYAGNIGMKIATKTNVRTTQAARTSLPKALGISFGGGTVMGLGVAGLAVLGLTGFFILFYHFFMNGTWTDTDAMTVVLETLAGFSLGAESIALFARVGGGIYTKAADVGADLVGKVEAGIPEDDPRNPATIADNVGDNVGDVAGMGADLFGSYVATVLAAMVLGNYVIRDMGGDIVNEGFGGIGPILLPMAIAGVGIIISVIGTLLVKIKSNDAKESQVMGALNIGNWTSIILVAIACYGLCMWMLPETMQMEFFGEGLIEISSMNVFFATLVGLVVGAVISSVTEYYTGLGKSPILKIVQQSSTGAGTNIIAGLATGMISTFPSVLLFAGAIWASYAFAGFYGVALAASAMMATTAMQLAIDAFGPIADNAGGIAEMSEQEPIVRERTDILDSVGNTTAATGKGFAIASAALTSLALFAAYVTFTGIEGINIFKAPVLAMLFVGGMVPVVFSALAMNAVGKAAMEMVYEVRRQFKEIPGIMEGTGKPEYDKCVAISTEASLKQMVLPGLLTIGFPLVIAFLPLLFGMEKLAIAEMLGGYMAGVTVSGVLWAIFQNNAGGAWDNAKKSFEAGVEINGEMTYKGSDAHKAAVTGDTVGDPFKDTSGPSMNILIKLTCLIGLVIAPILGSHMVEGQANVVTQEIEQEVVQNENEATSLYKNMDIQKSVDAETGIVTANVTYQSSANGATITKSHKYVGTEAQVEAKIKALNQEVINFK

SEQ ID NO: 75345 - protein, 476 aa, Geobacillus thermocatenulatus
MAKEYDVVILGGGTGGYVAAIRASQLGLKTAVVEKGKLGGTCLHAGCIPSKALLRSAEVYAQTKNGEAFGVIADGVRLDFAKVQARKAAIVDQLHKGVQHLMKKGKIDVFAGIGRLLGPSIFSPLPGTVSVEMNDGSENEMLVPKFVVIATGSRPRTLPGLEPDGEFVMTSDEALQMETLPSSILIVGGGVIGMEWASMLNDFGVEVTVLEYADRILPTEDEDVSKEMEKLLRRRGVNIVTGARVLAETLEKGNGVTIQAEHQGERKTFAADKMLVSVGRQANIEGIGLENTEIVVEKGYIQTNEFGQTKESHIYAIGDVIGGHASLPHVAAHEGIVAIEHLAGRNPAPIDYTMVPRCIYTRPEAAAVGLTEQEAKAKGYDVKVGKFPFKAIGKALVFGEAEGFVKLIADRNTDDLLGVHMVGPHVTDLISEAGLARVLDAAPWEVAHAIHPHPTLSEAMAEAALAVDGKRFIFKF

SEQ ID NO: 75346 - protein, 331 aa, Kluyveromyces lactis NRRL Y-1140
MVRVAINGFGRIGRLVLRIALSRPNVEVVAINDPFISVDYAAYMFKYDSTHGRFAGEVSHDENSLIIDGKKVLVFQERDPATLPWGEHNVDIAIDSTGVFKELDSAQKHIDAGAKKVVITAPSSTAPMFVVGVNEDKYNGETIVSNASCTTNCLAPLAKVVNNAFGIEEGLMSTIHSITATQKTVDGPSQKDWRGGRTASGNIIPSSTGAAKAVGKVLPELQGKLTGMAFRVPTVDVSVVDLTVKLAKEATYDEIKAVIKKASENELKGILGYTEDAVVSSDFLGDTNSSIFDAAAGIQLSPKFVKLVTWYDNEYGYSTRVVDLVELVAKN

SEQ ID NO: 75347 - protein, 252 aa, Zea mays
  misc_feature (44)..(44): Xaa can be any naturally occurring amino acid
PYLLLHPEIFPRLLRHHGVRPRCKPPPPRPAPLRLRRAPPPHPXCLPPLRAASAAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLGPVAILRVWSFCLFYVMAELWGSVVISVLFWGFANQITTVERAKEFYPLFGLGGNVALIF

SEQ ID NO: 75348 - protein, 454 aa, Magnaporthe grisea 70-15
MTEPPHPYNALDAAKLQEAADSSLLSYGPSFHNEIIARAEGVFIYTVAGRRILDWTSGQMSCLIGHGNPEVVSVIHQHATSLDHLFSGMLSPPVINLAAELKKLLPPGLERSMFLSTGGESNEAAIRMAKCVTGRWEIVGLSASWHGMTGGAAGAQYHSGRRGIGPMIPGNLMLPAPNTYRSIFRHADGTYDWETELDHGWAMVDAASSGSLAAVILEPILSSAGMHALPDGYLAAMKAHCERRGMLLILDEAQTAIGRAGDMFAFQHPSNGGVVPDVLTLSKTLGNGLPLSAVVTSDAIAARARGEGFLFFTTHVNDPLPAAVGLKVLQIVQRDGLVQRSRRLGERLHAGLRRLQERYACIGDVRGRGLMAGVEIVSDRETKAPGMELADRLGKRMMELGVSANLATLASFGGAFRIAPPITISEEELDLGLGFMEETLRSTEGSMPTGAIRK

SEQ ID NO: 75349 - protein, 348 aa, Oryza sativa
  misc_feature (299)..(299): Xaa can be any naturally occurring amino acid
MAGHGSNFYNVEELYDFNRLNKENIPPNHHAGARIALKDKTNRIGNEAFLKRTHSMDITQKPANVLGQNMMNLEPLDNLGPKFNLAMETEETTELDRFDRMNKHNPQMVSVFAKIIFDYLRDKEDNYLPKEGYMGQQTDINEKMRAILIDWLVDVNVKFRLVPETLFLTINLIDRYLTKVKVSRNKLQLVGVSSLLIACKYEEIYPPSLKEFVAICDRAYDSKEILEMEAHILLSLDFELTHSSSLRFLDRYSQIAEIDQKAYYFARYLLETRLLEYSLLKYKNSLLAAGAIFLVNKIXKSNGWTAELQHHTGFSEPDVKPCAKESTLRCKTIKNGASSQQRQVSPQK

SEQ ID NO: 75350 - protein, 549 aa, marine gamma proteobacterium HTCC2143
MKSIQSRIDSNSEEFAKNVEFMTDYVAQVRHIENQIRLGEERYRERAAKKGKLLPRERLAHLLDPGAPFLELNSFAGYQMMGDTDGTTAGGNLIMGIGFVKGRRVLVMVWNYAIKGGTINTATTRKSLRLQEIAFQTRLPIVSLSESGGGNLSGGEGPQDPWGAYGFIAGGRVYCQQAQLSAAGIPQITVAHGNATAGGAYQVALSDYIVLVRDQSHLFLAGPPLLKAATGEEAEHEVLGGAEMHASVAGTGEYLAENDADGIRVARDIVDQLPPPAGRTMLRDKEPEEPCYPKQELMGIVPTDKRVPYDMTEVIARIVDGSRFLAFKAEFGTETVCGHCYIDGFRCGIITNNGPITPQGALKSAQFLQLCDQSNTPMLFLHNTTGFLVGVEAEQMGQVKHGSKMIQAVANFRPPKVTIVVGNSYGAGNYAMCSHSLKPSFCFSWPTARTAVMGGAQAAKVLSIVSEDRYKAKGEQMPDEVRQGLDEQSERIETDMEISSEAIFTSARMLDDGIIDPRDTRQVVSFCLATVYETPHRDTEPNSFGVLRL

SEQ ID NO: 75351 - protein, 264 aa, marine gamma proteobacterium HTCC2143
MTNRLQGKVAIITGGTSGIGEATADIYIKEGATVVLTGRSEEKGQAIANRLGDKAHYIKADVSKEEDIANTISETVERFGKLDVLFNNAGGPVGGTIDSIAPGDINYGVDLLLSSVVLGIRYAIEPMKANGGGVIINNTSIAAIRYRQGNLLYSALKAAVTHYTKLAGVELGPLGIRVNCISPGAIATPIFWGGSAIANTKTDEDNARKLEKLKANLAKATPLQIPGLAEDIANGALFLASDEGRFINSHDLVIDGGRTSMFNE

SEQ ID NO: 75352 - protein, 149 aa, Dunaliella viridis
VAIKKIQSVFDNVADATRILREIKLLRLLKHSDVVDIKHVMLPPDPKTFKDIYVIFELMESDLHTVIEANDDLTHDHHKVFLYQLLRGLDFIHSSGVLHRDLKPKNILANSNCKLKICDFGLARPFISDPATSPIFWTDYVATRWYRAP

SEQ ID NO: 75353 - protein, 219 aa, Buchnera aphidicola str. Sg (Schizaphis graminum)
MNLNELKKKAAWAALDYIYPGTVIGVGTGSTVFYFIQALSTVKHLISGAVSSSNSSTVLLKKNGIRVLDLNTFDFLEIYVDSADEINNDMQMIKGGGAALTKEKIIAAMSKKFVCIIDESKKVNILGTFPLPIEIIPIAFSYISKEILKIGGQPKLRENIITDNGNVIIDVYNLFINDPISVEKKINSLPGVVSVGLFASRVADVVLIGTQKGVEIIKN

SEQ ID NO: 75354 - protein, 711 aa, Vitis vinifera
MNVNGPWTKGSAELNHHAQDEQKNIRDKVVGEGHGLSEEDESRINEDVEDLNDGRIGSVQAVQGVLHGPQQQPQGPIVRWERFLPLRSLKVLLVENDNSTRQVVSALLRNCSYEVTAVANGVQAWSILDDLTNHVDLVLAEVALPSLSGIGLLCKIMNHKACKNIPVIMMSSHDSVGIVFKCLSKGAVDFFVKPIRKNELKNLWQHVWRKFHRFSGSESESESGIRTKKSAKSKSVAGSDNNTGSNDEDNGSIGLNVRDGSDNGSGTQSSWTKMAVEVDSPKPMQPWDQSADPPDSTCAQVTQSWPEAFGNYQVPMTSSKDYQEQDDELDNVEMGKDLKIGVPRNSNLQLQDDVVGANKDKFHELTLKKDDEKLENRQMDLNSNKPNDELDKEAVDLMSVIANNTNPQKKSMGFKTPSGLSEVPETKDKAMYDKKEIPSLELSLKRLRDTGGTDTNPHDQIIWRHSDLSAFSRYNSASTAIQASTGNVGSCSPLDNSSEAAKTESMQNFQSNSNGTPPNQIKHLQHSAFQPVQNTILADFANANTILAHPSAMPPQVQIQNHHYYYHHHVHNISQQQIRIHDDLALTNMAKSAPQCGSSNVLNAPVEGYACNHSLNGITMVATAKMGVPLLDDGIAGKGGAGGGSGSGIDQNQYAQREAALNKFRQKRKERCFEKKVRYQSRKRLAEQRPRIRGQFVRRVFHDINSEDADS

SEQ ID NO: 75355 - protein, 368 aa, Pediococcus pentosaceus ATCC 25745
MALTAGIVGLPNVGKSTLFNAITKAGAEMANYPFATIDPNVGMVEVPDQRLDRIQEIIPAKKIVHTTFEFTDIAGIVKGASKGEGLGNKFLENIRQVDAIVHVVRAFDDDNITTVSGKVDPIEDIETINLELSLADLESVEKRLTKVQRAAKGRDKDAVAELAVLEKLHPVLEAGKAARTIDFDESEMPIVKGLFLLTTKPVLYVANIAEDDMADPEASKYFKEIKDYVAQEDPDAQVLGISAETEQEIAELEDDEKAEFLEAEGITEPGLNRLIQASYNLLGLQTFFTAGGKETRAWTFKKGMTAPQTAGVIHSDFERGFIRAETVSFDDLDKYGSMQGVREAGRLRLEGKEYLVQDGDIIEFRFNV

SEQ ID NO: 75356 - protein, 434 aa, Buchnera aphidicola str. Sg (Schizaphis graminum)
MSKILKIIGREIIDSRGNPTIECEVLLEGGFVGLASVPSGASTGSFETWELRDQDKNRFMGKGVQKAVEIINNKIFYSLKNKNAIDQFDIDQTMINLDGTENKSNLGSNSILSVSLATAKAAASSKGMPLYQHIAEINNTPGVFSMPLPMINIINGGKHANNNIDIQEFMIQPISAKSITEAIRIGAEIFHSLGNLLKDKGMSTTVGDEGGYAPNFKSNEEALNVIQDAVHKTKYKLGKDITLAIDCAASELYNKTRKKYQFIGEGTEFSSQELTHYLKKLSNKYPIISIEDGQDESDWEGFLYQTKELGNSLQLVGDDLFVTNKNILKKGIKKGVANAILIKLNQIGTLTETIETIKIAKKFNYGVIISHRSGETEDTSIADLSVGTASGQIKTGSMSRSDRTSKYNQLIRIEEILNKKRAPFYGLKEVKSSF

SEQ ID NO: 75357 - protein, 664 aa, Arabidopsis thaliana
MNSRSCICVSAMKPCCRFLISFRSSSLFGFSPPNSGKFINSSKLHCTKIDSRSIRSGIHCRRIVLDRNAFCDSDSISWGGGGSRVLRARGSSRGRGRGVLVIPHVASDFRNYSTSSLDSHVNDKSFESMFVKPLVFKEVEKTEGIPKRERGNVGGGKDANFGNVGVRKETERCLSQTEVEKEAWKLLRGAVVNYCGFPVGTVAANDPGDTQTLNYDQVFIRDFVPSAYAFMLDGEGEIVRNFLLHTLQLQSWEKTVDCHSPGPGLMPASFKVKSAPLEGNDGSFEEFLDPDFGGSAIGRVSPVDSGLWWIILLRAYGKLTGDYTLQERIDVQTGIKLILKLCLADGFDMFPTLLVTDGSCMVDRRMGIHGHPLEIQALFYSALRCAREMLIVNDGTKSLVTAVNNRLSALSFHIREYYWVDIKKINEIYRYNTEEYSADATNKFNIYPEQIPTWLVDWIPDKGGYFIGNLQPAHMDFRFFTLGNLWAVISSLGNQEQNEGVMTLIEEKWDDLVANMPLKICFPALEKDEWRIITGSDPKNTPWSYHNGGSWPTLLWQFTLACIKMGKLELAKKAFAVAEKRLKEDEWPEYYDTKSGRFVGKQSRLYQTWTIAGFLAAKKLIEQPEKASLLFWEEDYQLLETCVCGLSKSSGRKNKCSRFTPPRS

SEQ ID NO: 75358 - protein, 348 aa, Vitis vinifera
MSALKLSMVASIYGKPYTKLDRWARTIAPPATATNTITTTPIAVKKSSLSQNRATERLSRTDGWRIMPCAHLAASAHDKGSSRNLGFRCAHRSLSSSPPNFSSSSEHRGEGSGGNVADMGSESQDAAVDWSENHRSSQRKQPQPPPVSSSSKLLTLPTVLTLGRVAAVPLLIGTFYVDSWWGTTTTTTIFIAAAITDWLDGYLARKMRLGTTFGAFLDPVADKLMVAATLVLLCSRPLEVGMFGPVPWLLTVPSIAIIGREITMSAVREWAASQNTELLEAVAVNNLGKWKTATQMTSLTVLLAARDSSLTAAGGLVASGVVLLYISAGLAVWSLVVYMRKIWKVLIK

SEQ ID NO: 75359 - protein, 167 aa, Buchnera aphidicola str. Sg (Schizaphis graminum)
MRIGYGFDIHAFGSIKPLIIGGVQIPYNKGLIAHSNGDLLIHSLIDALLGATAMGDIGTFFPSEDKKYKNINSRILLKYIWKRIYLKNYRISNIDITIITETPKILSYIFLMRSNIASDLNIKIEKISVKSTSSKMIGCIGRKEGIACQSLVMLVKSKNTDRKNNII

SEQ ID NO: 75360 - protein, 348 aa, Zea mays
MEALRKQASKFKEQVAKQQQAVIKQFSTTGYERSDSIVIDEVELQRHQQLEKLYTSTRSVRDFQKDIVRAAEGLVSIGNKHIEVGTKFSEDCYRYGSENNASDEALRKAASLYGGALRNIEKEYEDFNRILSSQTIDPLRAMAMGGPLEDARGLAQRYSRMRHEAEILSTEIARRKARVREAPIAEHTTKLQQSEARMIEHKASMAVLGKEAAAALAAVESQQQRVTLQRLVGTAEAEKLFHLRLAAILDDVEAEMSSEKQRRESAPPIISSHKRAEKAQYFLAEVMHNFNGTTEKELSLIVGDYVVVRQIAPNGWAEGECRGKAGWFPAAYVVRRENIPPNKVFPQV

SEQ ID NO: 75361 - protein, 385 aa, Methanothermobacter thermautotrophicus
MDETLLMIPGPTRVAQRVLKAMSENIVNHRSALFGKILSETSEMMSDVFRTNNKSYLLTGSGTAAMEAAIANIIEPGDKVLNVVGGKFGQRFSQIVEAFGGESIRIDVEWGKAVNPDEIGYALEENDDIKAVTVVHNETSTGVANPIKEIGKIMSDYDALYVVDTVSSLGGDEVDVDGYGIDICVTGSQKCLAAPPGMAAITLSDDAWSAVEGVSNSRTYYLNLKKYRKSGDAEPPETPYTPAVSLIYAMHEPLKVIMEEGLNNRIKRHKLAAEATRNAIKALGLELFPDESVSSTTVTAVRLPEGVTDGELRGTMRNKYHVELAGGQDHLKGKIFRIGHMGNITHRELITTISGLEMTLRELGFEVEMGEAVAAVADTYLPENL

SEQ ID NO: 75362 - protein, 330 aa, Helicobacter pylori 26695
MAQNLPTIALLATGGTIAGSGASASLGSYKSGELGIKELLKAIPSLNRLARIQGEQISNIGSQDMNEEVWFKLAKRAQELLDDSRIQGVVITHGTDTLEESAYFLNLVLRSTKPVVLVGAMRNAASLSADGALNLYNAVSVALNEKSANKGVLVVMDDNIFSAREVIKTHTTHTSTFKALNSGAIGSVYYGKTRYYMQPLRKHTTESEFSLSQLKTPLPKVDIIYTHAGMTPDLFQASLNSHAKGVVIAGVGNGNVSAGFLKAMQEASQMGVVIVRSSRVNSGEITSGEIDDKAFITSDNLNPQKARVLLQLALTKTNNKEKIQEMFEEY

SEQ ID NO: 75363 - protein, 209 aa, Treponema denticola ATCC 35405
MDRCFKLSPSLLSADFSKLGEELAFIEKHGGDWVHIDVMDGQFVPNLTFGAPVVKSIRPCSKLVFDVHLMVNNPENLVSAFADAGADYFTFHAEASIHADRLIADIRSHGMKAGVSIVPSTPVGILEEIAPLADLILVMSVNPGFGGQKLIPYCLEKVKRLRSLREEKNYNYLISVDGGIDSKNVGSVIDAGADVIVSGSAFFSGDLRI

SEQ ID NO: 75364 - protein, 599 aa, Synechococcus sp. RS9916
MINAPVSQMTVDAAATSKGAGNGKLAMAGQPLPKAEQRKLDSGHLKQPLLDELANELPYFSEDALQLLKFHGSYQQDDRDKREKGKDKTWQMMLRLRSPGGRIPTGLYLAMDELADRLGDGTLRATTRQAFQMHGVPKADLKEVIGTIVRNLGSTLAACGDINRNVMAPAAPFDKGGYPAARQLADEIADVLSPETAEGSYLDLWVDGDLSYRIKPSRKVKKVRSRQLEGGVFSGDEAEPLYGDTYLPRKFKVAVTVPGDNSVDLLTQDIGLVAFTETTGELRGCNVYVGGGMGRTHNKEETFARIADPLGYVPADQVLDLVQSVLALQRDHGDRKLRRHARMKYLLHDKGIQWFRDELTRTYFQGDLKPLRNEPKAKLHDYLGWHRHRAGMWFVGLPLLCGRLEGEFKAGLRKIVETYQLEIRLTPNQDLLLCNIGTPQRASIRAALAELGVETPEMPAPLARHAIACPALPTCGLAITESERILPAVLDRLDHQLQRLEIAKPVLIRMTGCPNGCARPYMAELALVGSGVEQYQLWLGGSGNLQRLAKPYLQKMPLDQLETTLEPLLVSWKEAGGRRSLGDHVHKLGDEAVAELLNV

SEQ ID NO: 75365 - protein, 696 aa, Pseudomonas syringae pv. syringae B728a
MQTFFIAPTDFGVGLTSISLGLVRTLERAGLKVGFFKPIAQPHPGDLGPERSTELMARTHGLKPPKPLGLAHVERMLGDGQLDELLEEIINLYQQAAVGKDVLVVEGMVPTRSASYAARVNLHLAKSLDAEVILVSAPENEVLADLSGRVELQAQLFGGPKDPKVLGVILNKVRTEESMEVFASRLKEHSPLLRSGDFRLLGCIPYRAELNAPRTRDVAELLGAQVLNAGDYDQRRMTRIIICARTVLNTVPLLKPGVLVVTPGDRDDIILAVSLAAINGVPLAGLLLTSDTVPDPRIMELCRGALQAGLPVLSVSSGSYDTANRLNQLNKEIPIDDRERAENITDFVASHLDANWLHQRCGTPRELRLSPAVFRYQLIQRAQAANKRIVLPEGNEPLTIQAAAICQARGIARCVLLARPEEVHAVAQAHGIELPQGLEILDPDLIRERYVAPMVELRKSKSLNAPMAEQQLEDPVVIGTVMLALDEVDGLVSGVIHSTANTIRPALQLIKTAPGCTLVSSVFFMLFPEQVLMYGDCIMNPHPSASELSEIALQSADSATAFGISPRVAMISYSSGNSASGEEVEKVREATQLARETRRDLLIDGPLQYDAAANEQVARQLAPDSAVAGRANVFVFPDLNTGNTTYKAVQRSADCVSLGPMLQGLRKPVNDLPRGAQVDDIVYTIALTAIQADTLS

SEQ ID NO: 75366 - protein, 221 aa, Triticum aestivum
MGEEANCDAVMEAGNGNGKAKVNGHATAVLAMPDVKADDAVVAPADPRLQGISDAIRVVPHFPKPGIMFNDITALLLRPGVFKDAVDMFVERYRGMGIAAVAGIEARGFIFGPAIALAIGAKFIPLRKPGKLPGEVISENYTLEYGTDCLEMHVGAVEPGDRVVVVDDLVATGGTLSAAIKLLERAAADVVECACLIGLPKFKDFYKLDGKPVYILVESRK

SEQ ID NO: 75367 - protein, 469 aa, Vibrio campbellii AND4
MSVENVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGIADTVLIGPEPEFFLFDDVKFATNMSGSFFKIDDVEAAWNTGSDYEEGNKGHRPGVKGGYFPVAPVDSSQDIRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARAINAFANPSTNSYKRLVPGFEAPVMLAYSARNRSASIRIPVVPSPKARRIEVRFGDPAANPYLAFAAMLMAGLDGIKNKIHPGEAMDKDLYDLPAEEAAEIPTVAYSLKDALEELDIDREFLTAGGVFSDDFIDSYIGLKSQDVEKVNMTTHPLEFELYYSV

SEQ ID NO: 75368 - protein, 464 aa, Silicibacter pomeroyi DSS-3
MAAQSYDVIVIGAGPGGYVAAIRAAQLGLKACVVEREHLGGICLNWGCIPTKALLRSSEVFHLMERAKEFGLKADNIGYDLDAVVKRSRGVAKQLSGGIGHLMKKNKIDVVMGEATIPAKGKVSVKTDKGTQELTAKNIILATGARARELPGLEADGDLVWTYKHALQPVRMPKKLLVIGSGAIGIEFASFYNTLGADTTVVEVMDRVLPVEDAEISAFAKKSFVKQGMKIMEKSMVKQLDRAKGKVTAHIETGGKVEKLEFDTVISAVGIVGNVENLGLEALGVKIDRTHVVTDAYCRTGVEGLYAIGDIAGAPWLAHKASHEGVMVAELIAGKHAHPVKPESIAGCTYCHPQVASVGYTEAKAKELGYDIKVGRFPFIGNGKAIALGEVEGMIKTIFDAKTGELLGAHMVGAEVTEMIQGYVVGRQLETTEEDLMHTVFPHPTLSEMMHESVLDAYGRVIHM

SEQ ID NO: 75369 - protein, 408 aa, Schizosaccharomyces pombe 972h-
MSLNNLSNSYNQYLAQESHQILRHLFLNKQYSPLVKRDDDSSATVTCGGDANEFNEYGHLGYRIGAIFVILATSLIGMNLPLVLSKITKNRPNVYIEYLYLFARYFGSGVILATAFIHLLAPACNKLYDPCLDDLFGGYDWAPGICLISCWFILLLEVLLNRYVEWRFGMEIGDHHGPTLGAKQHSHSHEDGAHGVHEHPVYDIEECADGVEHECVKDDLEEVKLEPYTNTDSTDLTTKEEARSFLLKQQLTAFIILESSIILHSVIIGLTTAVSGEEFKTLFPVIIFHQAFEGCGLGSRLAGMAWGPKTAWVPWVLGVIYSLVTPIGMAAGLGVREHWDPLAHGSYAAQGVLDAISSGILVYAGLVELLAHDFLFSPERERNWYKLIYLLACSMAGTGVMALLGKWA

SEQ ID NO: 75370 - protein, 499 aa, Cryptococcus neoformans var. neoformans B-3501A
MDSEGRNTAPLQPSPASPSRHQSPLAENQGSSSSISKGKKKSLLDGVAHNGESPSSPGPISIKRRLVRPKKIRQSHGDVSPPASVDPQIRQETLAVAEPEPLKPARSPSLRQSSRSPSRHPSPAASTPSFADAPLPPPPRSRFAPPRSAHPPLVSCRSVYNYTRLNHIEEGTYGVVFRARCNDTGEIYALKKLKLDEEKQGFPITSLREVMALMISGGHENVVGIREIVVGDTLNQVFIVMPFIEHDLKTLLADMPHPFLQSEVKTIMLQLLSAVAHCHANWILHRDLKTSNLLMNNRGQIKVADFGLARKFGDPLGEMTQLVVTLWYRSPELLLGGKEYTTAVDIWSIGCIFAELMQGEPLFPGRGEIDQINRIFQLLGRPNDESWPGYSTLPLVQKINPIGPMFSTLRQKFKHLTYEGHNLLSSLLCYDPERRITAEEALKHPYFSEHPLPKHPDLFSSFPSQAAGERKHKSLISPSAPVREDRMAKDSLADLDSFV

SEQ ID NO: 75371 - protein, 99 aa, Arabidopsis thaliana
  misc_feature (43)..(43): Xaa can be any naturally occurring amino acid
  misc_feature (65)..(65): Xaa can be any naturally occurring amino acid
  misc_feature (76)..(76): Xaa can be any naturally occurring amino acid
RRKRDSSMLYSANMVASPAKATRVAPFKGVRSCAAFQGSREAXNNDITFIKSNGGRVNCMRVWPXIGKKKFETLSXASDLSDSELDREVDYLIETVDSV

SEQ ID NO: 75372 - protein, 199 aa, Pseudomonas aeruginosa PAO1
MSVLVNKQAPDFTAAAVLGDGSIVDAFQLSSLRGKYVVLFFWPLDFTFVCPSEIIAHNNRMDKFRELGVEVVGVSIDSQFTHHAWRSTPVEKGGIGAVEFTMVADVKHEITRAYGIEHEDGVALRASFLIDRAGVVQHQVVNNLPLGREVDEMVRLVEALQFTEEHGEVCPAGWRKGQKGMKASAEGVASYLAENAEAL

SEQ ID NO: 75373 - protein, 62 aa, Brassica napus
MRGILVDWLLEVHVKFELNLETLYLTVNIIDRFLSVKAVPKRELQLVGISALLIASKYEEIY

SEQ ID NO: 75374 - protein, 370 aa, Triticum aestivum
  misc_feature (263)..(263): Xaa can be any naturally occurring amino acid
NKFVQKSRLVPVRNSRDIVDPRVRALTVAPAAAPAAPAPAPAVSLDETKAKNVLRQVEFYFSDSNLPRDGFLRKTVEESEDGLVSLALICSFAKMRSHLGLDATVKEDGVPETTVLAVAKVLRCSAALRVSEDGKRVGRANELLKPDEIIVQIDSRSIAVSPLPHNVKLEDVQSFFTQYGKVNSVRLPKHVSDKRQFCGTALVEFSEEDEANNIMNNKLSFAGADLEIKTKKEFDAEMEAKKEAYEKSHPNTHPNKNGHDEGXNGGDKVDNSDNAKKEGVESGKACEEKAPENTDAKEEKSDDAEELKVSDAQGSGLLSVLDRALTDEEEYRRARPGAAQGRGGRGVRRRGYLGERARDLHHRAVPQRRI

SEQ ID NO: 75375 - protein, 367 aa, Schizosaccharomyces pombe 972h-
MAGDSVKSAIIGIAGGPFSGKTQLCEQLLERLKSSAPSTFSKLIHLTSFLYPNSVDRYALSSYDIEAFKKVLSLISQGAEKICLPDGSCIKLPVDQNRIILIEGYYLLLPELLPYYTSKIFVYEDADTRLERCVLQRVKAEKGDLTKVLNDFVTLSKPAYDSSIHPTRENADIILPQKENIDTALLFVSQHLQDILAEMNKTSSSNTVKYDTQHETYMKLAHEMPLGKPYFNMPLLTMIKGIRHAELIAIEKILEHYPASVFKETTLYVTVEPCLMCAAALKQLHIKAVYFGCGNDRFGGCGSVFSINKDQSIDPSYPVYPGLFYSEAVMLMREFYVQENVKAPVPQSKKQRVLKREVKSLDLSRFK

SEQ ID NO: 75376 - protein, 82 aa, Oryza sativa
FFKGNEAEMSQQEVYKFNVPTFGPGVVFDVDYSVRQEQFRFFTEALRANKLRSYVDQMVVEAEVRIASVSRNCSYIVRMVVA

SEQ ID NO: 75377 - protein, 304 aa, Pediococcus pentosaceus ATCC 25745
MTTKIIMDTDPGIDDAAAISVAINNPEIELELITTVAGNVTVDKTTKNAMKLVKFFNADIPVAGGAEQPLIKPFEDAARVHGESGMPGYDFGAEPTNIPVNNAVDVLYHTIMANDEPIVLVPTGSYTNIAVLLTEHPDVKTKIEKIVAMGGAIGMGNMTSAAEFNVFTDPHAAEILYKSGIPVVMVGLDVTMKALLTQSTLDTVKSLGKAGEMLGAIFNHYYEGNEGGIPMHDVNTLAYLLKPEMYKTIPYWIDVVTEGPANGETVADIRGAYHDGKTNAEVCVDIDADAFNAWFIEEVKKMNA

SEQ ID NO: 75378 - protein, 416 aa, Xylella fastidiosa Temecula1
MDRINTSAAPPTSPDWERLRADFPLLQRHVHGKPLIYFDNANTAQKPQAVITATDTFYRRHNANISRAVHTLGTEATEAYEATRAALATLLNVPMHELVLCSGTTFAINLIAYSWALPRLRTGDVILVSRMEHHANIVPWQLIAERTGARIQVADILPNGTLDLDALHTLMTPQVKLLAITHVSNVLGTVNPIHDICRQARQRGITTVVDGSQAAPHRHINIPAIGCDFYAITGHKLYGPTGTGALWARREHLHIMPPFLGGGEMIKEVSFDGTLFNTPPHKFEAGTPNIAGFIGLSAAVDYVRRIGIDQIETRETELLAHLTEELQKIDGMRLFGTAPNKAAVVSFMIEGTHAHDLATLLDLEGVAVRSGQHCAHPLLQYYGVTATCRASLAFYNTHEEIERFITALLKVRKLLG

SEQ ID NO: 75379 - protein, 159 aa, Rhodobacter sphaeroides 2.4.1
MDIRTGNGFDVHAFGPGDHVWLCGVRVPHHRGLIGHSDADVGMHALTDAIYGALAEGDIGVHFPPSDPQWKGAASRIFLEHAMGRIAARGYTLANCDVTLICERPKIGPVAPAMREALAEIMGIAADRISVKATTSEKLGFTGREEGIAAIATVALLQA

SEQ ID NO: 75380 - protein, 213 aa, Candida tropicalis
ISLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 75381 - protein, 578 aa, Physcomitrella patens subsp. patens
MEAIAVSRGLVGASRLQSFFADTSSSSSSSCVPALISYAGLKKNVCFSASKPACELGAVVAASRGAVVKGNRGLRVEAAATNGSPQSFDYDVVIIGAGVGGHGAALHAVERGLKTAIVEGDVVGGTCVNRGCVPSKALLAVSGRMRELHDEHHLKSLGIQVAAAEYDRQAVADHANNLATKIRGNLTNSMKALGVDILTGIGSVVAPQVVKYGRIGFADKTITACNIIIATGSVPFVPPGIEIDGKTVFTSDHALKLEWIPDWIAIVGSGYIGLEFSDVYTALGSEVTFIEALDGLMPGFDPEIGKLAQRILINPRKIDYHVGVLAKKITPAKDGKPVLIELVDTKTKEPKETLEVDAALIATGRAPFTKGLGLENVNVVTQRGFVPVDERMQVLDGEGNKVPNLYCIGDANGKMMLAHAASAQGISVIEQIAGRDNVLNHNSVPAACFTHPEISMVGLTEPQARALAEKEGFKVSVAKTSFKANTKALAENEGDGLAKMIYRPDTGEILGVHILGLHAADLIHEASNAIAMGNTIKDIKFAVHAHPTLSEVLDELFKSAHLEDHAVVSEKAAEPVAV

SEQ ID NO: 75382 - protein, 412 aa, Vitis vinifera
MEMESLPNGNSVAAVVAAAAAAAAAAPSSKFNQLAESLKLEHQFLRVPFEHFKKSIRANHRIVEKEMSAVISGVADAANADLSGDEAVHHLNSLVSRLQGLKRKLEEGSRTEHLQAQKCRARLDHLESADADNLSEWNNTRLKRILVDYMLRMSYYDTAMKLVESSNLQDLVDIEVFHEAKRVIDALQNKEVAPALAWCAENKSRLKKSKSKFEFQLRLQEFIELVRAENNLRAIAYARKHLAPWGATNMKELQRVMATLAFKSNTECATYKVLFEPKQWDYLVDQFKQEFCRLYGMTLEPLLNIYLQAGLSALKTPYCYQDDCTKEDPLSQDGFRKLALPLPYSKQHHSKLVCYITKELMDTENPPMVLPNGYVYSTKALEEMAKKNGGQITCPRTGFICNSSALVKAYIS

SEQ ID NO: 75383 - protein, 409 aa, Rhizobium leguminosarum bv. viciae 3841
MPANFDGDRAMAEAAPLYDTYSRAPLRFERGEGVWLITESGERYLDFGAGVAVTSVGHSNPHVVGALKEQADKVWHLSNIYEIPGQERLAKRLTDATFADKVFFTNSGAEALECAIKTARRYQFSKGHPERFHIITFEGAFHGRTLATIAAGGQEKYLEGFGPKAPGFDQVAFGDIEAVRAAITEATAAILIEPVQGEGGVRPATPEFMKALRQLCDDNGLLLILDEVQTGVGRTGKLFAHEWSGITPDIMAVAKGIGGGFPLGACLATAEAASGMKAGTHGSTYGGNPLAMAVGSAVLDIILADGFLQQVRDVALVFRQGLASLKDRYPDVIEDIRGEGLLLGIKAAVPSAELLQAIRAAHLLGVPAGDNVIRLLPPLVVTAEEAREGLVRIERAAESIRASKVKKTA

SEQ ID NO: 75384 - protein, 304 aa, Rhizobium leguminosarum bv. viciae 3841
MSPKHFLDLSAVTSADLRTIMNDALARKQAFKAGTGDKPLAGKMLAMIFEKPSTRTRVSFDVGMRQLGGETLFLSGTEMQLGRAETIGDTAKVLSRYVDAIMIRTTEHSRLLELAQHATVPVINALTDDTHPCQIMADIMTFEEHRGPIKGKTIAWTGDGNNVLHSLVEGAARFGYRMNMAVPLGSEPKDHYLNWARNEGAEIMLCHDADRAVAGVDCVVTDTWVSMNQEHRARGHNVFQPYQVNAALMAKAGNDALFMHCLPAHRGEEVTDDVIDGPQSVVFDEAENRLHAQKSILAWCLGAI

SEQ ID NO: 75385 - protein, 201 aa, Buchnera aphidicola str. Sg (Schizaphis graminum)
MIILNYNKTFFLKSISNISDIQIEHGIEIAFIGYSNSGKSSAINALTNQKKLARFSKTPGRTQLINLFQVTSDFRIVDLPGYGYAKAPLLIKIKWQNMIYSYLKNSRSLKGLVLLMDIRYPLKILDQDIISMALNCKIPILLLLTKCDKFTINNQKIQFQKVYEKLDKFLNELHIQLFSSLKKIGIEKLKSKLNFWYEKYR

SEQ ID NO: 75386 - protein, 309 aa, Populus trichocarpa
MATHTLTATLCNSSLIKSNSKFTFFGTRIITRTQKTQTLAMATAPTAAKVAPAVIVGGGRVGRALQEMGSGQDLLVKRGDPVPLDFEGPILVCTRNDDLDAVLEVTPKSRWSDLVFFQNGMLEPWFQSKGLGDADQVLAYFAVSKLGEPPIDGKTDTDPEGLTAAYGKWASAVAARLHAGGLSCKVLDKETFQKQMLEKLIWISAFMLAGARHPGATVGAVEKEFRSEVSSLIAELASAAAAEKGIVFEEAIEERLCAYSRAVAHFPTAVKEFKWRNGWFYSLSDKAVAEGKPDPCPLHTAWIKELKVV

SEQ ID NO: 75387 - protein, 595 aa, Rhodopirellula baltica SH 1
MSLIVQKFGGTSVADTEKIRAAARKAIRAQKAGHRVVMVVSAMGKNTDTLLDLASQISDEPPAREMDMLLSTGEQVSVALVAMAIHSMGSKAVSLTGGQIGLKTDNSFSKARIQSIDTGRIERLLDAGNIVVAAGFQGIDDDLNITTLGRGGSDTTAVALAAVLGADACEINTDVDGVYTTDPRLLAEARRVDVISYDEMLELASLGAGVMHSRSIEFAKKFEVPIHVRSSFSDQDGTMIVAQPESETAPVSGAALTRDEARVTVLGVPDVPGMSQKIFSAIAAQKVAVDMVVQNVGTSGKADVSFTVAGGELKKTLAALEGILDSLGADGVTHDDQVSKVSVVGLGMAHQKAVAASMFRALAEANVNIHMITTSEIKISCLVPRDQANEALRAVHEAFSLDQRPSDAKTWNEIKASNAKEADVADVVARLQNDALEALTLTDISIVPAQARVTLDGVPDQVGVAADMFEQIGEAGIFVDMIVQGYDGEDGSTSVSFTVEQADLDAAQKVAREICGKHSMRDVRGASGITKLSVSGIGLRSHTQVGTVLFEQLASAGINVEMIATSELQVNVVIQSDQAGDAATRLKQAFAEALH

SEQ ID NO: 75388 - protein, 183 aa, Physcomitrella patens subsp. patens
VAMASIVAATTVVAPTAFAAASSAVSTSESSSVKAFSGLKSNTLFSSKAQTLSSVQNGSRVQCMQVWNPIGMTKFETFSYLPPLSDDAIAKQVEYMIQQKLIPCLEFDNANGVSRTNNSSPGYYDGRYWTMWKLPMFGCNDSAQVLREIEECKKTFPGCFVRVLGFDNVKQVQICGFLVARPN

SEQ ID NO: 75389 - protein, 283 aa, Saccharomyces cerevisiae YJM789
MIQMVPIYSCSALLRRTIPKRPFYHVLSGLTVRFKVNPQLNYNLFRDLTRREYATNPSKTPHIKSKLLNIPNILTLSRIGCTPFIGLFIITNNLTPALGLFAFSSITDFMDGYIARKYGLKTIAGTILDPLADKLLMITTTLALSVPSGPQVIPVSIAAIILGRDVLLAISALFIRYSTLKLKYPGRVAWNSYWDIVRYPSAEVRPSQLSKWNTFFQMVYLGSGVLLLLYEKEEGCEKTEEDFEDRKQDFQKAFSYLGYVTATTTIMSGVSYALKRNAFKLLK

SEQ ID NO: 75390 - protein, 369 aa, Helicobacter pylori 26695
MLLFTPGPVAINEEMRTSFSQPMPHHRTKDFEKIFQSVRENLKKMTGLEEVLLLSSSGTGAMEASVISLCQKELLFVNAGKFGERFGKIAKAHSIKAHELVYEWDTPAQVDEILSVLKANPNIDAFCIQACESSGGLRHPVEKIAQAIKETNPNVFVIVDAITALGVEPLEITHVDALIGGSQKAFMLPPAMSLVALSQNAIERIEERNVGFYFNLKSELKNQRNNTTSYTAPILHTLGLQRYFELVQNLGGFEALYRETKKAALATQKAVLALGLKIFPKSPSLSMTTIVNEHAKELRNLLKEKYQVQFAGGQEPYKDALIRINHMGIIPVYKSAYALNALELALNDLDLREFDGVANATFLKQYYGI

SEQ ID NO: 75391 - protein, 241 aa, Thlaspi caerulescens
MSIWDGFSRIRTPLPGADSDHLNGAKSVRQLYEIASPNYTGKYTVPVLWDKKLKTVVNNESAEIIRMFNTEFNHIARNPDLDLYPSHLQAKIDEANEWIYSGINNGVYRCGFAKKQEPYEEAFKQVYEALDRCEEILGKDRYICGDTLTETDIRLFVTLIRFDEVYAVHFKCNKKLLREYPNLFNYTKDIFQISGMDGTVNMSHIKQHYYGSHPSINPFGIVPRGPNVDYSSPHDRHRFSK

SEQ ID NO: 75392 - protein, 248 aa, Zea mays
  misc_feature (160)..(160): Xaa can be any naturally occurring amino acid
  misc_feature (171)..(171): Xaa can be any naturally occurring amino acid
GGGRGGCGAAARPPRGGGADGARGQEAPGAPGSSGPTGRGNGGTVPSPGEVEVVRHMLDRMRPEDVGLSPDLSFFRARDATRGGGTPTITHTTIYKCPNFSMVILFLPRNAVIPLHNHPGMTVFSKLLLGSMHVKSYDWLNTADPDPSSATSTTSTSSSXSDGPCLRLAEXVVDDVFTAPCDTSVLYPTAGGNMHRFTAMAPCAILDVLGPPYSIEEDRDCTYYAELPYAHHSRKWPHLSPHQFLPLH

SEQ ID NO: 75393 - protein, 286 aa, Ustilago maydis 521
MASSNATNSTSAASAANTNSSAFKSAELAALSGVEAAKRAAAYAAVDNHVKPQHEIIGIGSGSTVPYVVERIAQQGPAVNAKRWFVPTGFQSRELIINAGLRLGDVDSFPSIDVTIDGADEVDNALNCIKGGGACHLREKVLAEAANEFVVVADYRKNGSQLGTKWLQGVPIEVAPFAYAKVLQNLKKMGSDKAVLRMGKAKAGPVVTDNGNFCIDAPFPEAQMKDPSDLLKRIKLLTGVLEVGLFCNICKSAYFGNDDGTITIKTAAGDVQEGVHFDVSKAPATA

SEQ ID NO: 75394 - protein, 215 aa, Brassica napus
MNALAATNRNFRLASRLLGLDSKLEKSLLIPFREIKVECTIPKDDGTLASFVGFRVQHDNARGPMKGGIRYHPEVEPDEVNALAQLMTWKTAVANIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMLGTEALLNEHGKSISGQRLVIQGFG

SEQ ID NO: 75395 - protein, 120 aa, Vitis vinifera
MKWRPPVTARARAGGLGVAAIAYVAVDYLRYLAPAWHSWLMPALWSVLALVAVARVPFYKHWSMEFRSVLPFVASMIFMLSTCLFEVLSVRSVTAVLGLDWHRFQGGPAAQGLIVSTFHL

SEQ ID NO: 75396 - protein, 212 aa, Prochlorococcus marinus str. MIT 9515
MEISNYLQIKKELPLNVNLLAVSKGFGSQDIKIINDKGQNDFGESRFQEAIEKKLLLKDFKDIKWHFIGRIQSNKIRKIVQNFDYIHSVDSYEKLLKISNIAFEEHKNPLIMLQVKLMDDPSKGGFNPKDLLGKWDEIKQLKSIKIKGLMTINPKGLNSTQNIKLFKECRNLANSLKLHDCSMGMSQDWKEAVEAGSTWLRLGSIIFGNRSY

SEQ ID NO: 75397 - protein, 398 aa, Silicibacter pomeroyi DSS-3
MGWKTLDDMDLTGKRVLVRVDINVPIVDGVVTDSTRIRRLMPTIRDILAAGGRPILLAHFGRPGGERRKNLSLGQLVPTLERAFETKVLFADDCVGPAAEEAAEALQPGQVLLLENTRFHASETKNDPDLAAGMARLGDIYCNDAFSAAHRAHSSTEAIARLLPSCAGRLMQAELEALEKALGKPERPVTAVVGGAKVSTKLELLGNLIEKVDYLVIGGGMANTFLVAKGLPVGKSLAERIMKDTAAEILAKAEAAGCTIVLPSDVVVAEKFESHAPHQILPNDRCPDEGMILDAGPDSLAAIKAIFEKSRTLIWNGPLGAFELEPFDAATNAAALKAAALTRAGKLISVAGGGDTVAALNASGAAGDFTYISTAGGAFLEWMEGKTLPGVAALIQAG

SEQ ID NO: 75398 - protein, 270 aa, Prochlorococcus marinus str. MIT 9515
MTSKIAVIGFGNIAKAIITPLFDKKILNPKDFYCLVNTKKSLENIRNNYKYNINIFQANSKDSEIIWDCPVKILSVKPQQLKNIIELEKNKNNRNLLVSILAGVSLEKLIKRFPNHKCVRVVTNIPITIGKGSTGIAWGDEISENQKEAVRRLFENTSKINEFPEDLLDIFLALTSSGPAIIALIIEALSDGGLSGGLPKQLSEELVMDMILGTISLIRETNLTTTELKNMVTSPGGTTISALRVLENKSLRSALIEAVVSASNRSKEFR

SEQ ID NO: 75399 - protein, 337 aa, Streptococcus pyogenes M1 GAS
MTQVFQGRSFLAEKDFTRAELEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYFTVKENFGKLEGLTLVYCGDGRNNVANSLLVTGAILGVNVHIFSPKELFPEEEIVTLAEGYAKESGARILITEDADEAVKGADVLYTDVWVSMGEEDKFKERVELLQPYQVNMDLVQKAGNDKLIFLHCLPAFHDTNTVYGKDVAEKFGVKEMEVTDEVFRSKYARHFDQAENRMHTIKAVMAATLGNLFIPKV

SEQ ID NO: 75400 - protein, 212 aa, Cryptococcus neoformans var. neoformans B-3501A
MKSVNRWLYGPTPEEKVRSWQTKLRQQERQLDKEIRNLETATQRSRIELKQLAKKNDVKSAKILAREVVRANKQRDRLESSKARIKSVNMQLQHQLSMVKVTGAFQKSTEIMKTTNALVKLPQLSATMREMSMEMMKSGIMEEMMEETLDSVDDEEIEEEADAEVDKVLYELTDGKLGQAGAVGAALPAEEEEENEEEMQRMRKEMQELLSS

SEQ ID NO: 75401 - protein, 255 aa, Moritella sp. PE36
MKLSGKKAFITGATSGIGLAIAQRFFEEGATIAINGRNADKLSQINQELFSGKALEVVADIACVSDIEAAYALLSAESFKLDILVVNAGTYQLKPFCETTEQDFDAMFALNVKGAFFTMQYATPLLNDGASVIAISSVAAIHASWNQAPYNASKAALSSLTKSFACGLSDKKIRANTISPGVTDTGIWDKVDYREQVEQAAREGIPLGRKGAVNEVAGAALFLACDDSAFMTTSDIMMDGGVTYVSDPKEWGHKQ

SEQ ID NO: 75402 - protein, 509 aa, Solanum tuberosum
MTLRISELFAAALIYIIVHIIISKLIATVRERGRRLPPGPTGWPVIGALSLLGSMPHVALAKMAKKYGPIMYLKVGTCGMVVASTPNAAKAFLKTLDINFSNRPPNAGATHLAYNAQDMVFAPYGPRWKLLRKLSNSHMLGGKALENWANVRANELGHMLKSMFDASHVGECVVIADMLTFAMANMIGQVMLSKRVFVEKGVEVNEFKNMVVELMTVAGYFNIGDFIPKLAWMDLQGIEKGMKSLHKKFDDLLTKMFNEHEATTYERKENPDFLDVVMANKDNSEGERLSTTNIKALLLNLFTAGTDTSSSVIEWALAEMMKNPQIFKKVQEEMDQVIGKNRRLIESDIPNLPYLRAICKETFRKHPSTPLNLPRVSTEPCTVDGYYIPKNTRLSVNIWAIGRDPDVWENPLEFNPERFLSGKNAKIEPRGNDFELIPFWAGRRICAGTRMGIVMVEYILGTLVHSFDWKLPNDVIDINMEESFGLALQKAVPLEAMVTPRLSLDVYCC

SEQ ID NO: 75403 - protein, 483 aa, Pseudomonas putida
MKTKLFINNAWIDSSDQQTFERKHPVNSEVMTESANATVTDAIKAAQVAEEAFKTWKDVGPSERRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFSPATHALITQCVQEAGLPAGVLNYLNSSPDRSPEIADALISAKEIRRINFTGSTRVGSIIAQKAAQHLKRCLLELGGKSPLIVLDDANIDAAVKAAVFGSFLFQGQICMSTERLVVDEKIADEFVAKFVEKTKRLSVGDPCVTGDCIIGPMVSPNSGERINGLFKDAIDKGAKVVCGGMAQGAVMPATILDHVKSDMRIYDEETFGPITVVIRCKGEAEAIRIANDSVYGLSSGVFGRDINRALRVGMSIEYGCVHINGSTVQNEAQAPYGGTKNTGYGRFDGRAVVDEFTELKWLTIEPFEQQYPF

SEQ ID NO: 75404 - protein, 493 aa, Coccidioides immitis RS
MAQRFPHVRTVAIVGAGAGGLTAAKYLLAEKCFDKIDIFEQRNRVGGVWNYSPASDKARLSIPIPQENANLPVEEPIWHSQGSYDGSETSEQIATFVSPLYNGLETNIPHTLMHYSDLPFAKDTQLFPKFETVFHYLEEYSQAVKHLIQFQIQVVDVRLEDRLAGTWAVTRKDLRSGVSRTDIYDAVVVANGHYNVPYVPSITGISAWNNSYPGIISHSKSYCSSEAFRNKKVIVVGNSASGIDIGAQISKVCRAPLLSSSRSESYFTSKATDDRTEYPPIEEFLPPGRHNRAVRFANGVIEESVDAIVFCTGYLYSFPFLSTLDPPVVEDGSRALRVYQHMFYIEHPTLVFPVLNQKVIPFPVAEAQSAVFARVLSGRLALPAKEDMYEWERSNVAARGAGKSFHVLAYPLDAEYLNFLHDWAASAETRPSLTRNGQGKEGPCWGEKEKWLRSRFTQIKQAFAARGEERHSCCVPEDLGFDFEGWKREQGTG

SEQ ID NO: 75405 - protein, 512 aa, Vitis vinifera
  misc_feature (376)..(376): Xaa can be any naturally occurring amino acid
MISADDFYKVMCAMVPLYFAMLVAYGSVKWCKIFSPEQCSGINRFVAVFAVPVLSFHFISQNNPYEMDTKFIVADTLSKLLVLVLLSVWAILFKGGLDWLITLFSLATLPNTLVMGIPLLNAMYGDFTQSLMVQLVVLQCIIWYTLLLFLFEYRAATLLIKNQFPGSTAASISKFEIDGDVISLDGRDPVRTESEIDGNGRIRVRIRRSTSSAPDSALSSSMGITPRASNLSGAEIFSVNTPAPLHDPRLSGYASSDAYSLQPTPRASNFNELDTTTITTTNTPFWVRSPVAGKVYRQQSPAFSGVRMVWESPGKCNGGGGERQGCKDVVGVAEEEDPKATATGQDMPRTHVMLRLILTMVGRKLSRNPNTYSSVXGLLWSLISFKWNVGMPSLVKYSIKIISDAGLGMAMFSLGLFMALQPQIIACGTKRATMGMGIRFICGPILMSAASIAVGLRGVRLHAAIAALPQGIVPFVFAREYGLHPDILSTGVIFGMLVSLPVTLLYYILLGL

SEQ ID NO: 75406 - protein, 515 aa, Apium graveolens var. dulce
MENGTKQNKHQQKQPPSTTMQIQAPPTVLPTPTWKLILVAAIAAGVQFGWALQLSLLTPYVQLLGIPHKWAAYIWLCGPISGMLVQPIVGYYSDRCQSSFGRRRPYIASGAACVTISVILIGFAADIGYKAGDDMTKHLKPRAVTVFVIGFWILDVANNMLQGPCRALLADLCISDTRRMRSANAFFSFFMAVGNILGYAAGSYNDLYKIFPFSKTHACDLYCANLKSCFIISIALLISITVVALTLVREKQWTPEEFSSEESPSSGKIPVFGELFGALKDLPRPMLILLLVTCLNWIAWFPFILFDTDWMGREIYGGDANTGKLYDQGVRAGSLGLLLNSVVLGLTSIAVEYLVRGVGGVKVLWGVVNFVLSIGLVMTVVVSKVAEHQRRYGSNGQVLPPSAGVKAGALSLFSVLGIPLSITYSIPFALASIYSSGSGAGQGLSLGVLNLAIVVPQMIVSFLAGPFDSLFGGGNLPAFIVGAVSAAVSGVLAIVMLPKPSKDDATKLTLGGSYH

SEQ ID NO: 75407 - protein, 231 aa, Arabidopsis thaliana
MFLLKPICIGTSRMERVFNNFLGFEEIEGEDDFREEYACPFCSDYFDIVSLCCHIDEDHPMDAKNGVCPICAVKVSSDMIAHITLQHANMFKISFLLSLPLHSLTKYYVTRKRKSRRGGAQSMLSILKREFPDGNFQSLFEGTSRAVSSSSASIAADPLLSSFISPMADDFFISESSLCADTSSAKKTLNQSLPERNVEKQSLSAEDHREKLKQSEFVQGILSSMILEDGL

SEQ ID NO: 75408 - protein, 300 aa, Oryza sativa Japonica Group
MVEIPAIDLRLAGGGGGAEETARLRDACARLGCFRVSGHGVPPGLQAEMKAAVRALFDLPDDAKRRNADIIPGSGYVPPGTANPLYEAFGLCDAAAPADVDAFCARLDAPPHVRETVKAYAERMHSLIVDVAGKVAASLGLHGASFQDWPCQFRMNRYNYTQDSVGSPGVQVHTDSGFLTVLQEDECVGGLEVLDPAAGEFVPVDPLPGSFVVNVGDVGQAWSNGRLHNVKHRVQCVAAVPRVSIAMFLLAPKDDTVSAPGELVDGEHPRRYREFKYDDYRRLRLSTGERAGEALARLAA

SEQ ID NO: 75409 - protein, 328 aa, Rhizobium leguminosarum bv. viciae 3841
MDAPRVLVTGGAGYIGSHTAKLLRSEGIEPVVYDNLTTGNRSSVRWGPFVEGDVLDTSCLIEVIEKYAPDAVIHFAASAYVGESVENPAKYYNNNVCGALSLIDACRQTGLQNVIFSSSCAVYGVPSVLPIDETLPKAPINPYGKTKLIFEHMLADYAAAYGLRYVALRYFNACGADPDGELGEWHVPETHLIPRALLAAAGRIPHLEIFGDDYDTPDGTCIRDYIHVADLARAHVQAFTHLAKGGANLAVNLGTGRGYSIRDVLRVIQETTGREVPVVIHPRRPGDPPSLYADASLARETLCFQPRYSDLETIVRTAAPFFGLEARA

SEQ ID NO: 75410 - protein, 204 aa, Glycine max
METETGAEAQPEEKKDEGKVRDSEKLVEETQTETEGQSEEKKDEEGKVAVMSSSVSETYDSDSVAVSMKKRKDKKKKVTSARKSLSLQQEHKNKHYKTRGKVANEEEVTSFKTTSLGQQPQRMKQSSLAAKRKRLLWTAEEEKVLKEGVSKFSTENQNIPWRKILEFGCRVFDETRTPVDLKDKWKNIISKKSRSTDCSYTFDL

SEQ ID NO: 75411 - protein, 318 aa, Helicobacter pylori 26695
MKARGFKAKMRGFKIFSGSAHPAFGKEVSKHLGFPLSKAVIGKFSDGEINIQISESVRGKDIFIIQPTCVPVNDNLMELLVMVDALRRSSANSITAVLPYFGYARQDRKAAPRVPITAKMVANLMQEVGIERIITMDLHAGQIQGFFDVPVDNLYGSIVFRDYIRSKALKNPVIASPDVGGVTRARYFANQMGLDLIIVDKRREKANESEVMNIIGSAKERDVILVDDMIDTAGTICKAALALKEQGATSVMALGTHAVLSGNAIKRIKESALDEVVVTNSIPLVQKCDKITTLSVAPLFAEVIRRIYHNESVQSLFT

SEQ ID NO: 75412 - protein, 704 aa, Arabidopsis thaliana
MSENCNSRHFSWLMKSCLPNPSDAKSLVQIHQPSSTAANSSATIASLPDDLLLECISRVPSSSIPSLAVVCRRWSRLLHSPYFLHLRRRLGLLRHSLFAISTVDSGLFAADLQFQSEIASWKVSLAVSSRSVGVDGSYGSLSHARAAAIGPRVYVVSRNAVLRYDSWMGTLNLRSPMIFPRKKFAIAVVSGKIYVAGGGGGSEVAAAVEEYDPELNRWEVVTQSARKRYGCIGAAVDGVFYVIGGLKIGNETSRAVAARAYASSMDLFDVESRQWLRSRSVPGGGCVVAACAAVGYVYVLTSHAVELSFWRFDARRRGGNSGFGEWQRLKSPPLPAQVRLDGTVRFSCVGVEDKVAVVQVVGCIDDLLRRSGRGSNLYFSILINYKQLFIKNIKSISNIIWKYYNFTILYNPEPCVSYTIILRKKTKLSVRNQTCFKKSSLSSSSTAKKTTNLSMREQTMFKKALELSTLCNIDVCVIYYGRDGKLIKTWPDDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQRTEPLMSGVSNTEQDLSTSSLSQNQSKFSVFLYNHDNCSFYQVPDSVSSFDSLTSTGLLGEQGSGLGSSFDLPMVFPPQMQTQTPLVPFDQFAPWNQAPSFADPMMFPYN

SEQ ID NO: 75413 - protein, 457 aa, Neisseria gonorrhoeae FA 1090
MSNPFSSLGLGTELVSALTAQGYENPTPIQAAAIPKALAGHDLLAAAQTGTGKTAAFMLPSLERLKRYATASTSPAMHPVRMLVLTPTRELADQIDQNVQGYIKNLPLRHTVLFGGVNMDKQTADLRAGCEIVVATVGRLLDHVKQKNISLNKAEIVVLDEADRMLDMGFIDDIRKIMQMLPRQRQTLLFSATFSAPIRKLAQDFMNAPETVEVAAQNTTNANVEQHIIAVDTFQKRNLLERLIVDLHMNQVIVFCKTKQSVDRVTRELVRRNLSAQAIHGDRSQQSRLETLNAFKDGSLRVLVATDIAARGLDIAELPFVINYEMPAQPEDYIHRIGRTGRAGADGVAISLMDESEQKMFEAIKELTGNKLLIERIEGFEPRWWEQEGSKPEKTETSEPRQRNRYESARAQREKNTRPETTANDAGAACGKIAGRSRRSRRGHRTCALLQPRYGVK

SEQ ID NO: 75414 - protein, 233 aa, Chlamydomonas reinhardtii
MAAGRLASIAYCGRTDLLEAWNCSRCAGVPGFTPHRVVHDAVWDLTTFSAAVSELVAAHPGSRLVGIGHSMGGALAQLAAIESKLAHNGTHTTVYTFGAPRVGNLAYQQLFNSFIDVSWRFTHNRDVVPSVPLQLMGFQHVAREVWEVDVDDPSAAGGVERKLLLCDGSGEDPSCHNSACYLGLCTSVADHLVYLGVHMYQDSDETSGEKASRERAAGPGRSEIALVVFVEST

SEQ ID NO: 75415 - protein, 475 aa, Ralstonia metallidurans CH34
MYQDLALYIDGEFIKGGDRREQDVINPATQELLGKLPHATTADLDRALSAAQRAFETWKKTSPLERSQILRRVAELTRTRAKEIGRDITLDQGKPLAEAVGEVMICAEHAEWHAEECRRIYGRVIPPRNPAVRQIVVREPIGVCAAFTPWNFPFNQAIRKIVAALGAGCTLILKGPEDSPSAVVALARLFHDAGLPPGVLNIVWGVPSEVSTYLIESPIVRKISFTGSVPVGKQLAAMAGAHMKRVTMELGGHSPVLVFGDADIEPAAEMLARFKLRNAGQVCVSPTRFYVQEKAYDKFLARFTEVIGSIKVGNGLDDGTQMGPLAHERRIASMEQFLDDASHRGGKIVAGGSRIGDKGFFFAPTVVTDLPDDAKLMVDEPFGPVAPVTRFKDAEEVLRRANSLPFGLASYVFTNSLKTANLVSNGLEAGMVNINHFGMALAETPFGGIKDSGIGSEGGQETFDGYLVTKFITQV

SEQ ID NO: 75416 - protein, 133 aa, Arabidopsis thaliana
MTHVEDDKEFKEKPLVQVLSDDDSEVKEAKDGGGEEVTGGDGEGEANEEDLGTEYLVRPVGEVEDEDDASDFDPEENGLDEEEGDEEIEEDDVDEDISLSAGKSEPLSKRKRVAKDHSEQGDVTGDNIRPSKR

SEQ ID NO: 75417 - protein, 444 aa, Bordetella pertussis Tohama I
MRQYHYITEMMRVALQDLSTLRIKGRVVQVVGTIIKAVVPMVKIGEVCLLRNPGEDFEMHGEVVGFVRDAALLTPIGDMYGISSATEVIPTGRTHMVPVGPGLLGRVLDGLGRPLDAAESGPLHAHKFYPVFADAPDPLTRRIIHAPLELGVRVLDGLLTCGEGQRLGIFAAAGGGKSTLLGMLVKGAAVDVTVVALIGERGREVREFLEHELGPEGRRKSVIVCATSDKSSMERAKAAYVATAIAEYFRDQGQRVLFLMDSVTRFARAQREIGLAAGEPPTRRGYPPSVFATLPKLMERAGMNQTGSITALYTVLVEGDDMNEPVADETRSILDGHIVLSRKLGAANHYPAVDVLASASRVMNAVVSPRHKYLAGRMRELMAKYQDVELLVKIGEYKQGADASTDEAIQKIGQINAFLRQLTDEREAFEDTVLRMAEIIGPES

SEQ ID NO: 75418 - protein, 388 aa, Escherichia coli K12
MKITISGTGYVGLSNGLLIAQNHEVVALDILPSRVAMLNDRISPIVDKEIQQFLQSDKIHFNATLDKNEAYRDADYVIIATPTDYDPKTNYFNTSSVESVIKDVVEINPYAVMVIKSTVPVGFTAAMHKKYRTENIIFSPEFLREGKALYDNLHPSRIVIGERSERAERFAALLQEGAIKQNIPMLFTDSTEAEAIKLFANTYLAMRVAYFNELDSYAESLGLNSRQIIEGVCLDPRIGNHYNNPSFGYGGYCLPKDTKQLLANYQSVPNNLISAIVDANRTRKDFIADAILSRKPQVVGIYRLIMKSGSDNFRASSIQGIMKRIKAKGVEVIIYEPVMKEDSFFNSRLERDLATFKQQADVIISNRMAEELKDVADKVYTRDLFGSD

SEQ ID NO: 75419 - protein, 515 aa, Zea mays
  misc_feature (333)..(333): Xaa can be any naturally occurring amino acid
  misc_feature (467)..(467): Xaa can be any naturally occurring amino acid
MRIPRRKGVAGPLAVGVPSRRAQVAAVFALATLLGVSVLYDAAHIAASLRRHGGPTAYAKLSSSDGAASVSGVAREEVATVETLAPPARAPVDGADRADPPPHERQQEAEAGAAKPGASLQQDAPLTEEVVEGGSGGHGGGGSQEQEQDQAQGTCDLYKGRWVYDESRAPLYKESECSFLTEQVTCTRNGRRDDDYQKWRWQPDGCDLPRFEAKLLLEKLRNKRLMFVGDSLNRNQWESMVCLVQSEAPWDKKSLVKNGSLNVFHLQEYNATVEFYWAPFLVESNSDDPDIHSISDRMIKPTSIAKHAANWEGVDYLIFNTYIWWMNTPQMKXHGGSFSRKHVKYDEIERVEAYRKVLKTWSRWVEAHIDPKRSTVLFMSVSPVHMQSEGWGSPNAVKCFSETQPAINYTKKLEVGTDWDLFAAAQRVTRSMEKVPVRFVDVTALSEIRKDAHTSVHTLRQGKLLTXSRRRTRGSSRIASTGASPACRTRGTSSFMVKSCRARRRRRINLTDNNS

SEQ ID NO: 75420 - protein, 738 aa, Brucella melitensis 16M
MAYVNFKVETDADGIALVTWDMPEKSMNVFTVDAMQELNAIIDAVIADDKIKGVVITSGKETFSGGADLTMLEGMFKEFQKQKVKDPEGAVQTLFDNVGKMSGLFRKLETCGKPWVSAINGTCMGGAFEMSLACHARAASDAPGVKMALPEVKVGLFPGAGGTQRVPRLANQQDALQMMTTGSSLTAQRAKAMGLVTEIAPAKKLVETAKKLIKGGLKPVQPWDEKGFKLPGGAIYSAAGANLWPAATAILRRETSGNYPAALAILKSVYEGLLVPFDTGLKIEQRYFTEILQTTEAGMMIRSLFVSLQELNKGARRPVDEKPTRLKKIGVIGAGFMGAGIAYVTAKAGIPVVLIDRDQESADKGKAHTADLITKEMQKGRATEADKEKLLSLITATPDYAQLEGADLVIEAVFEDREVKRVATEKAEEVLKSSAVFASNTSTLPITGLAKVSKRPKNFIGIHFFSPVDKMMLVEVILGKKTSDKALAVALDYVRAIKKTPIVVNDTRGFYVNRCVLRYMSEAYNMLVEGVPAAMIENAARMAGMPVGPLALNDETAIDLSQKILKATLADLGPKAVDPRHVELVDKLVNEFDRKGRKNGKGFYDYPAKPAKKHLWPGLKDLYPQQNPDKIDVKELKERFLVTIALEAARVMEEGIVTDPREADVGSILAFGFAPYTGGTLSYIDGMGAKKFVQLAKDLQKKYGAQFKAPKLLLDMAENGETFYQRFNPYKGETKKAA

SEQ ID NO: 75421 - protein, 229 aa, Coccidioides immitis RS
MFLFTAFAGTQVANEKTGPGVDSLLYIAAAFAASVTVNAWIFFRVSGSAFNPVASLSLWLLGAISLARFGVAALAHMAAGIAASAVVAILFPGPLTVQARLGPGTTVVQGLFIEAFLTAQLMIAVLMLAVEKQRATYLVPLVVGIAVFICEIAGARYSGGALSPARAFGPDLVLGDFAPYHWIYWAGPTLGSLAATGFFYLLKMLKYETCNPGADSDGLERFDGLDSKV

SEQ ID NO: 75422 - protein, 368 aa, Streptococcus pyogenes M1 GAS
MEHKWKLWLFIVGVVLLIGGASVLIQKGQAKAFSQGKPQLPAKKVKSTKVDPNAPVDQKVIYLAGGCFWGVEEYFSQVDGVLDAVSGYANGRGDTTNYQLIHQTGHAETVEVAYDANRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 75423 - protein, 306 aa, Physcomitrella patens subsp. patens
MAAPVATAQVVGNAFVNQYYNVLHQSPQVVHRFYTDSSHMTRAEAGADGAVDVAHTQDQIHQKVMSSDYSKFKAEIKTVDSQDSLNGGVLVLVTGSLSTKSTGKRVFVQSFFLAPQEKGYFVLNDVFRYLDDEVQQQTIAVPFQSNGVPEVEQEHPQASEPVVEQPTPAPAPEVVREVTPEPTPANVATAQEVFDDEGPTGAEEEELTGPAPIEDNTSPVIEEPESPMVQTTPIRETHPVVQESKAVGEQPKISYASILRVIGVPPPKAAQPPAERPAVASVPAATLATPSQESHEDVAPAENACK

SEQ ID NO: 75424 - protein, 472 aa, Pseudomonas aeruginosa PAO1
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 75425 - protein, 170 aa, Physcomitrella patens subsp. patens
MFITPSELEKELASFGRVLPNGVNVKSQKQGVCYAFVEFEDTTAAQTAIEASPIQINGRQVHIEEKKPMARGPRRSNDGKNDRPYRSDRNDRGEAARGRGSYHERNPGRGAGQDARERDGSRGGRGAGPARAGHSSSNNGSAPGNSERRPEGQRAPRRNSSNPPPPAAAA

SEQ ID NO: 75426 - protein, 324 aa, Bacillus halodurans C-125
MLQQKQSLLEHKPVLSKELEKLVNHYRTLSLNGQCAQYIPALREANQTYLGLYVVHSNGIEIKSGDWQVPFTLQSISKIINFIAACLDRGITYVLDRVDVEPTGDPFNSMVRLEMRKTGKPFNPMINAGAITVASLLSGKSPTEKLESVYSLVEKMLGRRASANEAVFHSEWQTAHRNRSLAYYLKDTGYLESEVDDALHVYFTLCAIEVATKDIAKIGLILANNGYDPLSHQQIFPKEVAKLTKALMLTCGMYNASGTFAAHIGIPAKSGVSGGIMAAVPARGRSDEAMGIGIYGPAIDDFGNSVAGVALLKHLSHMWDLSIF

SEQ ID NO: 75427 - protein, 430 aa, Bacillus halodurans C-125
MTILKEPQRTQVDEIKEITELSLLQSTQSVIKEALDLLGYSEATYELLKEPIRMLTVRIPVRMDDGNVNIFTGYRAQHNDAVGPTKGGVRFHPDVNENEVKALSLWMSLKCGIADLPYGGGKGGIICDPRTMSFGELERLSRGYVRAISQIVGPTKDIPAPDVFTNSQVMAWMMDEYSRIREFDSPGFITGKPIVLGGSLGRESATAKGVIICIEEAAKRNQLDLKGARVIIQGFGNAGSFLAKFLHDAGALIVGISDAYGALYDQAGLDIEYLLDKRDSFGTVTNLFKKTISNQELLISDCDILVPAAISNQITKENAHDIKAKVVVEAANGPTTLEATRILTERGIFLVPDVLASSGGVTVSYFEWVQNNQGYYWNEEEIDQKFRNMIVGSFEKVCTFSNQHQVDMRLAAYTVGVKRMAEASHFRGWV

SEQ ID NO: 75428 - protein, 885 aa, Carboxydothermus hydrogenoformans Z-2901
MTKYVYLFHEGRADMKDLLGGKGANLAEMTNIGLPVPPGMTITTEACREYYRLGGKFPEGLMEEVKEKLVYIEEKTGKKFGDPQNPLLVSVRSGAKFSMPGMMDTILNLGLNEETVEGLAQNTQNPRFAYDAYRRFIQMFGDVVLEIPKHEFEHILDRQKEKEGVTFDQELSAEALKEVITRYKELVERKTGKPFPSDPMVQLTMAIEAVFKSWNNDRAIVYRNLNKIPHDLGTAVNIQSMVFGNMGNDSGTGVAFTRNPSTGEKVLYGEYLTNAQGEDVVAGIRTPSPISKLKEEMPEVYEQFVSIAKLLESHYKNMQDIEFTIERGKLYILQTRNGKRTAQAAVKIAHDMVEEGLITKKEAILMVEPGQLDQLLHRQIDPSAKVEVIAKGLPASPGAASGIVVFDADEAEKLGKEGKKVLLVRTETTPDDIHGIVAAQGVLTSRGGMTSHAAVVARGMGKPCVCGCEAIKIDYEKKLFTVDNITVKEGDYLSIDGSTGRVILGTVPMKDPELSPEFIKLLEWADELKRLEVRANADTPEDAQKAREFGAKGIGLCRTEHMFMGPERLPHVQRMILAETKEEREEALSHLLPMQEEDFYGILKAMEGYPVCIRLLDPPLHEFLPSLEELLVETTELRVRGDNPELLAEKEALLKKVKSLHEFNPMLGHRGCRLGITYPEVYEMQIRAIFNAAARLTKEGYKVYPEVEIPLTIDVNEMKFFKERIDAIAREVMEREGVTFHYTTGTMIELPRAALLADELAEVAEFFSFGTNDLTQTTLGFSRDDAEGKFLTHYLDMKILKENPFIVLDRKGVGKLMKIAVEGGRKTRPDLLVGICGEHGGEPSSVEFCHQIGLDFVSCSPYRVPIARLAAAQAAVAEGEIVGTK

SEQ ID NO: 75429 - protein, 930 aa, delta proteobacterium MLMS-1
MPGRLFFGKRLALFLFTAILACTMIKFDDSQAGELAPRLHKEELANGLTVITRQTPATGVATVQIWLEAGSVYEEPHEAGITHFIEHLIFKGTEKRGPGEIAGAIEALGGRINAYTSFEHTVYHATLDARHWEQALEVLADAVLNSVFDPDEIEREKPVIFEEIRMRQDRPELHLFQELLSHAYQQHPYRLPIIGSQESVAAIERDDILAYVKEHYHPGNMTVVVVGDVNPAEVSAQTRKLFGELPAKEETPPRELPVEPPPTDFRFFLEEQAINQTHLTLALPIPAFKHPDTPVLSVLSQILGQGEASRLNERLRHEKGLVYRLGTSLLSLRDPGLLRISATLDAERAPEVLEEILAELFALRHFPVDDEELERARRNLEADFVFNLEQAEGMARVLGTFELLTGDPREQEYLERIRAVEAADIKRVANQYFRKEHLTVGLLTPLAASLELDRRQLTEIMVRAAERARKQVPDRRASDLPPHTHRFELDNGLTLLVRERPDVPTVAMRAVFPGGLRGETPATNGAFAFLAELLPRGAGELGARQMARTIADLAGELEGFSGRNTFGLKGDFLARFFDQGLLLLRDVIKKPAFDAEEAEKIRGELLANLRRQEDALPSVAIRELNRLLFRGHPYALNTMGSATSLRELELATLKEIYQDHARPDKMVLSVVGDIDAEGVRRQVEELFGNWQAPPEVDTQVVETLLPPEPPLKPEMIELTREREQVHIVFGFLGTTLTDPDRYPLEILDQVLSGQSGRLFTELRDRQGLAYSLSSFALLGTDTGSFGVYIGTSPEQREQAIKEIWSQLYRLRNEPISADELKRARNVLVGNYHLGLQGNGAQAMEMALNETYGLGLDFGQRYPAALEAVSAAEVREAARRYLQPERYVMVTVGGSEAPPTDEPADPVVPPEQPPAKAEGQANDREGSHDGE

SEQ ID NO: 75430 - protein, 127 aa, Crocosphaera watsonii WH 8501
MKVTNTQMDFIEVTGIRCYGYTGYLPEEQVLGQWFEVDLTLGADLTNAGTSDNLDDTSDYRQAIAIVKHHIKTTKVALIERLTEIIAQEILALPNINQVRVRLTKVSPPIPDFAGKITVDITRINKS

SEQ ID NO: 75431 - protein, 225 aa, delta proteobacterium MLMS-1
MENKPVNGPRLAPSILSADFARLGEEIRAAEAAGADIIHVDVMDGHFVPNLTIGPPVVAAARRVTELPLDVHLMMVNPQDYVEDFARAGADWITIHVETGYHLHRTIHRIKELGKRAGLVLNPGTSLASLDYLLAEVDLVMLMSVNPGFGGQSFIPSALAKIRQLRQMIDQRGLKVEIEIDGGVTPATIGEIYRAGTDICVAGSAVFGRDDYAAAITELRQQALA

SEQ ID NO: 75432 - protein, 347 aa, Zea mays
MGARRRLRQGSGRLQLLFSFLVLLLQAQASVGAASINGEGAQKLNRAELEVACEDFSNIINTFPTCTVFKGILSSGVEIGVVSTTISSSKDWSRSAESCFKKKIDRLSRVNHKNFINLLGYCLENEPFTRMMVFEFAPHGSLSQHLHVKEFEHLDWAARMRVIMGVAYCLQYMHHELSPPMAIHDVRSDTTFISDDYAAKIADVGVWNELAAKAKAGKEDGSSRAEAPPDLPSNAYCFGALMIETISGRVPDPYDHKPICSWASEHLKDKNYGKLVDASLKEHKESELEAVCEVIQECIDPDPTRRPSMRDVVGKLRDALGISPEAAAPRLSPLWWAELELLSVKST

SEQ ID NO: 75433 - protein, 143 aa, Zea mays
AGPFPKKLSDAPLVIVDKRRQGHNVAGVRIFLGEGRGKVAVLMDDMFAPAGPFSKGVELLPQEGPREVYACCPQGVFTPPPIERLSRGLFQKVIITNPIPLKGEKSFPQLIIFWVVTLWGETIGGVQDDCWVGHDPYSSLDID

SEQ ID NO: 75434 - protein, 456 aa, Carboxydothermus hydrogenoformans Z-2901
MYDVAILGGGPGGYVAAIRAAQLGLSVVVVEKDELGGTCLNRGCIPTKALVSTAERLHQIKNSAAFGIEVTGYNFNFQKAAERKNQVVERLVKGIHYLFKKSKITLIKGTGKLTGKNEITVETSDGLEKVEAKNIILATGSKPALISALGYDGERVITSDEALNLEKLPAEMVIIGGGVIGSEFATIFSEMGVKVTIVELLPSILANTDKEVSRYLTTLFKKRGIQVKTKVAVKEVKKGEKVTVVLENGEELVTDMVLISIGRVLNTKDIGLEEVGVALGPKGEVLVDEYLRTNVENIYAIGDITSKMQLAHVASAQGIRVVENLVGEPQPMSYDVVPGCIFTLPEIAMVGLTSQEAEEKGIKIITGKFPFQASGKAVAMEETEGFVKIIADFYTHRILGGHIVGPHATDLIGEIALAVQKGLTLEEVAHTIHAHPSLPEAVMEAAEAALNRAIHI

SEQ ID NO: 75435 - protein, 572 aa, Wolbachia endosymbiont strain TRS of Brugia malayi
MHSGSQHLFDIIILLSAAVFIVIAFWKMNISPVLGYFVAGALIGSHGFNLIHSAKAMDNFAEFGVVFLLFIIGLELTFERLIAMRIHVFGFGSLQVIVTMVAIWCIALAFGVNTNMAAVIGGGLALSSTAIVLQVLQEKGSQASQVGRLSIAVLLMQDFAVVPLIVLVPLLTGNSENSLISSLTGSLLQAAIALVMIFITGRLLLRPLFSIIARMESNEVFISTTLLIILGAAFITEQFRLSMALGAFVAGLLVAETEHRHSVEHAVLPFKDLLLGLFFMTVGMSINIDLLLNKLPLITLLSIILIVLKTSIIYMLCRFFGFKRAPAIQAGLLLAQGGEFAFILFRLADELNVLPSEIAQVLMMVTTVTMAFTPLLSGLGDWIVNSFSTEKVILDDEAVETDTQDLYNHVIVAGFGRVGYMVTKMLTAEHLSYVVVDIQSKIVKEGKSDSFPIYLGDATRYEILKSVGIGRAQALVISIKNEVTIKKIVSLVATNFPHVNIIIRLPDLSNAEVYKDLGASKIIPETSEMGLQLGGAALSLSGISESGVASLKSKFRKGNYSMIKDISSDMDE

SEQ ID NO: 75436 - protein, 815 aa, Saccharomyces cerevisiae YJM789
MSETLPRSDDLEATWNFIEPGINQILGNEKNQASTSKRVYKILSPTMYMEVYTAIYNYCVNKSRSSGHFSTDSRTGQSTILVGSEIYEKLKNYLKNYILNFKQSNSETFLQFYVKRWKRFTIGAIFLNHAFDYMNRYWVQKERSDGKRHIFDVNTLCLMTWKEVMFDPNKDVLINELLDQVTLEREGQIIQRSNISTAIKSLVALGIDPQDLKKLNLNVYIQVFEKPFLKKTQEYYTQHTNDYLEKHSVTEYIFEAHEIIKREEKAMTIYWDDHTKKPLSMALNKVLITDHIEKLENEFVVLLDARDIEKITSLYALIRRDFTLIPRMASVFENYVKKTGENEISSLLAMHKHNIMKNENANPKKLALMTAHSLSPKDYIKKLLEVHDIFSKIFNESFPDDIPLAKALDNACGAFININEFALPAGSPKSATSKTSEMLAKYSDILLKKATKPEVASDMSDEDIITIFKYLTDKDAFETHYRRLFAKRLIHGTSTSAEDEENIIQRLQAANSMEYTGKITKMFQDIRLSKILEDDFAVALKNEPDYSKAKYPDLQPFVLAENMWPFSYQEVEFKLPKELVPSHEKLKESYSQKHNGRILKWLWPLCRGELKADIGKPGRMPFNFTVTLFQMAILLLYNDADVLTLENIQEGTSLTIQHIAAAMVPFIKFKLIQQVPPGLDALVKPETQFKLSRPYKALKTNINFASGVKNDILQSLSGGGHDNHGNKLGNKRLTEDERIEKELNTERQIFLEACIVRIMKAKRNLPHTTLVNECIAQSHQRFNAKVSMVKRAIDSLIQKGYLQRGDDGESYAYLA

SEQ ID NO: 75437 - protein, 364 aa, Photobacterium leiognathi
MALSSAKEIIDDIRQGRMVILMDDESRENEGDLIIASEMVTPEAINFMATHGRGLICLTLSKARCKTLNLPLMVQGNNDNFSTPFTISIEAANDVTTGISASDRAKTVHAAVAPNAKSTDIVMPGHIFPLMAQDGGVLIRAGHTEAGCDVARLAGLEPSSVIVEILNEDGSMARRPQLEIFAEKHGLKLGTIADLIEYRTQQESHIERISEYELNTEYGIFTLVTYRDTIDNQAHFALCKGEIQAKAATLVRVHVKDTLKDILQVGLSQWSLEAAMQRIQTEDGVLVIISQQESPKTLFEKLDMYAKEQPNSPHSGIVQSRNIGLGSQILADLGVKKIRLLSNSNQGYRALSGFGLEVVEYIYD

SEQ ID NO: 75438 - protein, 106 aa, Cucumis sativus
ALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQ

SEQ ID NO: 75439 - protein, 197 aa, Photobacterium leiognathi
MVTVRARVSFKIGQDSHIPAELLSFNGFTSGKEHVAIIFNNADTTSAPLVRLHSECLTGDVFRSSRCDCGEQLNETIVKMQQQGGIILYLRQEGRGIGLYNKIDAYQLQSQGMNTYEANNRLGFDNDLRDFNEAAQALTALKIKRIRLVTNNPKKIKDLIEYGIDIVEVIATQAHIKEDNRDYLAAKSLYGKHNLAI

SEQ ID NO: 75440 - protein, 235 aa, Nostoc punctiforme PCC 73102
MTQNLSQKPIVISPSILSADFSRLGDEIRAVDAAGADWIHVDVMDGRFVPNITIGPLIVEAIRPVTTKPLDVHLMIVEPEKYVEGFAKAGADIISVHCEHNASPHLHRTLGQIKELGKKAGVVLNPGSPLELIEYVLDLCDLVLIMSVNPGFGGQSFIPGVLPKIRKLRQMCDERGLDPWIEVDGGLKANNTWQVLEAGANAIVAGSAVFNAKDYAEAITSIRNSKRPTPELAKV

SEQ ID NO: 75441 - protein, 161 aa, Cucumis sativus
AAIGKGFAIGSAALVSLALFGAFVSRAGVVVVDLLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYI

SEQ ID NO: 75442 - protein, 411 aa, Saccharomyces cerevisiae YJM789
MDATTPLLTVANNHPARNPKHTAWRAAVYDLQYILKASPLNFLLVFVPLGLIWGHFQLSHTLTFLFNFLAIIPLAAILANATEELADKAGNTIGGLLNATFGNAVELIVSIIALEKGQVRIVQASMLGSLLSNLLLVLGFCFIFGGYNRVQQTFNQTAAQTMSSLLAIACASLLIPAAFRATLPHGKEDHFIDGKILELSRGTSIVILIVYVLFLYFQLGSHHALFEQQEEETDEVMSTISRNPHHSLSVKSSLVILLGTTVIISFCADFLVGTIDNVVESTGLSKTFIGLIVIPIVGNAAEHVTSVLVAMKDKMDLALGVAIGSSLQIALFVTPFMVLVGWMIDVPMTLNFSTFETATLFIAVFLSNYLILDGESNWLEGVMSLAMYILIAMAFFYYPDEKTLDSIGNSL

SEQ ID NO: 75443 - protein, 468 aa, Escherichia coli K12
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPANLIQAQRDYFGAHTYKRIDKEGVFHTEWLD

SEQ ID NO: 75444 - protein, 175 aa, Populus trichocarpa
MAEGEEDMPRDAKIVKSLLKSMGVEDYEPRVVHQFLELWYRYVVDVLTDAQVYSEHANKTAIDCDDVKLAIQSKVNFSFSQPPPREVLLELARNRNKIPLPKSIAGPGIPLPPEQDTLISPNYQLAIPKKRTAQAIEETEEDEESADPNQSQEQKTDPPQLTPQRVSFPLTKRPK

SEQ ID NO: 75445 - protein, 835 aa, Saccharomyces cerevisiae YJM789
MGEEHKPLLDASGVDPREEDKTATAILRRKKKDNMLLVDDAINDDNSVIAINSNTMDKLELFRGDTVLVKGKKRKDTVLIVLIDDELEDGACRINRVVRNNLRIRLGDLVTIHPCPDIKYATRISVLPIADTIEGITGNLFDVFLKPYFVEAYRPVRKGDHFVVRGGMRQVEFKVVDVEPEEYAVVAQDTIIHWEGEPINREDEENNMNEVGYDDIGGCRKQMAQIREMVELPLRHPQLFKAIGIKPPRGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNVVVIAATNRPNSIDPALRRFGRFDREVDIGIPDATGRLEVLRIHTKNMKLADDVDLEALAAETHGYVGADIASLCSEAAMQQIREKMDLIDLDEDEIDAEVLDSLGVTMDNFRFALGNSNPSALRETVVESVNVTWDDVGGLEEIKEELKETVEYPVLHPDQYTKFGLSPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDENARLSILNAQLRKTPLEPGLELTAIAKATQGFSGADLLYIVQRAAKYAIKDSIEAHRQHEAEKEVKVEGEDVEMTDEGAKAEQEPEVDPVPYITKEHFAEAMKTAKRSVSDAELRRYEAYSQQMKASRGQFSNFNFNDAPLGTTATDNANSNNSAPSGAGAAFGSNAEEDDDLYS

SEQ ID NO: 75446 - protein, 391 aa, Rhodopirellula baltica SH 1
MATKTCYYEVLKVERTATKQQVDRAYRKLAIKYHPDSNRDDGSATAKFKEATEAYEVLSDANKRARYDQYGHAGVEGATQQYGDVEDIFEAFGDLFGGGFGDFFGGGSRRGGGRRRVRRGADVRCDVTLTLEEAARGCHKDIVFRRRVSCDTCDGSGAAAGSEPVTCTMCGGQGQVIQSAGILRVQTTCPTCKGAGKQIGEPCGKCRGTGTQNEKAEMNVEIPAGVDDGMRVRLQGEGEPSPDGGPNGDCYCFISVKEHNLFKREGQHLILQMPISYAQAALGATINVPTLDGPHELTVPAGTQTGHVFTVRGQGIVDPRSGRTGDLLVQIFIEVPKKLSDKQQKLLRELAELDHDSVLPERTSFLDKLRHFFDPEPEEAGTGSTDTEKDS

SEQ ID NO: 75447 - protein, 398 aa, Zea mays
MAANGKSSLANGASTGGKPIKCKAAVAWGPGEPLVMEEVEVAPPGRLEVRVKLLFTSICHTDLSFLKGENELHRKFPRILGHEAAGVVESVGDGVEDLAAGDHVIPIFNGECGACAYCESDRTNLCGTYRVDASKSTMVSDGGTRFSVADRVSGRTVPVYHFLNTSTFAEYTVLDAACAVKVNPEAPLQKMCLLSCGISTGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 75448 - protein, 210 aa, Helicobacter pylori 26695
MFKNDFEKIRQQRVLICGVGGVGGFALDALYRVGIGQITIIDKDVFDVTNQNRQIGSERIGESKVLVLQDLYKGIQALNLHIDEAFLNSFNFRDYDYILDCMDDLPIKTSLAIKCQNFAYGKFISSMGSAKRLNPKHIQVGSVWESYGDKFGRKFRDFLKKRRFKGDFKVVFSPEIPHCIELGSFNAVTASFGLQIASEVVQDIINDKRK

SEQ ID NO: 75449 - protein, 312 aa, Saccharomyces cerevisiae YJM789
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPAEGLDLALKKMGTDYVDLYLLHSPFVSKEANGLSLEEAWKDMEQLYKSGKAKNIGVSNFAVEDLQRILKVAEVKPQVNQIEFSPFLQNQTPGIYKFCQEHDILLEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYDKYNYAAQKV

SEQ ID NO: 75450 - protein, 666 aa, Physcomitrella patens subsp. patens
MLRSGENPTKDDDGDDDDDDDADDDEIEGAADELPGDEADIHDGLRTHFPLSFGKQEAKAVPLESIHSKTKRGEVVAERLLLKSANKLKSEASRRSGQIQFASAGSQFYGPPRPPAARADEDIVGPPRPETIVNDEDVVGPPRPPATVEDEDIVGPPHRPGTSSTEDEDGGEDEADEDDDEYRFPLSNEIVLKGHTKVVTAIAVDPTGSRVLTGGYDYSVRMYDFQGMNAQLRSFRQIEPSEGHQLRALSWSPTADQFIAVTGSATAKIYDRDGFTQGEFVKGDMYIRDLKNTKGHISGLTGGHWHPKERQTALTSSEDGSLRIWDVTNFKTQKQVVKPKLARPGRVSVTACAWGLNGNCVAGGLADGSIQIWNVKAGWGSRPDIYISNAHENGDDVTSLCFSGDGNTLLSRSTDSTVKVWDVRKPKAPLKTFGDLPNSYAQTTVSFSPDERLIMTGTSTEKEGNKGGLLVFFDRQRLEFVRRVGVSADQSVVCSLWHPKLNQIFATTGDKKRGGTHVLYDPAISEKGALVCVARAPRKKSIEDMEAKPVVHNPHALPLFRDAPSRKRAREKARNDPIKSKRPDLPMSGPGFGGRVGTTKGSLLTQYLMREGGMIKETWMDEDPREAILKHADAAAKDPTFFGPAYAETQPQTIFHESDEEEEDGK

SEQ ID NO: 75451 - protein, 401 aa, Helianthus annuus
MATKKSVSSLTEGDLKGKRVFVRVDLNVPLDDTFKITDDTRIRAAVPTIKYLMSHGARVILSSHLGRPKGVTPKFSLKPLVPRLSELLGIEVKMADDCIGPDVEKLVAEIPEGGVLLLENVRFYKEEEKNDPEFAKKLASLADLYVNDAFGTAHRAHASTEGVAKHLKPAVAGFLVQKELDYLVGAVSNPKKPFAAIVGGSKVSSKIGVIESLLEKVDILVLGGGMIFTFYKAQGLAVGSSLVEEDKLDLATTLLEKAKSKGVSLLLPSDVVIADKFAADANSKIVPASSIPDGWMGLDIGPDSIKSFSEALDTTKTVIWNGPMGVFEFDKFAVGTEAIAKKLAELSGKGVTTIIGGGDSVAAVEKVGLADKMSHISTGGGASLELLEGKPLPGVPALDEA

SEQ ID NO: 75452 - protein, 102 aa, Triticum aestivum
MPTQMLLTQDRYLQSRSDAVAQIEKTIGELQGIFRQLAQLVSEQHEQIERIDRDMELTLKNTEGAQAQLLKYLEKISSNRWLAIKVFLVLIFFMIIFIVFFV

SEQ ID NO: 75453 - protein, 489 aa, Arabidopsis thaliana
MFLVHQNMDAPLSHYFIFTGHNSYLTGNQLSSNCSELPIADALRRGVRVVELDLWPRGTDDVCVKHGRTLTKEVKLGKCLESIKANAFAISKYPVIITLEDHLTPKLQFKVAKMITQTFGDMLYYHDSQGCQEFPSPEELKEKILISTKPPKEYLEANDTKEKDNGEKGKDSDEDVWGKEPEDLISTQSDLDKVTSSVNDLNQDDEERGSCESDTSCQLQAPEYKRLIAIHAGKPKGGLRMALKVDPNKIRRLSLSEQLLEKAVASYGADVIRFTQKNFLRIYPKGTRFNSSNYKPQIGWMSGAQMIAFNMQGYGRALWLMEGMFRANGGCGYVKKPDFLMDASPNGQDFYPKDNSSPKKTLKVKVCMGDGWLLDFKKTHFDSYSPPDFFVRVGIAGAPVDEVMEKTKIEYDTWTPIWNKEFTFPLAVPELALLRVEVHEHDVNEKDDFGGQTCLPVSEIRQGIRAVPLFNRKGVKYSSTRLLMRFEFV

SEQ ID NO: 75454 - protein, 414 aa, Clostridium perfringens str. 13
MKRWTFDENTIILPNGLKVITIKKDTRLASINIGVNIGSLYEDEKELGMSHFVEHMLFKGTKNRSNEQLNRELEFLGGDYNAYTDYISTVYSITCLDEEFEKGIELLSDMVLNSSFDEKEMKKEKGVVLSEIKSDKDDIEDLSISRTHEYAFDKSALKNSIAGTEEHVKGFKRKQVYDFYKKYYTPDNCVIVTVSAFSHEQMQKIIIDLFGKWEGKSHKKAEIIKEENKELIKTTYKSQIEQGTVTYLYAFKEVCEKDKLPLKILSYKLAESSNSILFRELREERGLAYDVYSQMDLDENVNTMNIFTSVREESIDEVIEVIDKAILDIKNKDINFDEDMLCMMKKTHKTGVVSTLEDCSSLCSYVLVQSLAGKDITEFINSMEELETLTGEDIYRVCNKYLNKPTIHILKPME

SEQ ID NO: 75455 - protein, 178 aa, Streptomyces avermitilis MA-4680
MTHKALITGIGGKDPKVDQEAFTAPTSVVIGEVTLHAGASLWYGAVLRADCGPIVVGADSNIQDNCTLHVDPGFPISIGERVSVGHNAVVHGATVEDDCLVGMGATVLNGAVIGAGSLVAAQALVPQGMRVPPGSLVAGVPAKVKRPLTDEEREGIKLNGTYYVELAKSHRAVHAQED

SEQ ID NO: 75456 - protein, 318 aa, Musa acuminata
MDSFPVIDMEKLLGRERGAAMEILRDACEKWGFFEILNHGISHDLMDEVEKVNKEQYNKCREQKFNEFANKALENADSEIDHLDWESTFFLRHLPVSNISEIPDLDDQYRKAMKEFAAAIEKLAERLLDLLGENWKLEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 75457 - protein, 447 aa, Vitis vinifera
MAKVCWPYFDPEYENLSMRINPPRVSVDNLSCSDCTLIKVDSMNKPGILLEVVQILTDIDLLITKAYISSDGGWFMDVFHVTDQQGNKITDGKIIDYIEKALGPKGDTIDGVKTWPGKRVGVHSVGDHTAIELIGKDRPGLLSEISAVLADLHFNVVGAEVWTHNRRIACVVYVNDDATCRAVDDPTRLSVMEEQLKNVLRGCEDDDKVARTSFSMGFTHVDRRLHQMLFADRDYEGGGTTIEADYPPSFKPKITIDRCEDKGYSAVSVMCKDRPKLMFDIVCTLTDMQYVVFHASISSDGPYASQEYFIRHMDGCTLDNEGEKERVIKCLEAAIRRRVSEGLSLELCAKDRVGLLSEVTRVLREHGLSVTRAGVSTVGEQAMNVFYVRDASGKPVDMKTIEALRKEIGHTMMLNVKKEPSSAKTPEASGWAKTSFFFGSLFERFLT

SEQ ID NO: 75458 - protein, 617 aa, Arabidopsis thaliana
MADSQNGKSAFFFFFVSLILLFLSPSYSDVTASESDPIPYENSDASPGVVTSSESDRQGVSLHRLEELVRNLTELVARLDAKLSETPFKVKKEITRDEIEEKAKAFSVTKYSPFWSERFEFTSAVKLDSEATCINVLPFRDHEGLSKYFAVGDSSGRVFVFLRNGDVLVEFFTTCDSPITAMVSYMSVYKNESFVVTGHQSGVILLHRLREGSIGEDLNSAVMENVGKFDGTEDGLQVTLLEVHHVGRVRYILATDLSGKLTVFTENRTVYGSVSPTSRPLVFLKQRLLFLTETGAGSLDLRSMKIRESECEGLNHSLARSYVFDASERTKAYGFTSEGEIIHVLLLGDIMNFKCRVRSKKKVQMEEPVALQAIKGYLLIVNQEKVFVYNVSTQHYVRTTGPRLLFPAALEDIRSTFLSHRESTKTTDHQKLEKVTPLIASDREKLLVMGLGDGYVATYKSKLPISKAEFNTMLWSSPVFFFILFLFGAWHFFSKKKESLTAWGPDDPFSSTTMSSSSTTTAQNSSAFSESTRRNDDHMDLRRRYVSPSRYPPGAATGAYRSVGSNDPSSRAPVETTNYRTTAQEMKYRGGSGLDSGGFGKRRESLFGNNKALDDES

SEQ ID NO: 75459 - protein, 300 aa, Brucella melitensis 16M
MELPLEHALYPFSNNDGFQLQRSKGGTINMQDKVVLVGCGNMGFAMLRGWLDSGILKAGDVHVVEPAEALRERAALAHVHVYADAADLPADLQPRMVLVAVKPQMMANVLPAYKRFAPASTFVSVAAGIPVALFESHLGKDVAVIRCMPNTPAAIGKGMLVTFKNANVSDANEAFVTSLLKTSGKVASVDEEGLMDAVTAVSGSGPAYIFHFIEALTDAGVNLGLPRETAALLAMQTVMGAGALADASTDSPSKLREQVTSPNGTTAAALDVLMGGDRLKELVAEAVKAAHKRSVELGKS

SEQ ID NO: 75460 - protein, 251 aa, Carboxydothermus hydrogenoformans Z-2901
MRKPFIAGNWKMYKTPVEAAGFVRELIDSLKDVSGVDVAVCPPFPALWPVKEALEGSNIALGAQNMHFEKEGAFTGEVSPAMLQDIGVKYVILGHSERRAYFGETDELINQKIKAAFTWGLNPIFCVGETLEERERGITKAVVEIQVLKGLAGVTAEQAENLTIAYEPVWAIGTGKTATPDDAQEVCQFIRELLVKLFGREIADKVRIQYGGSVKPENIKELIAKPDIDGALVGGASLKVESFTAIVKGSI

SEQ ID NO: 75461 - protein, 491 aa, Brucella melitensis 16M
MTSQTIPVDPFDCIVFGGTGDLAERKLIPALYQRQRAGQLSDPTRIIGASRSQMTDDEYRTFAGNAIKEHVKPEEVDQAEVEIFLKRLHYVAVDAKSDEGWDALKTLIGKKPEKIRAFYLAVSPTLFGDIATRLKAHGLITRDTRIVVEKPIGRDLDSAKALNDTLGSVFREDQIFRIDHYLGKETVQNLMALRFANALYEPLWNSAHIDHVQITVAEAVGLEGRAGYYDKAGALRDMVQNHILQLLCLVAMEPPSSIEADAVHDEKVKVLRSLQPISTHNVEELTVRGQYRAGASAGGPVKGYLEDLESDTSNTETFVALKAEIANWRWAGVPFYLRTGKRLATRVSEIVITFKPIPHSIFGESAGKVIANQLVIRLQPDEGVKQWLMIKDPGPGGMRLRHMPLDMSFAESFEDRNPDAYERLIMDVVRGNQTLFMRRDEVEAAWRWIDPILQAWEFNSQPVQGYTAGTWGPSSSIALIERDGRTWHESL

SEQ ID NO: 75462 - protein, 228 aa, Zea mays
MAAKGGDELKLLGVWDSPYVNRVQIVLNLKGLSYEYVEEDLLNKSELLLNSNPVHKKVPVLIHAGKPVAESQAIVQYLDEAFPGGTCPSVLPADPYARATARFWAAFVDDKVGSPWHTVLFAREHGKKADAASRIVAALETLEGAFKDCSGGRDYFGGGAIGFVDVVLGSYLGWFKVFEKMVGVRVLDVARTPLLAAWGERFAAAEAAKDVLPDDVDKVLEFLQKFLD

SEQ ID NO: 75463 - protein, 542 aa, Physcomitrella patens subsp. patens
MTIAKPGTPGALSICENVVVVLDFGSQYTHLITRRIRGLHISSFCLPAGTPLDKIQALKPSVIILSGGPHSVHLENSPTLPEEFFSYVQEQGITVLGICYGLHLIVKLLGGEVKQAEHQEYGRMQISAVEGSRLYGDAGSINNQTVWMSHGDEAVKLPPGFKVVATSTQGNIAAIENVDSRIYALQYHPEVTHSEKGTETLRHFFLNVCGMKADWQMQNVLEEEIKKVTATVGPDDHVICALSGGVDSTVAATLVHRAIGDRLHCVFVDNGLCRYKERERVMATFVKDLHLPVTCVDATEQFLSKLKGVVDPERKRKIIGAEFIAVFDEFSHRLEREIGKMPAFLVQGTLYPDVIESCPPPGSGKSHSHTIKSHHNVGGLPENMKLKLVEPLKWLFKDEVREMGALLDVPVSFLKRHPFPGPGLAVRILGDVTQDGALDTIRLVDEIFVNSIREAGLYDKIWQAFAVYLPVKTVGVQGDKRTHSHAVALRAITSEDGMTADWFHFDGKFLAEVSSKICNSVRGINRVVYDITSKPPSTVEWE

SEQ ID NO: 75464 - protein, 386 aa, Cryptococcus neoformans var. neoformans B-3501A
MDMDSAHLDSSLLTLAFRLIKAAQTAAPSVLADLLAEGAPAWFQDDDLGWSCLHYAAERKEPECLEVLLQGGAVWNAVDKWGRTAGEICLSLGDEEGWSIIRNEGIRSEMLHHALSGTSSPDATNNIVLRAEDKTSAGDNLVFLKSKLTWDVGKDGKERVLDADGNGVMMGWEEPLSYCIVVEHVKRLTEEHPKAELGAEGMSILNVGFGLGIVDRLFQECDPKPSHHTIIEAHPQVLEYIHKKGVHLLPNVRILQGRWQDWLLDGEKVGDVLSGTPDGMGFDAIFVDTFAEGYEDLKAFFEVIPDILNADNGRFSFWNGLGATNPTIYAVSSSLAELHLEDVGLQVEWHDVLIPESMREEVWKGVRRRYWDLPGYRLPIAKMSLI

SEQ ID NO: 75465 - protein, 300 aa, Zea mays
MVDSFESDPIPLPVVYDRYDEPNHNEILEVLALLEYNEEARITDAIEGLIHEASSSMTAALEPVEHRRRQVLTATGEVEQKPTEGITNEVEAEEACELTGDATDFSDPEDTPTSPPSRPSPTRSSTATSSTTHRSTGRKSNFHARCTSHPTTTARLLHSLQSPNQAEVVKSSEPESARPPVVYNSHVELDLYSFTPPIFSVEQVIEEEVPVDMPTRCSRMDPNCDAYSVLNLHVICIVGGPNSNEYGTNRVLHHTIGLPDFSQELQGFQAITYYQAIINNLDDAQEQMDMAIATTLRKSK

SEQ ID NO: 75466 - protein, 365 aa, Triticum aestivum
  misc_feature (74)..(74): Xaa can be any naturally occurring amino acid
  misc_feature (89)..(89): Xaa can be any naturally occurring amino acid
  misc_feature (95)..(95): Xaa can be any naturally occurring amino acid
  misc_feature (126)..(126): Xaa can be any naturally occurring amino acid
  misc_feature (142)..(142): Xaa can be any naturally occurring amino acid
  misc_feature (184)..(184): Xaa can be any naturally occurring amino acid
  misc_feature (229)..(229): Xaa can be any naturally occurring amino acid
  misc_feature (313)..(313): Xaa can be any naturally occurring amino acid
MSAYCGKYKDELIKNAAYIGTPGKGILAADESTGTIGKRFASINVENVEDNRRALRELLFCTPGALQYLSGVIXLFEETLYQSTKGGKXPFVDIXLRRGNVLPGIKVDKGTVELAGTNGETTTQGXMTLGKRCAKYYEAGAXRFAKWRAVLKIGPTEPSQLSIDQNAQGLARYAIICQENGLVXPIVEPEILVDGPHDIDRCAYVTEMVLAACYKALNDQHVLLEGTLXLKPNMVTPGSDAKKVAPEVIAEYTVRTLQRTVPAAVPAIVFLSGGQSEEEATLNLNAMNKLETKKPWNLSFSFGRALQQSTLKXAWAGKVENEEKARKAFLVRCKANSEATLGTYKGDATLGEGASESLHVKDYKY

SEQ ID NO: 75467 - protein, 367 aa, Wolbachia endosymbiont strain TRS of Brugia malayi
MVNMSFNCGIVGLPNIGKSTLFNALTQSSAAEAANYPFCTIEPNIGKVPIRDQRLRQIAAIAGSEKVIYNQLEVVDIAGLVKGASKGEGLGNKFLSHIREVDAIVHLLRCFMDDGVNHVHNEIDPISDAEVVEMELILADIDSIEKRLPQLEKKAKQGNKELKRQLDLMHEVLATLKLGKPARSLECSDRNEMKSLQLLTAKPVMYVCNVEDINIITGNKLSQKVKKIAEENKNKFYCISAKLESDIANLESEEEKQSFLSEFGLQESGLDGVARIMYEVLSMITFFTVGLKEARAWPIKIGSTADKAAGVIHNDFEKGFIKAETISFADYVKYRSESACKDAGKIRFEGKDYIVQDGDIMHFRFNV

SEQ ID NO: 75468 - protein, 153 aa, Triticum aestivum
MSETETAAAAATSTERKPRRLRGHKKGAVTCCVASSARPGVVASSGEDGCLCWFDLRTKDVLLTIEAANKPISSICFKSGNEDHVYVSAGNEILSFDIRMGSQSKPLETYNYNRDEINQIAVSSKGYLAAADDSGDVKIVNTTQKCLYKRLRE

SEQ ID NO: 75469 - protein, 471 aa, Francisella tularensis subsp. tularensis SCHU S4
MWSKTMEYNYDIIIIGSGPGGEGAAMKATRNGQKVAIIEDDAIGGGCNNWGTIPSKALRQLSREVWHNKKNFDFPEMLDTAYEIVIKQREIKRNRFANNEIDVFYGFASFIDKHKIKISRKNGSTEIITAKKFILSTGSRPYHPDDIDFTHPRILDSDKLLELKDKNIKSITIYGAGVIGCEYASILGTLDIQVNLINTRNKLMSFLDDEIIETLTNHFTVNQRINLIHNETYKSIKARGDKVVTTLNSGRIIESDYVLFALGRSGNTNGLNLDKIGVEYDPQRGLVKVNDNYQTTQENIYAVGDVIGFPSLASSAFNQGRFAATHIIDGSCNDKLVEDIPTGIYTRPEISCIGKTEEQLTAENIPYEVGRAYFKDLARAQISGSETGMLKILFHKETLEILGIHCFGHRVSEIIHIGQAIKSMPGKHNTIRYFLNTTFNYPTMAEAYRIAGIDGLNKLKPKNKQFVPEHQ

SEQ ID NO: 75470 - protein, 418 aa, Oryza sativa
  misc_feature (280)..(280): Xaa can be any naturally occurring amino acid
MGRKRALLVGINYPGTKAELKGCHNDVDRMHRCLVDRFGFDEDDIRVLLDRDSSGTQPTGANIRRALAQLVGDARPGDFLFFHYSGHGTRLPAETGQNDDTGYDECIVPSDMNLITDQDFRELVQKVPNGCLFTIVSDSCHSGGLLDSAKEQIGNSTRQNQTQSREREEPSDSGSGFRSFLKETVRDVFESEGIHLPRSRHSQSHYGGEDQYETYAQPTDGHTKNRSLPLSTLIEMLKEKTGKDDIDVGSIRMTLFNIFGDDASPKVKKFMKVMLGKFQXQGQSGEQGGLMGMVGSLAQEFLKVKLEGNEEEAFKPAIEQEVHSVDEVYAGTKTWAPNNGILISGCQSNQTSADATTPQGSSYGALSNAIQTILADKRGNVSNKDLVMKARSLLAKQGYTQQPGLYCSDDHVHVSFIC

SEQ ID NO: 75471 - protein, 476 aa, Brucella melitensis 16M
MSADTTEKKATRTPRRRTPAYVKSLRGVKNWKQATEWLAWRDIEDIECITPDQAGVARGKMMPSKKFTSNTSLALPSAVFMTTISGAYPEDGYGFHYPEDDGDLKLLPDLTTLSAVPWETDSTAQVICDLVYQDGRAVEFTPRNVLRNVIAAYSKRGLKPVVAPEIEFYLVRKNPDPDYPLTPPVGRSGRAIGGGQGYSIAGVNEFDELIDDIYHFSEGQGLEIDTLIHEEGAGQLEINLRHGDPVELADQVFMFKRTIREAALKHDMYATFMAKPIQGQPGSAMHIHQSIVDKKTGRNIFTNEDGSESQAFHHFLGGMQRHVPNALVMFAPYVNSYRRLTPDASAPVNVKWGYDNRTTAFRVPRSDPSARRVENRIPSSDANPYLALAASLACGLIGLVNKIEPEQPATTSVNTKEVELPRGLIDAVELFEEDAELRNLFGSSFMTTYAAIKRAEFETFMEVISPWEREFLLLNV

SEQ ID NO: 75472 - protein, 476 aa, Nocardioides sp. JS614
MTATATKPAKLPREEDPRNPVHRLTALLDEGTLELITPDDDSGMLAAVGQVDGTRVVAFCSDATVMGGAMGDLGCRVVVDAYHRAMTDRIPVIGLWHSGGARLAEGVLSLHAVGRIFQVMTQASGRIPQISVVLGPAAGGAAYGPALTDVVILGPEGRIFVTGPDVVRSVTGEDVDMLRLGGPEPHGRRSGVVHILADTERDALDRARDVAGLLGSQGSLVVEDVEDRDLAALLPESKKRAYDVHPLVESILDEGTAQELHARWAPNIVTALGRLGGRTVGVVANNPLRLGGCLDSLSAEKASRFVRMCDAFGVPLVVVVDVPGYLPGVGQEWDGVVRRGAKLLHAFGECVVPRVTLVTRKTYGGAYIAMNARSLGATKVFAWPGAEVAVMGAVAAIRILHRRRLAEVAPDIRPQVEAELAAEHERIAGGVDKAVEIGVVDEVVEPAVTRSALARAIDDAVQADGVRRGAHGNIPL

SEQ ID NO: 75473 - protein, 398 aa, Carboxydothermus hydrogenoformans Z-2901
MVLEIKARSRFFYKFTAFMGPAFLVSIGYIDPGNWAANFAGGSRYGSIMLITVLLCNFLAILFQSLVAYLTLKTGKSLAENIVEKLPKPLVAFYGVLAVTGAMATDVAEFVGAALGFSLILGLDLLKSVIIAVVFVVCGYFFERQGNRKVEFLIMGFLAAIGFTYLMELLILKPKIYNLINLGVKLDGDFLFVVLSMLGATVMPHNLFLHSDLIAEKLKQRIITTKDFPVVFLENLIALNLAFLVNSAMIVVAKDMFYDCGVAVDSLRLAYHTLEPVLNGWAALIFGLALVLCGLSSSLTGTIAGQNLLEKFLPVNLSALSRKMIIITPALYFFLKGLGEIELLLLSQVVLSFVLPFVLIVLLWFLNNIANKYLLILGWFLTAIIGSCNVILLWTAIF

SEQ ID NO: 75474 - protein, 441 aa, Bacillus sp. SG-1
MSHLEKAKTMTSLHPLGLLNNFRDDPLMFLDEMRTSAEDLVSFRFANRRVHLLLNPELIKEVLVTKAASFQKSKQFQELHPLLGEGLLTSEGPKHREQRKLIQPFFTHRHIENYINDMIDVTEKAIGNMSEHETRNVSKDMMEVTLAIISKTMFAMDIEEGHEKVGKPLEVAMETATKRIRSFIKLPLSFPSKEIKDYVHAINQLKDVVENVITTRESQKERYPDLLDALIHAKSDEGEGMPREQLQDELMTLTLAGHETTANLLTWCLYALAKNEGAKRKLYREIDRVLGTKRITSDDLPRLTYTKQVLQEALRLYPPAWMFGRIAIEDESIGDYSVKKGENILVSPYVMHQKIEYFEEPLAFKPERFLEKQPPYAYFPFGGGPRVCIGNHFALQEATIILAMLVQKFDVCLDPGSGEPDFEPLITLRPKNGLFLRMVER

SEQ ID NO: 75475 - protein, 424 aa, Oryza sativa Japonica Group
MEGRMQGKAPLSDSNRRIMDADAPPRRVYQGWKGSNIFFLGGRLIFGPDVRSLILTVCLIVIPVILFAAVISGQLDHEYHNQIGGWVASVAIIFTAYIIVLLLLTSGRDPGIIPRNAHPPEPEDVGESSNLSEWPGGQHGSTGLPLTKDVLVNGVLVKVKYCHTCMLYRPPRCSHCSICNNCVERFDHHCPWVGQCIGKRNYRFFFMFVSSTTLLCVYVFAFCWVDLRIIMDTHRCKLGRAIMKSPVSGILILYTFIAVWFVGGLTSFHLYLISTNQTTYENFRYRYDRKTNPHNRGLVQNFIEILCSRIPSSRNNFRAKVKEDSATFPSSLGMGRALSPPKMSVDLEMGMKRQTVAMEELEDLHSQIGSAMGLERCGTEPPHIVGRKGCSEIATDIEAFAEEFGLEQRFTERKKIEQRTSHNP

SEQ ID NO: 75476 - protein, 333 aa, Prochlorococcus marinus subsp. marinus str. CCMP1375
MVQKSKPLITEAYQFSVAPMLDCTDRHFRVLMRQITGRALVYTEMIVAKALKYKNRKSLLDFDEIEHPIALQVGGDDPIVLSEAAQIAEEWGYDEINLNLGCPSPKVQSGNFGACLMGQPDQVFKCIEAMKKKTNIPVTIKHRTGIDNLDSEQLLLDFVDKMASAGADRFSIHARKALLNGFNAKENRSIPPLEYEKVAKIKKCRPNLKIELNGGLQNQYDCIKALKTFDGVMVGRAIYSNPLMWKEIDDIFFGEKKVKINASIILRGLIPYAEKHLSKNGRLWDICKHTLHLVQGVKGARKWRNELSQKAQNPKAELIILEKAARQLEDAGL

SEQ ID NO: 75477 - protein, 166 aa, Prochlorococcus marinus subsp. marinus str. CCMP1375
MNTNFFLSSRRSFLVGILSAFLGIVLGPKKVLAASNSDSWSLTKDQWKQRLSREAYYVLREEGTERPFSSLLNDEKREGIFACAGCDLPLFDSSRKFDSGTGWPSFWEPLPNAIETKTDFKLIVPRTEYHCSRCGGHQGHVFNDGPRPSGKRYCNNGVALVFTVSK

SEQ ID NO: 75478 - protein, 291 aa, Rhodopseudomonas palustris CGA009
MSRKHPIISITGSSGAGTTSVKKTFEQIFRRENVNAAFIEGDAFHRYNRVDMRNKMAEEAERGNRHFSHFSPETNLFEELEQTFRSYAETGIGRTRHYVHDDEEAALHGVPPGNFTQWQDLPANSDLLFYEGLHGAVITEKVNVAQHADLKIGVVPVINLEWIQKLHRDRAARGYSTEAVTDTILRRMPDYVHYIVPQFAETDINFQRVPTVDTSNPFIARWIPTADESMVVIRFKNPRGIDFAYLLSMIQGSFMSRANSIVIHGAKLDLAMQLILTPLIMQLIDRKRSMK

SEQ ID NO: 75479 - protein, 514 aa, Pseudomonas syringae pv. tomato str. DC3000
MPASSVMPPPMLEQYVKKILTSRVYDVAVETPLHGARQLSERLGNQVLLKREDLQPVFSFKIRGAYNKLAQLTAEEAARGVVTASAGNHAQGLALAAKELGILATIVMPRTTPEIKVEGVRSRGATVVLHGDSFPEALAYSLKLVEQQGFVYIHPYDDPDTIAGQGTVAMEILRQQPGKLDAIFVPVGGGGLIAGIAAYVKYLRPEIKVIGVEPDDSNCLQAAMAAGERVVLSQVGLFADGVAVAQIGYHTFEVCRHYVDEVITVSTDEICAAIKDIYDDTRSITEPAGALGVAGIKKYVEQRGVTGQTLVAIDSGANVNFDRLRHVAERAELGEGREAIIAVTIPEQPGSFKAFCEAIGKRQITEFNYRYHTDREAHIFVGVQTHPENDPRSALVASLTGQGFPVLDLTDNELAKLHIRHMVGGHAERVNDEVVLRFEFPERPGALFNFLNRLGGRWTISMFHYRNHGAADGRVVAGLVVPEEERHLVGAALDEIGYRYWDESENPAYRLFLG

SEQ ID NO: 75480 - protein, 223 aa, Pseudomonas syringae pv. tomato str. DC3000
MTQDQLKQAVAQAAVDFILPKLDDKSIVGVGTGSTANCFIDALAKHKGAFDGAVASSEATAARLKGHGIPVYELNTVSDLEFYVDGADESDEHLNLIKGGGAALTREKIVAAVAKTFICIADGSKLVPVLGAFPLPVEVVPMARSHVARQLVKLGGDPVYREGVLTDNGNIIIDVHNMSITNPVELEASINAIVGVVTNGLFAARPADLLLLGTAEGVKTLTR

SEQ ID NO: 75481 - protein, 343 aa, Rhodopseudomonas palustris CGA009
MDQGQTLSVLLDSYAVDPQKKAVAAAVGAIAAGSIEISELIGQGALAGITGAAHGGSNADGDVQKDLDVKAEQIIVKSLKDVPYAALASEESDTLLDGDPNAPISIAYDPLDGSSNIDTNMTVGTIFSIIPNQPGVKPFTAAGSCQIAAGFVVYGPQTSLVLTLGDGVNIFTLDRKAKVYRLIRERVKVPADTAEYAVNASNHRHWEQPIRDFVDECIAGADGPRAKDFNMRWIGSLVAEVYRILTRGGVFLYPGDNRPGYGNGRLRLLYETHPMSFVMEQAGGAASTGRERVLDLTAKTIHQRSPLIMGSIDKVKRIELLHTDPSAASRSAPLFARRGLFRV

SEQ ID NO: 75482 - protein, 440 aa, Physcomitrella patens subsp. patens
VEAKIREIFMPALSSTMTEGKIVTWNKTEGEKLTKGESVVVVESDKADMDVETFYDGFLAKIVIGEGETAPVGAAIGLLAETEEEIAEAKSKGAAQAAPAAPKPSAVEEKAVAPPAPTAAPAVAAVQVAPEPTAPEEPRSSRIVATPYAKKLAKQYSVDLATIAGSGPSGRIVAEDVEAAAGKTPVPAAAPVPSVAQPSAAVAAAPSAAPTPAAALAPAGSVAFTSMQAGVARNMVDSMSVPVFRVGYTITTDALDALYKKIKSKGVTMTALLAKAAALALAKHPVVNACCKDGKSFTYNEDINIAVAVAMDGGLLTPVLKNADKVDIYSLSRSWKDLVDKARAKQLSPAEYNSGTFVLSNLGMFGVDRFDAILPPGMGAIMAVGASVPTVVATGNGLFGVKNRMTVNVTADHRIIYGGDLAVFLQTFAAIIEDPTELTM

SEQ ID NO: 75483 - protein, 386 aa, Zea mays
MKAVGYSPYDSSAQNRGLRGRSFSGNVVASAGAFPYMRANNDLESEIHRVEQDAYTGILRAFKVQSDAISWEKESLITELRKELRVSDEEHRELLNKVNEDGTIRRMRELRQAGGSPSGLHHGNMVLYGAEPGSTTKRQRASHSIPLQSAGLQSPMMPSHSVSSAKWGPLQARGTKARTPIPLALPSVDPSSLINHKVYTRWPEDNNFYEATITRYNPVTGEHGLVYDMGTQAESWESVRLCDMAPEDIRWGFDGHLSNRDVWSPSGPMLMRHMTNNGAMAGSIKGRGRLSINETIKDYAPPENGTNRNFDHVDIPNTGSVVMEVKRVLFNPNMPEIEKARKLLKDQEQSLLDAIARLDEASDSDNEDMAMEGRMGSAGERNGITT

SEQ ID NO: 75484 - protein, 468 aa, Pediococcus pentosaceus ATCC 25745
MVVGTQAINVDTLIIGSGPGGYVAAIRAAELGQKVVIVERDYIGGVCLNVGCIPSKALIQAGHLYSTLQHGNPFGVSVSESKIDFTKTQEWKQNQVVNKLTGGVELLLKKHKVAIVRGEAYFNDNETVNVINGDDSHVYRFKRALIATGSRPVEIPHFKFSGRVIDSTGALNLKDVPEHLIIIGGGVIGAELAGAYMNLGSKITIIEGLDHILNGFDGELIQPVLNNFKKNGVEIVTEATAVEANQTDKDVTVTYEADGTTKTVNGDYCLVSVGRRPNTDQLGLNNTNIKLSKRGLIEVNDSMQTSVKHIYAIGDVVAGPALAHKASFEAKVAAAAMGGEDAHDTHYVLPAVAYTNIELATVGETPQSIAEKKLDAKSSKFPFAASGRAMTMDQTEGFIRLITDNPTGGIIGAQIVGPEASNLISELTLAIENGLTIKDIELTIHPHPTLGEEIMDAAELAAGLPIHV

SEQ ID NO: 75485 - protein, 429 aa, Pediococcus pentosaceus ATCC 25745
MTEIFKMPDIGEGMAEGEIANWLVKVGDTIKEEDAVAEVQNDKLLQEILSPYGGKITKLFVEAGTVVKVGEPLIEFDGDGSGAGAESEVPKETPASTEPEPESSAPVDQTAPEVTKVGAEYTSNGQLLAMPSVREYARKNDIDLTQVPATGRHGHITMADVENFKASPAPAASVPETESEKAPSAPVTPAAPAEVKAGRVPLSPVRKVIAKTLTNQVQTIPHVTIMDEVEVSKLMDLRNQFKEQAKQKGYKLTYMPFIAKALAGAAHKYPELSAMVDIEKQEIVYYEDTNVSFAVDTDNGLFVPNVKNVKSKSIMEVAQEIDDMAIRGRAGDLKPNELKGGTVTITNIGSESGSGFFTPIINPGESAILGIGRIRKTPVVNEDGELAVGNTLKLSLSFDHRLIDGALAQKIMNELKALLSNPAYMLMEV

SEQ ID NO: 75486 - protein, 332 aa, Glycine max
MERKRHSPISFTMFTLLLGVLAQNLVIPVISTTAIIVDQNFNSPDPHAGTDLSNSLCSYCSPDHGSGSGGHGSSPHHSQHGTPSHHGSTSHGGGGSYNPTPSTPPGGGSYDPTPSPPTDGGSYNPTPSPPSGSNCGTPPHDPSTPTPSVPTTPSTPTTPSTPSTPSHPPSGGGGYYNSPPTYGGGSPPTPITVSPPSTPIDPGTPTIPSTPPYLPSPTPFTGTCNYWNTHPGIIWGLLGWWGTLGHAFGVSSMPGFGASLSLPQALSNTRTDGLGALYREGTASFLNSLVNNRFPYTTQQVRDRFIASLASNKAAEAQANLFKMANEGRMKP

SEQ ID NO: 75487 - protein, 737 aa, Rhizobium leguminosarum bv. viciae 3841
MTYTNFTLETDADGIALVTWDMPGKSMNVFTAEVMAELDAIIDATTADAAVKGVVFTSGKSSFSGGADLSMIKSMFSSYQEEKAKSPETAVQALFGLVGRMSGLFRKLETSGKPWVSAINGTCMGGAFELSLACHGRVASNAKSVKIALPEVKVGIFPGAGGTQRVPRLANAQDALQMMTTGQSLTGSRAKAMNLVHQVVEPDQLIPAAKQMIKDGLKPVAPWDEKGFKAPGGGIWTPASAQLWPAAPAILRRETSGNYPAALAILKCVYEGLQVPFDTGLKIEQRYFTEVLQTREAFSMIRSLFISMQELGKGARRPAGHAKTELKHIGVVGAGFMGASIAYVTAAAGIPVTLIDRDIEAATKGKTVSEGLVKDSVGKGRLTQDEAAALLSRITPSADYADLANADLVIEAVFEDREVKKAVIEAVEAVLPEGAVFASNTSTLPISGLARNSQRPADFIGIHFFSPVEKMMLTEVILGSDTGDRALAVALDYVAAIKKTPIVVNDTRGFFVNRCVLRYMSESYDMLIEGVPPVMIENAAKMAGMPVGPLALNDEVAIDLSLKILKATVADLGEKAIDPRHMELISRMVEKEGRFGRKNSKGFYDYPPKPAKKSLWPDLKTFYPQKQADEVDVNVLKQRFLVTIALEAARTVEEGIVTDPREADVGSILGFGFAPYTGGALSYIDGMGAKAFAELAEKLAAAYGNHFKPTPLLKDMAAKGETFYGRFDPYAKLGKAA

SEQ ID NO: 75488 - protein, 172 aa, Clostridium perfringens str. 13
MSLKDKIRVIEDFPKKGISFKDITTLIADGEGLRDSVDQMAEFFKDKNIDVVVGPEARGFIFGVPVAYALGVGFIPVRKPGKLPGDTVRVEYDLEYGKDALEIHKDAIKPGMRVAIVDDLLATGGTIAAVAKLVEQAGGEVAGLAFTIELTELKGRDKLKGYEVTSLVDYDV

SEQ ID NO: 75489 - protein, 632 aa, Ustilago maydis 521
MSSTSSTIAGPSQSKVEINSRGIPHAPFISNVQEYLGGPDEEVEPTLKKFQETMSKYKFMELNTAQRRRGLEEKIPDIRKTLQMVNFLKDKKDDPEPIETTFELNDTLYAKATLDPTDTVHLWLGANVMLEYPLDEAISLLTSKLNGAEKSLTTSKEDLDFLREQITIMEVNTARVHNWDVKRRRERREELERGGLAERAATGSKTSQASNQAFNERLQESHHCCCRNQEVSVTETSPCLLCLPFWHSTSGGGWLFDDRDKSETGAGKNETGAVFQESAKGGAKPRDGTNAAVDPPASSKTTAQLDGVGGSRRLSTDVVLTESQVASEAATTHLSANSMLTTPNDVPLPSQTGNHSDPIALTKLAPTSAPPPHSTLPASPLSLPHATDPLSSTTLIVPPLNFAMVSRGIYRSGHPNERNFEFLRRLSLKTVLYLGTEDYRSNMTNWTASQNITTHHLRLAINKEPTAEMDHADVVKALQLILKPENWPILIHCNKGKYRSWSHTSIFEEYSSFDDAGSLPLPHFDLACGAWTTDKFHQQTTTTTAAAAAVVGRPSHVADDRRLNIIVDVIAKRRTCRLARGRCGWGKEVERITMDIGVGIIQSIVNRIGRTHYISLRVPCMPLRKPTSCCLA

SEQ ID NO: 75490 - protein, 90 aa, Oryza sativa
  misc_feature (66)..(66): Xaa can be any naturally occurring amino acid
IPRKSKKLYWKKVSGDGTLQVDYFTFSPSIADYIRDASLVISHAGSGSIFETLRHGKPLIVVVNEXNPYVPGDAKPVVSLINKFFGFPDD

SEQ ID NO: 75491 - protein, 722 aa, Photobacterium sp. SKA34
MIYQGETLSVSYLEDGIAEINLNAQGPVNKFNISTLESFNQALNALYQQPDLKGVIITSAKDAFIVGADITEFLGLFAKPEQELSQWLSHANEIFNKLEDLPVPTLSAINGYALGGGCECVLATDFRVADTKARIGLPETKLGIMPGFGGTVRLPRLIGADSAMEIITAGKDKKAQDALKLGLVDAVVETDNLKCAALAMIKSAIAGKLDWQQRRKQKQAPLSLNKIEATMSFSTAKGMVAKVAGKHYPAPMAAVTTIEQAARCSRDEALVIENQHFVQLAKTDVAQALVSIFLNDQYIKSQAKKAAKSAKPTEHAMVLGAGIMGGGIAYQSALKGTPVLMKDIAEASLSLGMNEAAKLLNKQLERKRIDGLKMASVLSSITPSLHYAGADSVNIVVEAVVENPKVKAAVLADVENQVTDDTVIASNTSTIPINLLAQSLKRPENFCGMHFFNPVHRMPLVEIIRGEKTSQETIDRVVAYAAKMGKSPIVVNDCPGFFVNRVLFPYFAGFSLLLKDGADYIQIDKVMEKEFGWPMGPAYLLDVVGIDTAHHAQAVMAEGFPERMGKNGKDAIDVMFEAQRFGQKNGHGFFSYSIDRKGKPKKAVSDKTEALLAPVCQPNTAFTSDAIIARMMIPMINEVVRCLEENIIATPAEADMALVYGLGFPPFRGGVFRYLDSLGLANYVALADQYAKLGALYEVPKGLREKATKGETYYNHTTNLNA

SEQ ID NO: 75492 - protein, 271 aa, Arabidopsis thaliana
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGVFTVNGFSFKPLP

SEQ ID NO: 75493 - protein, 100 aa, Borrelia lonestari
MLKQEGFFFDIAFSSLLVRANDTLNIILSELGQSYISVEKSWRLNERHYGALQGLNKSETAEKYGEDKVLIWRRSYDVPPMPLEESDNRHPVYDIRYGGI

SEQ ID NO: 75494 - protein, 266 aa, Clostridium scindens
MRLKDKVILVTASTRGIGLAIAQACAKEGAKVYMGARNLERAKARADEMNAAGGNVKYVYNDATKEETYVTMIEEIIEQEGRIDVLVNNFGSSNPKKDLGIANTDPEVFIKTVNINLKSVFIASQTAVKYMAENGGGSIINISSVGGLIPDISQIAYGTSKAAINYLTKLIAVHEARHNIRCNAVLPGMTATDAVQDNLTDDFRNFFLKHTPIQRMGLPEEIAAAVVYFASDDAAYTTGQILTVSGGFGLATPIFGDLSERSDARG

SEQ ID NO: 75495 - protein, 607 aa, Candida albicans SC5314
MSYKGNDIEKQQSASTATGFNDKQIASTSEDATDRSHNIHGDTSSLDSRYTYETVDQEKNYFKRVYNSFKPMNLEEQGIDTSQLTPVERTIIASAKHPLARRLKARHLQMIAIGGSIGTGLFVGSGYALANGGPGAVLIGYVIVGYALLTVVNALGELSVQFPVSGSFNAFFSRFLEPSFGGTFGILYAASWCISLPSELIAAAMTIQYWNTEVNPAVWVAVFWVVIVVINLFGVKGYGEMEYFLSIIKVLAVVGFIILGICITCGVGDQGYIGGKYWHNPGAFNHGLKGVTSVFISAAFSFGGIELVALAASETANPRISLPAAVKSTFWRIFIFYILTAIIIGCLVPYTNDDLLNGTGIAASPFVIAVSQGGIRVVPHIMNAVVVIAVISVGNSSVYGCSRTLASLAVQGLLPKSMGYIDRGGRPLIAILFTSAIGLLGFLVVVDNEGDVFTWFFSICSLSSFFTWGAINVVHLRWRFALAAQGRSTDEIIFRSPLGTFGSWTGILVLILIVIGEVWVSIWPIGSPADVQQFWKNCLSLPLMIVMWAGFKTYHRSWNMLWVKLEDIDLDTGRREIDVELLKQELAEERQIIKSKPFVYRIYKFFF

SEQ ID NO: 75496 - protein, 329 aa, Bordetella pertussis Tohama I
MASNIVKAVRIEQHGGPEVLQVVDVEVPPPAANEVTIRQHAAGLNFIDIYFRTGLYPHPLPHGLGFEGAGVVEAVGADVRHLKKGDRVAYGQSPLGAYAQARNVPAAQVVKLPKGIGFDEAAALMLKGLTVQYLFRQTYRLQGNETILFHAAAGGVGLIACQWAKALGVKLIGTVSSPEKAELARAHGAWATIDYSRENVVERLLELTGGKKVPVVYDGVGKDTWEISLDCIEPRGLMVSFGNASGPVAGVNLGILNQKGSLYVTRPSLGVHVNTHEKLAAAADELFGLVLKKKIKVRIDQRYSLAQAGDAQTALAGRKTTGATVLTLD

SEQ ID NO: 75497 - protein, 260 aa, Arabidopsis thaliana
MDNLEDLKIVAEQWSKQGLEFVQKIPPPQLYTAIGVLLLATIWLLSIRLFRRTKSDTVLLSGLSGSGKTVLFYQLRDGSSHQGAVTSMEPNEGTFVLHNENNTKKGKVKPVHLIDVPGHSRLISKLEEYLPRAAAVVFVVDALEFLPNIRAASEYLYDILTNASVIKNKTPVLLCCNKTDKVTAHTKEFIRKQMEKEIDKLRVSRSAISTADIANDFTLGIEGEVFSFSHCHNKVTVAEASGLTGETDQVQEFIREHVKP

SEQ ID NO: 75498 - protein, 584 aa, Zea mays
  misc_feature (223)..(223): Xaa can be any naturally occurring amino acid
  misc_feature (465)..(465): Xaa can be any naturally occurring amino acid
MDAQDGDERPLIIHRLPLLQDESTSEFTSDGTVDLRNQPARKQRTGKWKACFFILGAEFAECVAFFAISKNLVTYLTGVLHESNVDAATTVSTWIGTSFFTPLVGAFLADTFWGRYWTILAFLSVYVTGMTVLTASALLPLLMGASYSRSAHRLFAYLGLYLAALGTGGIKPCVCALGADQFDASDPVERRAKGSFFNWYYFSINIGSLLSATVVVWVQDNVXGWGVGFAIPTLLMLSGLVLFVAGRKVYRYQRVGGSPLTRASQVVVAAVRNYRLVLPEPDDSSALLHQAPPGTTEGNDSTMQHTSQFRFLDKAAIVAPSSGEKGATASPWRLCTVSQVEELKTVLRMFPVWVSMVLFFAATAQMSSTFIEQGETMDNRVGPFTVPPASLSTFDVISVMVCIPIYDKALVPLARRATGKERGLSQLQRLGVGLALSVAGMVYAALLEARRLSLARAAADGRPLXSIPRGAPAFAVLGAGEVFATIGILEFFYDQSPDGMKSLGTALAQLAVAAGNYFNSAVLAAVAAVTTRNGEAGWIPDDLDKGHLDYFFWLMAVLGVVNLLHFLHCSVRYRGSSNNSTYSS

SEQ ID NO: 75499 - protein, 154 aa, Nocardioides sp. JS614
MTGLELGGPAPDFTLRDQFGQDVTLSSFRGRKAVVMFFYPYAFSGVCTGEMAGIRDRLAEFLTFETEVLAISCDPVYSLRAFADQDGLNFPLLSDFWPHGEVSRAYDVFNEAKGSSRRSSYVVDKDGRVRWAVHNAMPEGRDLDEHLKQLTGVL

SEQ ID NO: 75500 - protein, 291 aa, Sulfitobacter sp. EE-36
MTQTTQTLPAPLPPVLTAAQQTHVVNVLRRAARAEVLPRFRNLAPADIDTKSGPHDLVTAADLAAEAMITRALATAYPDALIIGEEAVSADPALQDKIADAPLAFILDPIDGTSNFAHGLSTFGMILAVTRFGKPAFGVIYDPVNDDWVISDDTSTPRFERALGQSRPLRVSMGKQIEDLSGFVPLGNFSKELRVKVAATLPSFAKVNSLRCSAHEYRTVAQGHADFVLSGTLHPWDHAAGALICAQAGAHVEMLSGGPYDATLRTGHILVAPDKTTWNRLRKVFAFLADV

SEQ ID NO: 75501 - protein, 340 aa, Prochlorococcus marinus subsp. marinus str. CCMP1375
MTLRVAINGFGRIGRNFMRCWLSRGENTGLDLVGVNVTSDPKTNAHLLKYDSILGQIKDAEIDYTDDTFVINGKTIKCFSDRNPMNLPWREWGIDLVIESTGVFNTFEGASKHLQVGAKKVILTAPGKGEGVGTFVVGVNADQYRHDDFNVLSNASCTTNCLAPIVKVLDQSFGINKGLMTTIHSYTGDQRILDNSHRDLRRARAAAMNIVPTSTGAAKAVALVYPEMKGKLTGIAMRVPTPNVSAVDLVFESGRSITADSINAALKSASEGSMKGIIKYGDTPLVSSDYAGTNDSTIVDTALTMAIGDNLGKVVAWYDNEWGYSQRVVDLAEVVAKNWK

SEQ ID NO: 75502 - protein, 364 aa, Photobacterium leiognathi
MALSSAKEIIDDIRQGRMVILMDDESRENEGDLIIASEMVTPEAINFMATHGRGLICLTLSKARCKTLNLPLMVQGNNDNFSTPFTISIEAANDVTTGISASDRAKTVLAAVAPNAKSTDIVMPGHIFPLMAQDGGVLIRAGHTEAGCDVARLAGLEPSSVIVEILNEDGSMARRPQLEIFAAKHGLKLGTIADLIEYRTQQESHIERISEYELNTEYGIFTLVTYRDTIDNQAHFALCKGEIQAKAATLVRVHVKDTLKDILQVGLSQWSLEAAMQRIQTEDGVLVIISQQESPKTLFEKLDMYAKEQPNSPHSGIVQSRNIGLGSQILADLGVKKIRLLSNSNQGYRALSGFGLEVVEYIYD

SEQ ID NO: 75503 - protein, 440 aa, Sulfitobacter sp. EE-36
MSQKIFEPGVAAGRLDADAYAAQFSDLHPPLDVHEALVAADRCYFCHDAPCITACPTDIDIPLFIRQIATGTPDAAAKTILSQNIMGGMCARVCPTEQLCEQACVREVAEGKPVKIGELQRYATDHLQAQGAHPFERAASTGKRVAVVGAGPAGLSCAHRLAMMGHDVTVFDARPKPGGLNEYGIATYKTPDGFAQAEVDWLLKIGGITVQNNAALGAAMTLDSLRADYNAVFLGMGLGGVNALGAEGEDKTGVLDAVDFISHLRQASDVAAVPIGRDVVVIGGGMTAIDAAIQAKLLGALNVTLVYRRGRDRMNASVFEQDLAASKGVRIVTHATPVAVIGNGAVREIEFEYVDDQMNGTGQTLRLPADQVFKAIGQTLQGDALPMLEARKIKVDGTGRTSVDGVWAGGDCASGGDDLTVTAVAEGRDAAMDIHMVLMG

SEQ ID NO: 75504 - protein, 378 aa, Medicago sativa
MAIHHHHQQHTCSLFDALYCDEEKWEDDEGEVVDEGEQSDVTTTNYDILDSTSLLPLLLLEQNLFNEDEELNTLFSKEKIQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDHGVDYKNQLLNVLKTSKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 75505 - protein, 140 aa, Glycine max
  misc_feature (54)..(54): Xaa can be any naturally occurring amino acid
  misc_feature (66)..(66): Xaa can be any naturally occurring amino acid
  misc_feature (103)..(103): Xaa can be any naturally occurring amino acid
  misc_feature (119)..(119): Xaa can be any naturally occurring amino acid
QTGFPMKHVVLTPGLVTLLLLTGSPCLRGYGRRIGERRIKSLRRCIVMPDLSVXNSVILKKGENDXPGLTDVEKPRMIGPKRASNMLILFNLSQEDVVWKSVXTYRHTSTTNAGKKESXAPRIHKLATPLTLQTTRTNTA

SEQ ID NO: 75506 - protein, 325 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIR

SEQ ID NO: 75507 - protein, 398 aa, Streptococcus pneumoniae TIGR4
MAKLTVKDVDLKGKKVLVRVDFNVPLKDGVITNDNRITAALPTIKYIIEQGGRAILFSHLGRVKEEADKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADNVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 75508 - protein, 319 aa, Rhodopseudomonas palustris CGA009
MAHPHDVSVCGTYILDILGVPVTEIPAGGGRALIDEIRLTVAGTAGGTVVPCARLGLKALAVGAVGTDEKADWVLDAMVREGIDISVMEKIAGAPTSATILPIRPDGSRPVLHARGASARWKISPEAQKVACGSKVLHLGGVGSLLAMDGEPTVSLLRDAKAAGCITTVDLIQARGETLPLLEPLMPYTDFFMPSIDETHALIGSGDPATCARYFIGKGAGACAISLGEHGSFVMTRDGRQLTVPAFDITVRDTSGCGDSYTGGFIAGLVRDWDLQDCARLATATAAIVATGLGSGANLVSFEETVKAMNTLPVRGARA

SEQ ID NO: 75509 - protein, 93 aa, Populus trichocarpa
MGYIQEARENHVKKKVEEALRSKMKQKALKQCEELASKYAQCATGRTMSVVWQCRKQAKELNECLHQFTNDAVLEEMKREYTLQQDVKGPLRA

SEQ ID NO: 75510 - protein, 221 aa, Francisella tularensis subsp. tularensis SCHU S4
MAGKGDVFIIGIVGGSGSGKTLFSNAIIKKLKSKHLNKIAVISEDRYYKNWGEMVGFEEACKINYDHPDAFDHKLLRKDLNNLVQGNDIYIPHYDYTTHSRVEEKAEKITGGVSVIILEGIMLFNDRKLLKMMDFKVYMDTPADLCFIRRLMRDQNERGRSVESVINQYLETVRPMHIKFIEPSKRKADIIIPDGAQNKTVIDIIYNKVRQLLKKNGVKNG

SEQ ID NO: 75511 - protein, 336 aa, Oryza sativa Japonica Group
MGSEEEPSQMRRALVDALAGAISGGISRTVTSPLDVIKIRFQVQLEPTTSWGVLRRDVYGPSKYTGLLQASKDILREEGLPGFWRGNVPALLMYMPYTAIQFTVLHKLKTFASGSSKTEDHLHLSPYLSYVSGAIAGCAATVGSYPFDLLRTILASQGEPKVYPDMRSAFLDIMKTRGFRGLYAGLTPTLVEIIPYAGLQFGSYDTFKRSMMTWNRYRYSHLNSGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWIGSKAGVE

SEQ ID NO: 75512 - protein, 388 aa, Rhizobium leguminosarum bv. viciae 3841
MSIVSSISPRALAAPESGIVELVNYARGREGLLPLWVGEGDLPTPDFISRAAMDALAAGETFYTWQRGIPELRQALSDYYDRHFGIRLPVEHFYVTGSGMQAIQIAVQALTSPGDELVYLSPSWPNIAAALEISGARSVGVELQFAGGKWAVDLNRIEAAITPKTKGIFINTPSNPTGWTATKQDLGDILALARKHDLWIMADEIYARYSFAGGRAPSFLDVMDEGDKIIFVNSFSKNWSMTGWRVGWIVAPPEMGQVLENLIQYSTSGVAQFMQKGAVAALDQGDDFVAANIAKAARSRDILCDALVATNRVETLKPDGAIYAFLKIDGVTESRRAALDIVDKTGVGLAPGTAFGQGGELFLRACFLRDPTQVAVAAERLCDYILKL

SEQ ID NO: 75513 - protein, 397 aa, Physcomitrella patens subsp. patens
MGTSLSIWVLIMAVLVWFFASDPLELSSLSGIEDFQAQYVAPPPYNPLSGISRDVESKLQAAEILGQGEIFGPESLAFDAQGNGPFTGLSDGRIVRYDGPELGWTSFATTSKNRSAICDYNHIPEAKLDYEHICGRPLGLRFDKRTGELYIADAYLGILKVGPQGGLAEPVVTGFNGESFKLCNDLDFDEDGNLYFTVSSTKYQRRQFFLSRLELDNTGRFFKYDPVSKETTVLIQGLRFPNGVAVSKDGTFVVIAESNMARLLRYWLKGPKASTWEVWMDLPGVPDNVRRNENGDFWVAFHNKRTFMEMYTGALPWLRHLVAKLPIPSKYLYAMLAPKPHALILRYSSEGQLLETLEDQPGKVVKVVSEVEEHDGKLYIGTVLFPQVAMYALSSSA

SEQ ID NO: 75514 - protein, 286 aa, Brassica napus
  misc_feature (272)..(272): Xaa can be any naturally occurring amino acid
MGLGKRVIVSLVLMAIVTNCCVKATIAEDVAKSKSWTDWAKEKIGLKHEENIPTTHTTSTVEDNAWEATDKAKDAKDAAKRKAEEAVGATYETAKSKAGETIGSLKDKAWQSYDSVGQVKDDLPRKSKQVKDSFSGDNSDKSWTDWAKEKIGIKHNENYPNMGDTVSEKAKEAKDAATRKAGDAKERLEFFVEAAKEKASDLTSAAKEKAEKLKEEAESESRNAKEKTKEHYETARSKAEETLESAKDKASQSYDSAARESEQARDNLSHKXKRVKDTSFNEEDEL

SEQ ID NO: 75515 - protein, 357 aa, Rhizobium leguminosarum bv. viciae 3841
MPLLVKTKAGMRDMAVLVTGGAGYIGSHMVWALLDAGEDVVVLDRLSTGFRWAVAPAARFYLGDVADPDILKKVFIENDIEAIIHFAGSAVVPVSVADPLSYYDNNSGKTRALLSASVKAGIRNFVFSSTAAVYGQQKTDLPVKETAPLNPENPYGQSKLMTEFMLRDAAAAYDFNYVALRYFNVAGADPHHRAGQSTSGATHLIKVACEAALGTRDSVNVYGIDYPTHDGTGVRDYIHVSDLTDAHLKALQHLRRGKGSLVANCGYGSGYSVLDVLNMVTRLHGHSFKIHMAPRRAGDSASVVADASLARQVLDWKPRYDSLETIVQSSLDWELFLSNKNVDDLHSIHRALAAASF

SEQ ID NO: 75516 - protein, 499 aa, Trametes ochracea
AIGPSANLVVTNAAVAADGHSRDAVVVNGGTPGPLITGNKGDQFQLNVINNLTNFTMLKSTSVHWHGFFQKGTNWADGPAFVNQCPIAAGSSFLYDFSTPIQAGTFWYHSHLSTQYCDGDRGPFVVYDPNDPSANLYDVDNLNTVITLTDWYHTAAQNGPAKPGGADATLINGQGRGPSSPSADLAVISVTAGKRYRFRLVSNSCDPNYTFSIDGHQMTIIQVDSINVQPLVVLKIQIYAAQRYSFILNANQAVNNYWIRANPNQGNVGFTNGINSAILRYSGAAATQPTTSQTSSVQPLDQTNLHPLTATAVPGSPVAGGVNLAINQAFNFNGTNHFVDGASFVPPTVPVLSQIVSGAQSAADLLASGLVYSLPSDANIEISFPATSAAAGGPHPFHLHGHAFAVVRSAGSTTYNYNDPIFRDTVSTGTPAANDNVTIRFKTNNPGPWFLHCHIDFHLEAGFAVVFAQDIPDVASANPTPNAWSDLCPVYDAASSSSQ

SEQ ID NO: 75517 - protein, 256 aa, Bifidobacterium longum NCC2705
MGARGCRLNRMTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 75518 - protein, 456 aa, Francisella tularensis subsp. tularensis SCHU S4
MSSQIKQVFARQILDSRGNPTIEVEVVLESGAFGRAAVPSGASTGIREALELRDGNKALFLGKSVYKAVENVNTKIAQAVKGLDALDQRLIDKTMIELDGSENKKNLGANAILGVSLATARAAASHLRKPFYRYLMDVKEYLMPVPMMNVINGGSHADNNVDMQEFMIVPAGFDTFSEALRCGTEVFHILKKVLIADGYSVAGVGDEGGYAPDLPSNEAAIEAILKAVKEAGYEPGKHVFIALDPASSEFYKDGKYELKSENKSLTSEEMIDYYAAWVEKYPIVSIEDGLAEEDWAGWKLLTEKLGNKVQLVGDDLFVTNPSILAKGIEKGIANSILIKLNQIGTLTETFEAMAMAGQAGYTCVVSHRSGETSDTIIADLAVATCSGQIKTGSLSRSDRIAKYNQLLRIEEELGENAIYPGIKAFVFNSDEEVEEVVQEIIVEDSEAEKVVVQVEE

SEQ ID NO: 75519 - protein, 372 aa, Medicago truncatula
MSFVRNFQAEDCNLNGGYRSTYDGNNTDRKRSRNHYNQRNYNNYYDNHNQANFGYYGGNFNQCNADYANYANVASSSLKKRKYSAPVRGESQKFTLPATVYDSIPSSRNFQAYPARSIAYNSTSASLKPDFSIFDDDKPIFMSRDDIDRNSPSRKDGIDVLHETHLRYSYCAFLQNLGTRLEMPQTTIGTSMVLCHRFFVRRSHACHDRFLIATAALFLAGKSEESPCPLNSVLRTSSELLHKQDFAFLSYWFPVDWFEQYRERVLEAEQLILTTLNFELGVQHPYAPLTSVLNKLGLSKTVLVNMALNLVSEGLRSSLWLQFKPHQIAAGAAYLAAKFLNMDLAAYKNIWQEFQATPSVLQDVSQQLMELF

SEQ ID NO: 75520 - protein, 394 aa, Streptococcus pneumoniae
MKIAIAGSGYVGLSLAVLLAQHHEVKVIDVIKDKVESINNRKSPIKDEAIEKYLVEKELNLEASLDPAHVYKDVEYAIIATPTNYDVDLNQFDTSSVEAAIKTCMEYNDTCTIVIKSTIPEGYTKEVRDKFNTDRIIFSPEFLRESKALYDNLYPSRIVVGTDLDDSELTKRAWQFADLLKGGAIKEEVPILVVAFNEAEVAKLFSNTYLATRVRYFNEIDTYSEVKELNPKTIIDIVCYDPRIGSYYNNPSFGYGGYCLPKDTKQLKASFRDVPENLITAVVQSNKTRKDYIAGAILAKQPSVVGIYRLIMKSDSDNFRSSAVKGVMERLDNYGKEIVIYEPTIECDTFMGYRVIKSLDEFKNISDIVVANRMNDDLRDIQEKLYTRDLFGRE

SEQ ID NO: 75521 - protein, 190 aa, Zea mays
MATVNATTTTAGSGKQTDAAPSPPAAAAAACRSLSGADLALRVLLFAVTLSGLVVLATAKQTVRVPVPQIPGLVLSLPAKFKDSPALILLSTAFTSLKLLSGSSPSRTLFLLVLFDVFYAAIMASATGSAGGVAWIGLKGNSHTNWNKICNIYSKFCRHIGSSVFLGLIASVVLVLLTILNAHSLYRRSR
